United States Patent 11,549,145 (METHODS AND COMPOSITIONS FOR INHIBITING AND TREATING NEUROLOGICAL CONDITIONS) - sequence listing, part 15

SEQ ID NO: 86 - DNA, 1571825 bp, Homo sapiens
acccttagagtaactgttaatataataatgagtttcttaaagtaattctatggggaaccaataaaattgtgccagagcacacagacatgtggttgtctgacttagaaagtaactctgaacagaaaaataaatatataatgtattttttatgaaatcctcttttgataaatattttacaatcatgaatttgatattttcttgagaagtattgattatagccattttgtttgcattttaaaggtgtacttacatggtttggccatattatgaaataaatgaaggccaaataagcctacctcaatgtgggggtgggcttcagtttgaggggtaggctggaggaacactgaaaaagagagctaactttttttcttctctttttttttttgagatggactttcactcttgttgcccaggccggagtgcaatggtgtgatcttggctcactgcaccctctgcctcctgggttcaagtgattctcctgcctcagcctcctgagtagctgggattacaggcacatgccaccatgcccagctaattttgtatttttagtagagacagggtttctccatgttggtcaggctgacttcaggtgatccgcctgcctcggcctcccaaagtgctgggatcacatgtgtggccattgctccctgccagttttttcttaagaagtagttttgtgtctactccagtgcatagagtaaaagccttagcattttccacaatggagtgtgaatctattaattttagacataatgtcatacctgtttgcaaaagggagctaattcttcaacttagccaaaaagccatgtaagtaagtaatcattaggagttttaactcaatataattttttgacttataatccaagataagcctagctaatataatgagcttgtttttaagtagaggtattaaagatatggcaattaattgttgaggtgtatatatgttaaatgatctgtttcttttgaattatacttctgtgatattcccttttctttttttttttattgtggtcaacccccttttctttcataatagctagctaaatgggaggaagtgtattaaattgactactactccatacccagagtctttacccactcttaatatcaaactagattctaactttaggtataatctacttaacctctttgaatagtaaatgatacctactatataagatttccatgaaattaaataccacctgtgatggttaatattaagtgtcagtatgactggctagagggatgccaagatggctggtgaagcattgtttttgggtatgtcagtgagggcatttccagaggaaattggtgtgtcatacaggaccaatagaaacaagcagatgaaagcgaggggtttctgtctgtttctctttctgtttcctcgtctctccccactcccatttctctctccccattccataaggaaacacctttctcctcctttccttggacatcagactccaggttctttggctcttgaattatgtgacttgaattagcagcctcctggggtctctcgggtgttcagcctcagactgggagatgcactgttgtctttcctgattctaaagctttcagactaggactgatccatgccactggcttctctggttctccaccttgcagatggcctctcatgaaatttccctgactctgtgagttcatttccctaataaaccctctctcttatttcttattggttctctctctctggagaatttggactattacaccatcataaactctctcaatgcagtgcttaatccaataaatacttctatagtaaaaatatattttttatttttatttttaatctgcatgtaattgtctccttatctttttattctctatgagagcatcagttttccagtttatccaatatcataaaatgacaaaacaaaaaagtaaaaatataatcaaacctttcctcactcaactagaaatttctgtttattttttccagagaaatatagaaatatctgaatcttaaagaaccttataaaaccattaggtattagcagatgcaggtgtatattgcactttcacatattaaattattgtcaagtcttctccataaagtcaaaagctaaatggaagtaaacgaaaagagaacttcacacgaagtaatggtgggacacaatggtccatggtggtacacatggactaaatccatatcaaaaatctgagttaccctccacttaaaataattccatatgtttcaaacacaattaaggaaactggaatacatttgagattcaattttgaataactaatgtgtgttaaatttgagcagtataaaagctgccctttgcaaaaacatcctggatccagatatatatttgaaaaaaagaacttaattggctataataatagcagtgatggtcacctattctttaggacagttttttaaaaaactgtttgaggctgaaatatatttgccttctgtgggcaaaacctgatgaccatattaatttaggccccaattttttttttttctgaggaatgtaacaattgactaaactgaaatgaaatactcttatttgaatgcttcccacaatgtctttgtactcagaacaaatatttagaaataggtagtaaataaatgtgtatcaaaagaataaagtctattaacattaaaataagataaaaagaaaattttaaacaaattttgtatcaaaaccacattctttatgtatgttttgtgggggaaaccatatatctgttttcaaagttggctcccaaatttttgtagcttctcaaatacacatcaagttataatgcttagtaggtgtaataatatttgtcaatgacctcagcaggtaaatttttatcattacttggcctccatatttgattaaattcaatcaacatttatttagctcctaccatttgcaaagatctgcctaatgtgatttgaggagaaaactgaagtaagacatgtctctagtctttaggaagcttccatatgcacggtaactagatatccagatttcatttggaaaccagtagactcttgagcatatgtaatgattcctagagcggtgaggtgagaagaggagagcatgtaagataagtatacatgtaaatctaacatattgagccaactgttatgaaaattacaaaattccccatggtgattaaaataagagaaaataagatcaatatgaaaatcattaatggacagcaaagttccattcatacatatatagagaaaagaaataattctcaaggcaattaaaattagaactttccaatttatctgatgcacatgtgacattcacctggtcatttagtgtaattagaaattcacattagtcatattaaattcatggtaaaatacaaagagttcagaatcccaaaccatagtgagatttaaaattatgtttatgtttgagagaataaattgagattagcatacataatttaagttttatgaaatcattctcttagatttaatagatggtgcttttatataaggaaatgaacatggctcatctcgctgtattctttttgcaattccataaaaatattctgacaagtaattttagaatctggaagtcttgtttttggggttagactattgttttctaattaatataattttaaagtttaaatttatttttcagattttacatgtgaaacattaggaaagattaatacattgctaatgacatgaaggtagtatggaaaagtaggcagaatagcaacccaaagtctaaagctatgactccaccattaataaacacttagaatttagtaatgtcacattgtgtttcttagttttaatattcatgtgaaaattacgataataacacatatctcacccagaagaaaaaaaaattgtgaagaaacttagaagttctaaaaatataaggtataatgtaaacatgaataacaataacatttatagcttgatgttttttcaggccttgtaattttcaaaatatgtgtatatagttagctgattagaagaaaatatggttgactcattactgtggaaatagcctgatacagtgaaaaggccatgttttcagttagaagacttagatttgagccctagtccaatcactttttagttttctggtttctgtcacatcattcatccttactgaataccttcagtttccttaggtgtgatctatctgaggctcatagatctgtcccatccacttgaaaatgttgatgtgatgatgatgatgagttcagatgaagcatgttaaagtacttcataagttcctaaacaaatataactttatttttcttatcttgattttctaaacaaattcatttgtgtagtatgttagctctaggcagaaggtgcaggaataagtacagttcagagaagctgtagtggggtagtcaatggcttccaagcctgagtcagaactgtcaatcttaggttcacagctgggtgtgctccagagaaactggaccataggaactgcctgtcatgaagttttataactattccaactattcggtgcaaggtgattgctgccagcacttctctatatgctatgggaaaattacacaccaaagatctgtcatatacaattgctttattccagatactcacaatccagacagagagataataaacacaaaagtactctaataagaataaagagtttaaaaccatttaccaagtttcacaaagaagaaactgttaattgacaaatgacaagttaagaaaataattgcccctctcacaaatactagagatctgagcatatctgtctgcagatgggaagaatcaagtaaggcaaaaaagattcaaaatgcacgaatgaatgcaggtaaggagagggaggataatagagcaaggggttttcagtaggcaaagtggaattagatcaaagcacaagtaaagcagacatggaaaggaggaggggcagaactctgagaacaagggcattaatgagggaatgtttatagaaatgtatattttgaaatggagagaggaagatgagaaaactgatgtctgatgttgattttatgaatcatctgatgaacataatccctaaatttatgaaactacatctgatgaacatcatccctaaattcatgaaactactagttttctaaactaagggttgtgatctgtgagtgggtcatgactcattatggagtcattgaatcattttagtgggttgcaactagtaatgttcaaaaataaaataggctgaaacagacaatattacatcccactgcattttgtaagagcaaatttgttttgtgaaattttgttgcagttaaatttatatgtatgtgtatcctgggtcatgaaataaaaaggatattttctgtggggtgcagttaaaaaatcccaaaaaccactcaactagagaatctctataaactgaacagaaatattgccaaggggcaaataaagcttgtacgtatcatgctggtttagatttgtgttgagtagttaatacaatgtctgccttattccagtggttctcagaaggccagaagcacacattaaggaactagtgatgttgatcaaaggttagaaattagacccagtggagttagggctgttagggaaatgaagatgccctgggtgttgttgaggctaggtcaaggtggcagacctgactttccagactattgcaggaggatcctcaattattaaagcttcagttgttggaaaatatcttttccattgagcttcaagtctaccttcttgtaatatctactcttaatatctatgattttgtcttctggtgccacacaccataaatctaatcacttctctacaacaaggagttttatgtttttaaaaatagctattgtcatttgggttcacttgggtctaaatgtaatgctagttcagggagccctagaggcctggaatcttataagagtgagtacaaaaatttagttgaaactgtaggcatgataagggactggtttgtgcaggacagagtctgtcaaatctgaggatgcccaaactgaatgggacaggtgtgtgggtcagcagagggcacacacatatgcagaactgccaatcaggaaatgagatggcaaccacaacatcatttctgaactcttctccctctctttgaattggcaatatgccttgagagagggcctgataccccagagttcaagtcgctcttaaatcttcattcctgctttttcttcagctttttctcatgggttttcagcccttcatatgtcctcagaacagcacagcccttcaacttttctaaatccagctatttagaataccttaaatgtatatcactggccagtttactgtgcttctgaacatgtaaggaacttatcaattgaatataaaattaagctacttaaaaatatttggataaatcagctgtttttgaatgactgattctgtgtttggtcacatcgatagacccatttatctatgagggttcccatatgtagattagtttatttatatctacagatacattgagtggggaatagaagtttcgcctataattttactcacttttaacaatgtggactttctgtctatattatgtcatttttctttatatatatatataaaatttaatagattgacatttttattacattagttttgaaactttcattgaaaaatctagtgtttcattgaaataactgtattatatatggtctcttataattcaactgagtgtttaatattgggcaaatacattcttatgtcattaatggtatctaacttctcaattaaaataaattctctattcttgtgagttatgtattgcacattaaattaggataaaataataattaattaattgtaaatattttgaataaaatgtcttgatttctagttactactagtatttttaaaagagaagcatgatttatttttcagacaataacttacaaataatcatattcaaattgtcattttataagtaggaaactgagttctacagatatttaataattttcaaagtcattttgctagtcagtagtaacagaacctagcctgtatttctagcttgaataagtactttagcttcctcaaactcttgtgggttaggtctgatactgcaatagaaaggctatgtctatcagattcccttttggttatgtgagctttgcgtgggtttgttcatgtaaatcccatgctgaggtgaaagtttttttttctctctttctcttttttttctgtaaaatgagcgttttgtactgctaacataattcttatatattctaagtgaaaaatcattacatagttgtcaatgtatctcacctctccctaaataacctctactatttatgatttagaaatgaattccctccttacttgacctcttgcttgatttataatcgacatagttcctatattttctgcttatattcttcattttatatttagtgcatctcaattgatttttcttctttaccttgcatttttttccacttttatcttcatcttccttggctctctacactgagtataaatactagaccatagtttcaacccatgggagcagagcataatttcttgctgagtacttaaaattttcctatttcattctattttataattgctttacccactggttttcagaagataggccttcattattccaaagtatgcttggtttattgtttaaaagacacaataggctcaccccactttagtccatttctagccatgctttattctttgtttaacttttaattgctattccaaactctacagtgtctgtagcagatgctggcactgccgtgtctgtattactcaagcctttcaagtgtcctctaactttctcccaactgtcagtacctacatctctgtctctgtgtctgaggcattcgtttttgtttttactgttgttttacttcctaaaaccactgaaggccattctgctcttacgtagaagagatatgaggctggacttaatacaactttactcccccaaatccctaacaaataaccctactgaatataaacattccattccctttataaacaggagaattctgaagcataggttttatcccaagttccagtacttttccatgagatgaagcttcaattattcactccaggtagctgatttcataacaacctttgttggtgcttttttccttctctgaaccactacctctactccctgccagtgtttcctggccccctgaaatacactatttaccctcaaatctttgtttcagagtctgtctcactaatttccttgaagctatagctctctgatttatgaagtagtgacaacacttgagttttggcagaattaaataaatgtgcagaacctgattcataataggtactctaatactattgtacctagttaaaataaatgctgtctttaacctctgagtactttctcccaaatataattttgctccctctatatctcaatagaatgagctattttttactgcatggacagagccatgccagtggtcaccaatgtgataaatctgagggttgcatatgaagagttcacacatttttcttttatgcctgcaactccattgctagtcacacattttcacgcagtgagaatagtctttttttttttttctgcagtcctattttaatcactacaaacactacagggtaatgttcaatgaatggttattggaagagtctacctttttcttttttttttttttctcttaaaggaacaatatgctatgatctttcacactttccaccaacttctcttctccaggcttttcctacttatcctgtaaaacttaatttacaggtcttctacaaagcttgacctcatcctccaaagcttttagttacttttactctaagttgccatagcttttaatatttatttcaatcaaagtgcataatctcctgaactgttaacttatttatctcattagcaagatccttaattgatgaggctgggttatttattattgcaactcaacacctagaacaatgtttatgcatactgacactcaactgttagatgaatggattaaatttataaatactgttggaaagaagtaagctattgttaggccttaaagtggctttaattgaatctaaattttaattgaataaattggtacatctcaattgattttgcttttttaccttgcttttttcccctatatattaaaattacttttaattgcaaaaattgtaattacttttgtaccaacctaataaatagttatggaatatgtattattccactgcctcaaatagacacagctgactatttctcatttaccacccctacttttatgttatcatgtaattaaccatattctcctgtttctaatgtgtggacaacatttaacttgctaatggttgatctgtgaatattttttactttagacacaaagaagcctttaggtcatattatacattgaaaaaaaaagataacttaaaataatacagtattaggatttgactcaatttctgcttaagtaaaagcaaagaaactagatatcaaaatgcatactttttccaaagcatatgtaatataaaattacatttatttcattttgttatatttgtcataatttatcacctaatttataatgtattgatcttctaaatgttggaatacaaagcatattagtttaataaaaggttgaataatgtgttttacttaccaattaaatcactatatagtatagcagtgctgtaggaggaaaactagtcttccaaaaatcaaaattttcatatatgttggaagagttggctatcacaatgttacataggagtagattcttgttttctttttaatggatgctgacaagaatgcctgagaatcctatctgctggcattggaagattttacaaaatacaatctgatagtattttccctacttaacattaatcttcttatataatcacttggtcttctataaaattatttgttaattaaaagaagtcctatcattactcttgatactgcaaaaaaatggcctttatgagtaaacataaatatgtaactaaaacataaatgaaatcaggcagttacaaataagaaaattagtcatttggggcaagctgaagagttaagaaaacacgaggatataatttactggcacttcagataaaatagaaagaaataatggggcttctctctaggtatacatattataaaattatagtattttggcatatttgtagtgttgctatttttatcagaccagaatgcaccattctcagctgtatttgagttgagaagaaccaaatagtttttaatattgagtgttcaaaatattgcatgggatatacttatactcaaaaataatcattattcatctgaaattcatatgtgactgggcctcctttatctggtaaccctacctagtaggaaagaatgttgtgtacatttttaaaatactgattaacctagtaatatgattatttaaggaaacataaacaaaggactatttctgaaatattttccagcgaagtttggaaagcagtcttatctattgtgttaagataaagaagggggaaagtcatattttgttttgttttgtttttttttattaacttcaatttcttatcacttttgaacatacaatatgtatttacttaggagtcaaaagttcatgtggtaaataaacactataaatgtaaaccaaggatcaatgcttcaaaagcaaatttattcagtataaaatgtcagagcagcttttatatttccaaatacataagatgtaaattggaaagtgtttgcattttaactagctttaacacatccattatataataacatgagaggaaaaaggattacagcttctattttactacccctttaaaattccttcattttcatttttgtataatgtggtttagaggagaaaaatcagaactgacaatattatttaatgaaacttttaattatgtagataatgtaaatctaacaccaagtctgcacatttataatgctgttttcaacattgtaaaattgtggtattcaacagttgggaaatctggagtaatgtttgtttatctctcagaatttgctatacagcttatgacaaagaattcaatgtgaaccacttctgaattatgatgattatatatagatgaaatgtttcaaaacttactacatgtgaagcactttgcctcatgctttgcaaacattgtatactttaatattacgagttttaaaatattagtatatttgaaaaatcacataaacacttccttttcagatatgttttgctagataaccctctaaagataacactgaataaagtaaaaatccattgctgaaattgcacaaaaataaaaggtatgcaaaatcgaaaataataaaaaagctgtaactctgagtgaaaagtgaggattgaagatggctatcacttaaagaattttgtattatcctagaaaacttcatcttttaaaaaacagcttcatagcacctggagacaaaagataaatactggggaatgcccaagctatagagtctaagaagataaaccccggacataaggtttacatcctcagcttcaaaggagatggtgcaaaactaaggtgtgacaaagtatggatcaaaacattacaaagaaccttgtccatcatccatagtgctaagggaatgtgaaaaaacaatcaatctgagaattaagttctcagcagagttttagtataattcacaatctttatgatgtgaacaatctcaaatttacttattttaaaattgtgtcaggcaacttacactggcaagaggcaaatgtttcctagaggaatgacaaattaaactatgacatcacataatactcaagttaaagttctaagaaaaataaaaatctcatggacaaaattcacaaagtgcaacaggaataaggtgtgattaataagagattaatacaaacatcaaaatcgtacccacaaagatgttaacatactgaaaatattacaaccaaaattacaaacataactatgactaggagattttaataaatgagaagcttgaaaatacaagcaagtaaataaaaactcagaaatatttagaaaacaaaaaataaacttctaggattgaaaaatataaattaaaatgagaaagaaacatcaatgaataataagctgtggcctaaaaaatagacttgaagaaatttcacagaatttctcacagagactttggttggaaaaatatgaaaaaggaataatagacatactgctcttaactagctaagggaaaataataaaatgtaaaaattatagccgtttaaatagcagaagagtttcaagtggccagtatttgaacacaatgaaattaaatcagaaaccaataagttttaagtaggaaattttacatacttggaaattgtaagaattacacctaaaatttcatgaatcaaagaaaatatcaaaaataatgatggaaattaagatattttatttttccaagatggtggattagaggcttttagcatgcttcagctgctttgaaataggaacagtgcataaatattaactctgtgaggtttgattcaagaaagacaatgggaatccaccagaataatgaaggacaccctaaatcctgggaaggagaacatgagcaaaaagcccctgtgacagcatccagctgttaaaagtgagtgaaaccctagcacacgagaaaggcagacagcctccttctgtgactcaactttccactgaggatctaagtaacccagggagagggagagccctttgtttcactcaagccatggagctaacttggggagaggcttggaggtgctgtgaggaataaacactgggaaaagctgcagacattttcccagacctgagaccgagagcaggatgtcattataacctgggtgcacacaaagtcagccattttgtggtgactccgcaatgtggccacttgggcattttagtcttggggcagagatagaagtacctgctgtggaccagggtacagacctccacaactagaacaatagaaagtgtctcagcagcaggtgctggaattgtgctccccactgtgggacaagaggagatatatgacagctgcagtttctcctgaacaataagacttgcagccaggagcagtttgtcaacctggaactgtcatttttcagtgccccagctgctaccctgagatcatggtgcagcaggcctctttcttttccatcacaaggcagaagtctaggcatttggaacacctgcttgcctggaccagcagcttaagcctcctcacacttcatggacatagactgtggtgcagcagggccctctcagatttccaggcatttgaagcagctactcatctggattagcagcctgacctgccccacatttcctgtgcagagatcctggtgtaaggagctcctctgtgttttatacccagtgagatctccaggcatttgagcacctgctcacttggttcagcagcctgagccatttcattcttcctggcaatagatcatgatgcagtagggtcctctctgctgcccacccaggcagatctccagacattctgagcaaccactcacctggataagcagcctgaactgtcccaccctttatgggcatagattgtggtgcaataggaccctctctactccatacttaggcatatctccagatattaaaagcatatacttgagcagattggcaacctgagctgccccacccttcctgtgcagagatctgtatgcatgggtgccatctctgcttcatgtccaggcaaatctccaggaattcagaccacctgcttgcctggttcagcagcctgagttgccccaccattcctgtgaggagatcttggtgcagggggctcctctccactacatgcctgcacagatctccagacatctggagcacccactctcctggattaggagtttaggcttccctcctacctgtgcagagaactcagggctgaggagatttcctagttccacacacctaggcacacctctgggcacttggtggctgcccagtggattctcctttgacactgatgtctgtgcctgacatcaggagaacagaaactggacctgcctggtctagccttgtttatcagggcccccacccctccagggatgagtagggtgttcaggccattgtgcactccacaaatcaggccattgcctgaggcaacagagggcttctgccattaaacaaggatcaggtgtataccgagctgtgttggtcgcagctagctcttaactataagcaccatctactggctggtaggtccaaccacagagcccaatattcaactgctgacagaagcgcataaggctatagaagtaaaaccaaaacaacctacccaacattgtctacaatcacataaccagggatgggtaaagggaaagggaaataaaaaaataataataatattacagagaaataaagaaaaagaaaaaaaatctacccacaggaatataattacaaaaattagaagtcctagtctccagatgacaaggaaccagtgcaaaaattaaggcaccatgaaatatctgaatgtagcaacaccaaaggatcacaatagctcttcagccacatccctaaccaaaatgaaaactcagaaatgacacaaggaattcaaagcatggattacaaggaagctcaacaagatccaagacaaggttgaaaagcaacacaaaggaatttctaatgcaattcaggaaaggaaagaagagataagcatattaaagaaaaattaatcagatcttctggaattgaaaaactcacttaaaggaatttcaaaatacaatggaaagctttatcaatagactgaaccaagccaaagtaagaatttcagagcttgcagactggtcttttggagtaagccagttaaaccaaaataaagaaaaaaaaagttttaaaaacaatgaacaaagtcttcaagaaatatgggatgatgtaaagcaaccaaatctatgaattcctggcattcctgaaagagatagagaaaagatgaacaacctagaaaacatacataagggaatacttcaagagaatttttcctaatcttgctacacagtagacagcaagatacaagaaatccagagaacatctgtgagatactatacaaaacgaacaacaccaaggcatgtagtcaccagtctgttcacggtgaatgctaaagaaaaaatcttaaaagtagttagagaaaaaggtcaaattatgtacaaagggaacactatcaggctaacagtgagagttctcagcagaagccttacaaaccaggagagtttggaggcctattttcagcattctttgaaaaaaaaagaaaaaagaaagaaagaaggaattaatgaaattccagccaagaatttcatatcctcccaaactaagcttcttaagcaaaggagaaataaaatctttttcagaaaagcaagaagtaaggcaatttataatcactagattattcttacaagtaatacataagggagttctaaatagagaaacaaaagtacaatacctgctaccacaaaaatacacttaagtacctagcccacagcccctataaagcaaacacacaattgaaactacaaagcaaccaactaaaaactcacgacaggatcaacctcacgtatcaatattaatcttgaatgtaggctaaatgccccccttgaaagtcatagagtggtaagctgaatttaaaaaaagcacacagaagatccatgtatctgctctcttcaagacaaccacctcacagtagcagcacctatactgtcaaagtaaaggattggaaaaagaagcatcataagaacagaacacacaaaaaaaggcagggtagctattcttatatgaaacaaatcagattttaaaccaataacagtaaaaaaaaaaaaaaaaggacaaagaagggcattacataataaagtgtttgacacaacaagaagacttaactatcctaaatatatactcacctaacattggaacacccagattcataaaacaagtacttctagacctatggaaagatgtagatagccacacaataacagtgggggacttgaacactccgctgacagcattaggcaaggaactaacaaattctcagtttaaatttaacaattggccagttggacctaatatatatgtacagaacactctacacatcaaccacagaatatacattattctcacctgcacatagatcatacaccaaggttgaccacatgttcagccatatagcagttttaacaaattgttcaaaaaatcaaaatcataccaaacatactcttgaaccaaaggggaataaaaacagaaatcaataacaggaagatctctcaaaactacaaaattacatggaaattaaacaccttgctactcaatgacttttgggtaaataacaaaactaaggcagaaattaaaaaaaattatttgaaataaatgaaaacacagatacaatatactaaaaatctctgggatgcagcaaaagcagtattaagagggaaatttacagtgctaaatgcctaccacaaaaaagttagaaatacctcaaattaacaatcaaacatcgcacctacaggaaataaaaaacaagaacaaactaactcctaaggtagctgaagaaaaaaaataactaaaatcacaccagaagtgaatgaaattgagaccccaaaatctacccaaataatttatgaaaccaaaagttgggtctctgaagaataagtaggattgatagactgctaactagactaacataggtaggccagctgtggtggttcacaccagtaatcccagcactttgggaggccgaggctggtgaatcacaagttgaggagttcaagaccagccaggccaagatggtgaaaccctatctctactgaaaatacaaaaaaattagccaggtgtgttggcgggtgcctgtaatcccagctactcaggaggctgagggagagaactgcttgaacccaggaggcagaggttgcattgagctgagatcacgccactgcactccagcctgggtgacagagcaagattttgtttcattaaaaaaaaatataggtaaaaagagagaagatccaaataagcacaatcggaaatgacaaacgtgatgttacaattgattccacagataccaaagaccctcagatattgttatgaacactcccatacacacaaattaggaaatctagagaaaatgaataaattcttggaatcacacaatctccctagattgaatcaggaagaaattgaaacccttaacaaaccaatatcatgttctgaaatggaatcagaaataaaaagaaaaaatctaccaactaaaaaaagccctggatcagatggattcacagcagaattctaccagacatacaaataagagctggtactaatcttcctgaaactattccagaaaatcaaggaggagggactcctccctaactcattctacaaaaccagcatcccccgataccaaaacttggcaaagacacagcaagaaaacaaaactacagaccaatatccctgatgaacacagacacaaaaatttctcaacaaaatactagcacagtgaatccagcagcacatcaaaatgttaattcagcatgatcaaataggcttcattcctaagattcactgctggttcaacatatgcaaatcaataaatgtgattcaccacataaacagaatgaaaaacaaaaaatatgatcatctcaatagacgtgagaaaaagcttttgacaaaatctaacatgtcttcatgttaaaaacattcaaggaactaggcatcaaaagattgtacctcaaaataataagagccatctatgacaaacccatagccaacatcatagtgaatgggcaaaaactagaggcattcccccttgagaactggaacaaggcaagaatgcccactctcaccactcttattcaacatagtactggaagtccttcccagaataatcaggcaagataaagaaataaaaggcatccaaagaagtaaagaagaagtcaaaccatctctttttgctgataatatgattctatagctacaaaactctaaagactctacaaaaaggttcttggaacacataaatgacagcagcaaagtttcaggatacaaaatgaatgtacataaattaacagcacttctatacaccaataatattcaaggtgagacccaaatcaaaaacacaatttcatttacaatagccacaaaacaaaaaacaaattaaaaaacaactaggaatacatctaaccaaggaagtgaaagaaacaagacatctacaaaatactgctgaaagaaagcataggtaatacaaacaaatagaaaatcattccatgctcatagactggaagtaccaatatcattaaaaatccatactgcccaaagcaatgtacagattcaatgctatttctatcaagctaccaatgttatttttcacagagctagaaaaaaactattctaaaattcatatggaaccataaaaagccaaaatagctcttcaaaccataccataaggctacagtaaccaaaacggtatggtattggttactgtactttctattacaaaaatagaaagaccaatggaacacaatggagaacccagaaatgaagctgcacacctataaccatctgatctttgacaaggtcaacaaaaacaagcaatggggaaaggactctctagtcaataaatggtggtgggatacgtggccagccatatgtagaggaatgaaactggacccctaccttttaccatacaaaaattaagtcaagatgtattaaagatttaaatgtaagacctcaaactataaaaatcctagaagagaacctaagaaatggcattctggatgccggccttcagaaataatctatgactaagtcctaaaatcaattgcaacaaaaacaacatttgacaaatgggatctatttaactcaagagcttctgcacagcaaaagaacctatcaataagagtacacagacaacatacagaatgagagaaagtattcgcaaactgtgcatccaacaaaggtctaatgtcgagaatctataaaaaacttaaataactgaaaaaacataaacaaataacccccttaaaaagtgtgcaaaagacatgaacagacaattcccaaaagaagatttataagcagccagcaaacatatgaaaaaatatcaaaaccacaatgagataccatctcacatcagtcagaatggctattattaaaagtaaaaagcaaacaaacagaaaacagtagatgcttgagaggctgtggaaaaaagggaatgcatatacagtgttggaacataaattagttcaactacagtggaaagaagtttggacatttccctagaacttaaaacaggactaccatttgatccagcaatcccattagtgggtggatgtcccaaagaaaagaaatcattctaccaaatagacacatgcacccatttgttcatcacagcactattcacaatagagaagacatggaatcaatctagatgttcatcaatggtggattgggtaaagacaatgtagtacatatacaccatagaatactatgcagccatataaaagaatgaaatcttgttctttgcagcaacatgaatgcagctggagaccattatcctaaacgaattagcacagaagcagaaaatcagatgcctcgtgtttgcacttacaattgggagctaaatactagttacacatggacataaagatggcaaccatagacactggaaatactggggaaggagggggacaatttttcaaaaactattggttactatgctcagtaactgggtgacgggaatctatcgatcccaaacctcatgtgtcagatattcccaggtaacaaacctgcatgtgtacccactatatctaagatgaaagttgacattattaaaaagaaaaagttaacataaataaggacagaaaaaaatctataattaaataaatatgaaaatgctgcttttcaaaacttctgggatatagctaaggtaatacttataggtattctagttttaagagcttgctttagaacagaaataatgctaaaagttaaagctaagtatccaacttaaaatttaagtatttttataaacaagagagtaatttaagcataaaaaactaaaatgtaaaaactaataaaaattgaaacagaagatcaatggagtcaaaagaaggcaatttttataaactaaaaacatgccttgttaaattaataaagaggcatcagccaaaagtacattaatatgaaagacaatataggtataagtagagatgctattgatgttatgcagctaataaaagagtattaggaaaaactttattcatgtaaacatatatatgaaatgaatacattctcataaaaattgatttcaccgaaactgattccagaagaaatagtaaaccttaatggttcagtcagaatcaaaataactgaaatttcttttaaaatcctctcattgtgtaaacaccagttccagatggtttcaaggtaagattttcaggtaattctaatattacacaaaattctgcagaccattttaaaaagaaagacgacagaaacagaagattataaaaaataaaaaatgtatattacaggcccacctagtcattaacagatacaaaaatagtaaatacgttatttgcatctcaatccatcaatttaaaaaataaaaatatataggtataatctaagctgaatttctccaaagaatgcaaaccccgtttatactagaaaatggatgaatgtagttcacctcattattcctactttagatggaggggaaaaattaatattcaatatccattcagaatgaaaaccttaggaaactaaaaaagaagggaactcccctagcatagtaaatgatttctactaaaatacaatgaatatgttattaatggcacatgttgaaaccttcttttaaaattgtgaacaagaaacaagtcagtggaaagtttctgttatcacaatttctatttaacattgcattgacggttctagctagtgcggtgagataggattaaaatgtttaataatcagaaaggaagaaacaatgctgtcactatatctacaaaacataaacttactgattattagaattaataatttagtcatgttactagataaatattaatattcagaagaaaaccgcatttttagataacagtaaaaatcacttgcagaatataattgtattaaaagaaaattacaataacatcaaaaatatgaaatgcctaataattaaactaccataagatgagtaaatcctttaggaagaagactacatacaattttatggaaggatattaaagaatacctaaattaaaaaaaaaacccacaacacattcttagaaaatttcagtaatataaatgcatggatagtcccttaacttaaaatactccttcaaataaaaatcccaccaggatttcctgtggaatgtggaaaatttactccatataaaggatgaaaacagccaggacactatttatttttatttttatttttattattttttttttttgagtcagaatctcactctggggcccaggctggagtgtggtggcacaatcttggctcattgcagcctccgcctcccaggttcaagcaattctcctgcctcagcgtccccagtagctgggattacaggcgcccgccaccacacccaactaatttttgtatttttagtagagacggggtttcaccatgttggccaagctggttgggaactcctgaccccaggcaatccacccaccttggcctcccaaagtgctgggattacaggcatgagccaccacgctcagccaggactgttaaagaagaaaaataaagaggggactttttgtttgaagtattgtaatatattaatctgttctcacactgctatgaagaaataactgagactggctactttataaaggagacagatttaattgactcacagttccacattgctgggaggcctcaggaaacttacagtcatggaggaaggaagaggagaagtaggcgccttcttcacaggggtggcagaacagagtgagtgcaagcaggggaaatgccagacgcttacaaaaccctcagatttcataagactcactcgctattatgagaacagcacgggagaaactgcccccgtgatccagtcacctcccctggtcctgcccttgacacatggggattatggggattacaattcgaggtgagattttgttgggcacacacagcaaaaccatattatagtgattaaaacagaacagtggtgaggaagagatagacaagtaaaaaaatgggacaaaatagcagccttgaaactattccattcatggatgcaaattggatttacagcccagtgggcgttgctggttagtgtgggaaaagagagcccatttcattaataatactggaaaacatagtcatctatttgaacaataaaataaaattggactcctacatcatactgtacacaaataaatatcatgtagattaaagacttatctgcaagagtataggaaaatatctttataattgtagtggaggaaataattttttaataaaatcataaaaagcagatagcctaaggaaaacgataatttaaatgatacaaaaaaaccaaaaactttacagagagggaaatataagtaataatctgtaaaaaagtgtttctaatatttacaactgtcagagaactagtattcagaccataaatcagtaaaaaaagattcataaaagtgagtaaaagataaaaataggcattttgcagagggggtaatataaattgctcataatttttttaatgcttaagcttaatactaattagcaaactgcaaattaaaaccaaaacccaattccaaaacataatgacctgattgcaaaaagtattaaaagcacattagtatttgttcaatactagtgtgctgggatgattttaatgataagaaacactttatttttcttaaaataatttagcatgggtctgctttgtgaccaagcaaattcataatcatgtacgtagactatagtaacactttcacatttgtaccaagagacttttacaatattctattcttatcaaaactgtttataatagtaaaaaattggaaaccactcaaataagccattaaaagggtctggctgctgggcacagtggctcaagcctgtaatcccagcactttggaaggctgaggcgaaaggattgcttaagcccaggaattgaagaccagcctgggaaaaatagcaaggtgctaaatatatatatgcaagctgggcatgctggtatgtgcctgtggtcccagctacatgggagactggggtagaaggattgcttcagcccagaagattgaggctgcagtgagctgtgtttgggccgctgtatgccagcctaggcaacagagcaagactgtcaaaaaaaaaaaaaagtggactagttatacattcaaatactgtaaagcacttaaaataaacattctatcactatcacatccaaatagatgaagcttaaaaacataatactcagcaaacaagccaactcaaggatgcataggatattatttcatttgcataaatatccaaaacatatgaaacaacacatctaggcttgctcataggtggaaaaattacatgaaagttaagtgagtgttttccatactcttcagaattataatttcctctggaggaggaggatggtgcagctggctacaacagaggcctttatggcactagcagctggtgacattcactttcataacatctggtggcgattattcaggtgtgtttacaattattctctaaactacatatgtttaatacttttcatttatgatagatataagaattaaaacttttttaaaaaagagaacatgtatatgaaacttaaaatgccattgtgagccaggtgattgagttagacaagttactgctgctcctagtgtgttactaccctgtaaaatggctcattaaagaacaaattttgggattttttttctcatcatctgtgctgagtttaattaaaaacacacttattatactgaactataggatggagtttctcctgtagctggagaagtgtccctcagttttgtagtgactaaatactggagtcaatttctgaaggaaattagagattatccttccacgaattttttaaaatatgctttgaatatagcatattatatgtaaagttctgcatggttgttccttcataaaatactatattttataatgcactagaaagaatactgtgatagaaatcacaaaatttcagttcttgttttgcttttatttcttataagcttaatctctgagtcctaatttaatgcattatctatccaatgcccagatcatgttgtattacataatgtttacatgaaattatgctaatagtaatgtcctttacatataaaaggagtcactactctttgtatttaatcactcttttaaatgaataattggcatatatttataattgtatatatatatttttaacttttattttaggttaagggatacatgtgcaggtttgttatagaagtaaattgcatgttgtagggctttggtttgcagattatttcactactcaggtaatgagcatagtacctaataggtagttgttttattctcaccttcctccaactctccatcaagttggctctggtttctgttattcccttcttgtgttcctatgtactctatgtttagctcccacttatatgtgagaacatgtgacatttggttttctgttcctgtaatcactcttttttttccagtgagaagttttacatgttttcaggtgcattatacagatattgatatctcataaagtcaccccatccaaatttgccaaccttgtataatatgtcatcaaaatatgattggcccttcatattcattggttccacatctgtggattcaacaaactgaagactgaacatatttggaaaaaaatacaataaaaataatgcaacaataaaaataatataaataaaatatagtataacaactatttatataaactttacattttattaggtattataaatatctggagatgatttaaagtatactagaggatgtgtataggctatctgaaaatactacaccaatttaagtaaggaacttgagcatctgcagattttggtaaccatagggatcctggaactaatcctctgaagataccaggagcaactgtgtatatttttcacccccttaattgctcagaatcctgctctgctagtctaatgaataatgaaaatttaactgtgtcagtgtggctatgtgtaataatagcatggcagcttaattttggttacatagttgaattataacaaaataatttaggaaaagccatatagttgaataaatggttattccataagctgcaatgctctgtaattgtagaatcaaaaacaggtgaagatggtagcaatagatatacaatttacccttgaacaaatgggggttagggaaaccaacctctcttccagtcagacatccatgtataacttttaactcctcaaaaacttagccattaaaagtctactgttgaccacaagccttaacaataacataaacagttaacacatattttgtaaatgtattatgtactgtattcttacaataaagtaagctagagagacaatattttattaaaatcataggaaagaaaaaatatattgactattaagtcaaattggatcattataaaggttttcatcttcctcatcttcacattgagtaggctgagaaggaaataggatgaaatagtgaaggaggtggaagaggaggcaggagaggcaaacatactcactgtaattttacaaaaatacatcataatttctgtctgattttttttttgctttttcatttctaaaaaaatgtttctacagttaccaatcctttctccaaaatttgcccatatcatagaagggttcatgtcataagataagtcaaaagtagtcttaaataatcagaacccttctaccagattgtctaacgtcagttttgttttctggcactgcttatttgatgtcttcttcctcatcatctagctgtggttcagaagccttaatttccctcatcatcttttgttaattcctttagtgtggtgtctattggctctactttttctaagatccatatcttgtaaccttgcaccccaactgttttattgttgtggttgatttagttttgtttttggtttttgccacatccacaatctcttttatgatttccttgattggctctgttgtaaatcctgtgatgtcacgcataatacctgggtacagttttctccagcagtaatttattgtttcagacttgatgactttcacagctttttctataacaatgatggcatcttcaatggtataatccttccagactttcatgatgtattctctatcagggttctcttctattgcattgacaagactttccatagaatgccatgtgtaatgagccttaagcgtcctaatgaccccctgatttagcaagtagactaagtcattgccttcaatgttgagctcatgaagttctgggtgctaggggcattgtccaatagcaaaagaatgttagaaaggcagtcctgtattggatcccagcactttgggaggtcgaggcaggcagatcacctgaagtcaggaattcaagaccatggtcaacatggtgaaaccctgtctctaataaaaatacaaaaattagccaggcatggtggcagatgcctgtaatcccagctactcgggagcctgagacaggagaattgcttgaatgcaacccaggaggtggagattgtagtgacctgagatcacaccactgcattccaacctgggcgacaaagcgaaactccgtcaaaaaaataaaaagagagagagagagggagagagggagagagggagagaaagaaagaaaggaaggaaaggaagaaaagcaagaaaggcagccccttactggggcttgtgtcttcatggacaaagcatcagtgaaattaatccagaattctcattgtccaggctttcttgtggtacaacgaagactgccagctggtgcttatttttttcctttcatcgttctggggttagcagctttataggtaagggcagtcctaataataaacccaagtgcatttacagtaaacagtaaagttagcctatcccttcttgtcttaaatactaatgctcacttctcttccttactaataaatgtcctttgtggcacttttttttttgaataaggtacttttttccttgttaaaaacctatttaggtagatatactttcccctcaatgattttcttaatgggatctgggaattttgctgctgcttggtctgcaaaagttgtttcccctgctgtcttgacattttgtaaagcctaaagctatttctataatcatcaaaccatcctttgctttatatccttcactgtccttttgatttaagttttcacataatgacttcattttttctcaaatcacattagaatttataggcatgcttttcttataccaatcctgaagccacataaaagctatgttttcagtaaacggtaaaacaagtatttcacaaaaacagtaagattttgtgtctgttggtataactgcaatgacaacttcatgaatttcttattctgtctttaccatggttcttatgttggattcatttatcttgtaaaagtaggcagctacagctgtatcgtatcaagcaattcaactttttcttgcaatgtcatgagttttctctgcttcttgggaacacttccagcatcactagtggcacttcatatgggttcgatgttgttcttcaaggtttatggcatttgcactaagcacaataaaaatatgagaaaaccatgatagtttaccttttactgctatatgcaatttactgtagacaggaactgctcaattgaaatgagtactgttacaagggcattttaagcagataaaacacttcagctcaaggcaatagcaacaggaggtgactataaaattattacagcaatagagtaagtactatagttaattttatgcagttatgctttactattgcatctgtatcttcatttgcatttctctgaactgtaatagagccatgaataatccatttgtatgtataagttttgataaattttaactttttgtaatagacttgtgatatttttagtggtaaatgataaagcagactagtatatacatgtattttgtgcaacatgacatacctttttcttaatttttgatattttttgacctatattttatatatatttgtcttcaagttttttcaaattgtccaaagtctccccaaatgtttcttatatagttattgaaaaaatactgtgcataagtgacctgtgcagtccaaatctgtgttgttcaagggtcaatagtacacatacagtcatgcatctttttaaagacatgcatatgttctgagaaatgtgttgttaggcagtttcatcattgtgggaacaccaaaaactgcacttaaaaaacctagatggtatagcctactacacacctaatctatatggtatagcctgttatccctaggctaaaaacctgtaccacatgtcattgcactgaatattgcaggcaattgtaacacaatggtaagtatttgtgtatctaaacatatctaaatgttgattatctaaacatagagaaggtatagtaaagtacagtattatgggaccattgttgtacatgcagtgtgcatcaactgaaacattgttatgcagtgcctgactttattttccatgaggtgtgttattatatagcttagtcatttgaatccgcttttcatcagaatccttctcactttctgggtttattataatgcttgtatttgtttttatgttgattaattagaaatatttttggaaagtacaactctagaacttacgtactctaccttaatgaactctaattttaaagagggagctttagaaagtcttttaaggaaatgaaaataccttgtgaacttccaaaacactcatatttccccctttttcaacttcgttgattgacctggaacccttaaaggagaaaaagaatctatcaagtagagctggatcaagtgtaattttggtttgttttattttttaatagttttttctctcagggaagtttcatgtctttcgtcagtcatgggagtttctctactatcatttattcaatttcaattatgcctctggcccatgctcattattttcttgctctggcagtttagcataatggttaagagcatgccctcttgagcctcaggtccaattcctggcttctctatttattagctatatgaccatgggtaagttaattactttctcttcctcaaaggcttgctgcgatgagtaagtaaatgaatatatgtaaagtgctcagacagtgctcagtatattttaagtattatgtaagtgcttgctcttattataatgattacttttatatagaggtgtaaatctttttatctttttttccattcctctttcatactttctgtctgtataacatttggaattgcattatgagctactaggcttggtgctccagaatatttgtgtgcccaatagctgtgtccacctttcttttttagtctatataattagagtttgcttagttttttgttacaatctcaatcattatacttttatatttcaaaaatctctaataatttcttattgtacaattgcttagtcttatataggtataatatcttcctaatctctctccagatatttggacatattttggacattttacgaaacacactttttgctaactctttcaacacctgtaagtgtctctgtcatggttctgatatttgctgctttcttgtgcactttgtagcttagttgtcctgtacgactatctcctcttttcattcagggagatgggtgtgagctgaaatgtggcttggatacttcgttagtgactgtgagaaagtggcatcccttggcagctgtttttctgagtatgggcacttgcaaccaaatgttgtgagccattcgggacacattatgcctccgtcttcctgacctccttcagttaatattcctacctcgggacttttccattgttgtttgccaaggttaacttacctgactactccagctgtgagaccatgctaataattctggtcgttgatccttagcatcttattcactggttccacgccctaccagcacagaccagttaatgttttattttaaagttgtgctttgatatggcttttttccgctgcttgttgtttctcaggattctctagactctgtagcgcatctagagtgactttttgtttttagtggagctatgacttatttttatatatgacaaaataatgtctatgaatttgatgcagaaggagaaaattgcctaatgtattcaagtctgctatgttgaaatagaattcaatagtgaccttcaaaaagatatgttctaaccacacgaacctgtgaatgtgaccttttttttttttaaggtgacttatgcaggtgtcattaagtttagaatctggaaatcaggtcatcctcgattatctgggtggaccctaaagttagtgataaatgtcctcacctgaaacacacagggagaaggaacagaagatcatgtaaagatagaggcaaagatgggagttatgtggtcacaagccaaggaactccattaaccactggagctggaagaggcagggagggattcaactttaagattttagaggaagtgtagccctgctgacattttgattttggacttctggctgccgggctatgaaataataaatttctcttgtttcaattaaccaagtttgtggtaatttttaatggaagtcctaggaaattaataaaggtatcttcttctattaatacacaattttagcagaaaatattgtctctcatttcacagaaaatattaagacagtacataaaaccttccttaatttcctccttgtcacttacaaacatgtttatatccacaaccatacctaccttccacatcccacctactgttcaaagttacatttgtgttagggaacctctgccatttctgcctctgctttaccaacaaacgtctttgtaatctggtagacattttccttttacatgtgaacagagccaagcctctttgaaataaaaaatcctgcaggtttaacaaatcacccttcaacttctgctctggattctgtcttcattttacagccaatcgttgagggagagcagccagcacacaccgtcctgtctgtatcacatatctcaaactaatacagtctttctcttgaggctaatatgccactgaaagctaacagtaccaaggtccttcacattgccaaagcctgtacacatttcctttgcttatatcaattgccctcactttgatatttgactccggccattgcacaccacccttcaatctctgtttaccctcttcttctgtttcttctgattgactgtttcttcccaatctcacacataggtttctttctctccccagtgcctgttaaatatcaggagtataatccaaggttctgcctttgtccctcacttcttgctacattgtgtgatctcaaggtgaccacattcatactcatgattttatctttatttgatatactggagactctcaaatatattctcataatttagaactcactttgggcttcaatattgaacatccaactctcactggcacatctccattaggatgtcccaaggacactttaatctttatttttgacatcttctcatcctgacttcagacttgttactctgtattaccttttttagtcaacagattcttcattcaaacaactgaaacagaatattgttattatctagaagtcctttttgtgttctcttatatcatatctttgtatgtgatttaagcaatcattttattctgctgtatatcatgtaaaattggatctagaatgataaatagtttttatctcaatcaccatgtgccattgatttgtaggggctgccaagagtacaaagttgagaaagatagtgtgatcacctctagagtgagaggaaagacttccacaattgatgatagatgaaatggcaagggtgaagaaaagtgaagcatctagctctgaatgtgttatccatgatcttagattataaagttcacaggttaagtcagtgtgtgtgtgtgtgtgtgtgtgtgtgtgcgcgtgcgcgcgcgcacacatgcacgtgcacaggcacacacttgatttgggatattttagtaaataaacagataagcacaaaaaggatgctttaggcaggaagaacaaagtcagagaggagtcaagtggaacttaggggatactaatagaactccataatttaatttgcatagagggaagtttgtagttgatgagagaaatttagattggactcaaattagttaaagccatttgtgccaagttaaataatctttatctaagataatacagaaggatagtaaaatctcattctttctggcattgtggaactttacaaattccatttaaatttatttttaaacacttcccttacagggtaatctcaaaataaaatgacgcagtttaaaacaataacaattattcaaaaaaatagaaacatgttgtgaaaatacagattatttctctattttaattaagaatggtagtaacagcagtaatatatcttctgcctgcagtgtcacccaccatctgtgtgtttcttgacccctggcaatagtcccaggcatggatagaaatcatccctgcagtgggtgcagccacattaattttcactagggcttcatagtaagtttccatattgcagttcttttagggagagacctctggtcactcgacttcatggcagacagctcagctaattgaagaagtgatagtattctctacaaccatgagtacaattaatgaaagtattctgctattgcctaggcttagattttttttcttcacataatttatcagagaatttgaggtttgcaaatagatttttaagatgtcatttgggactttcactgacctccagaacagggccatttccattcttcttctgagcagcttgcctatttgactttaacaagccaccagaacagctgccctaacacccctgctgttgctatttctgatattactagtctagcaccaaggtttacttattttttctcttttctcatcatcagccagctatgaaaaaagaaccattcttcatgataaaggtcatatttgcatttcaaaattttgagtgactgtactgcctgatattaatatatattataaataatatggactcaaatttccaagtagcagcattgactataaataaatatatctaggtaggaactataggaggctcacctatcaatgattgtttccagttttaaagatatacttttaataaactataatatgatttcctgtaagatacagtttttcatataaaaaccaaagtggcaagtacagttcaagtaattccaaagttcctcttgcatgaatagccttctcacatatgttatcctaacattgatctttcatttaacttcaaagtatgctctatttccctctgtgaaatcggactttgtacttcattggtcattttatccacatatgctttctctttatgtttctttatttggttccaaaaatattggcattgtaataagtagagattttatcaggtatatcataaaaataattatttatccttttcaggaaatcaaaaaagtgaggaaatggctccaaaaacttagtactaatgtttgtgtgtctgtgtttgtgtgtgtgtgtgtctttgggagtgttggcaatggaaagaagttaaactgaaattgcatacactaagttgtaccaatattttgtgaatcaatttagataattctgtgctactaaattgggaacattatttattagaaaaaggacttccctgagaattgaggagttcactgtttggagtgatttgaccaactggttattttatcattctgcagaccttgatttaaaccacattttatgtccttatattccctccttttcatttgttgatattgatcctttgtttcacctttttaacccattccctcaaaatatgaaatgcttctttcttctttccaaggctatatttcccacctgctagtgactggattccctctctcctttgtgaacttgctctatccattgtaatttctctgttttgtatattctacaccttttatagtagctatttgatatcagcctatgttatcaggattctggtggttgcaagtgacaaatcaaatttgtaagtgtggaaatttattggttcacaaatttgaaaagaccaaagcaataattagttttaaacatgactgcatccatgggctcagatgataacatttttttctttcatctcttcactctacttccctctatgtgttgatcaaacttatttccaccaaatatggtctagttatatatgggacctggagtgaccatagatgtcttcagaccttatcctacaagccaggcattgcagaagacaggacttctggttgtccacagtcagttaatggttcttaagttcttgaactactgctgaaatcggtagcaaggaaggagtcattttctaatagaaggatgtttttgctttttcatttgaataagagaagaaatgctgaatagtgaagcaataggtgtcctctaaatatatttgtttcttaacatagaaagtaccttgggtaggatagaaacataaaagaggaagagaatttggagagattaaaaatctgatttgtgacatattgtggggtttctgtatgtctggtgataggtagctgaaaatacagattgcactttaggataatgaaattcactgtcttcaatatattactctctatttaattatatcttttctggaaataatctctctttggtaatctaaaggctgcccacatttcactttgctcttcctacacatgttgctgtgatgaaccttttggaccaaaagtctaatgagtatctttctcctatgtttattaaaaacagcattcttactaaaagtaatgactacttttctttcttcatagtacttgattacattgtctttgacattattcaatgctgtatttccaactccctatcaacagacacacacaaatcacaatatctcacaaatccaatttttaataatcacttccagattcctcctctttctatgtttttatcatattcaacgattttaacaattcttttttaaaacatctagggaagtcagtcaatattggctttcctctttctcatgtgtacattcagcatcccaacaaatcccacctatgttagacttctttagagtctcttctctgctttccaacaacattgcaaacatttcatgacgagatctttcttaaactattccaacagctttttaacagtctgcagtcttcattcttttctattccaggcagcaaggcacaaagctatttgatttatttttctttttttttcaagtagacattttctttttaataaaacagagcgcaaatttaagagtcttgtaatgggattcaacatttttccttcacgcagctcgggtgtgagtacctggctttaaagcaaatccagtatgtgaaaatggggatgtgtacccatcagatctggggcaagagattcacttcacagagtgaatgcttcttttctttaccagaggaattttcatagtattctctggaagggataagctttcctcatacatataaacacttagtaaatttttaatttaagtacactctttagacaagtgctgtataaagagaagactcagatcaggcagatggtgcctattatttttcaagcaattaccttaattcaaatgaaatccaaatgttttgtcaacatctggttggcattcagtgccttgcctagattgttcttttttattttttattttttggtaatagaaaaatttattttttcaaattaacatgttttcttctttgtttattatactttaagttctagggtacatgtgcacaacatgcaggtttgttatatatgtatacatgtgccatgttggtgtactgcacccattaactcgtcatttacattaggtacatctcctaatactatccctcccccttccccctaccccacaacaggctctggtgtgtgatgttccccttcctgtgtccatgtgttctcattgttcaattcccacctatgagtgagaacatgttgtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctgtcattggtggacatttgggttagttccaagtctttgctgttgtgaatagtgccacagtaaacatatatgtgcatgtgtctttatagcagcatgatttataatcctttgggtatatacccagtaatgggatggctgggtcaaatggtatttctagttctaggtccatgaggaatcgccacactgacttccacaatggttgaactagtttacagtcccaccaatagtgtaaaagtgttcctatttctccacatcctctccagcacctgttgtttcctgactttgtaatgatcaccattctaactggtgtgagatggtatctcattgtggttttgatttgcatttctctgatggccggtgatgatgagtaagttttcatgtgtctgttggctgcctaaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttcttccattttgtgggttgcctgttcactctgatggtagtttcttttgctgtgcagaaactctttagattaattagatcccattcatcagttttggcttttgctgccattgcttttggtgttctagacatgaagtccttgcccatgcctatgtcctgaatggtattgcctaggttttcttctagggtttgtatggttttaggtctaaacatttaagtctttaatccatcttgaattaatttttgtataaggtgtaaggaagggatccactttcagcttcctacatatggctagccagtttccccagcaccatttattaaatagggaatcctttcctcatttcttgtttttgtcaggtttgtcaaagagcagatggttgtagatgggtgttattatttttgagggctctgttctgtcccattggtctatatttctgttttggtaccagtatcatgctgttttggttactgtagccttgtagtatagtttgaagtcaggtagtctgatgcctccagctttgcccttttggcttaggattgacttggcaatgagggctcctttttggttccctatgaactttaaagtagtattttccaattctgtgaagacagtcattggtagcttgatggggatggcattgaatctataaattaccttgggcaatatggccattttcatgatattgattcttcctatccatgagcatggactatttttccatttgtttgtgtcctcttttatttcgttgagcaatggtttgtagttcttcttgaagaggtccttcacctccattgtaagttggattcctagatattttagtatgtttgaagaaattgtgaatgggagttcactcatgatttggctctctgtttgtctgttattggtatataagaatgcttgtgaattttgtacattgattttgtatcctgagactttgctgaagttgcttgtcagcttaaggagattttgggctgagacaatggggttttctagatatacaatcatgtcatctgcaaacagggacaatttgacttcctcttttcctaattgaataccctttatttctttctcctgcctgattgtcctggctagaacttccaacactatgttgaacaggtgtggtgagagagagcatccctgtcttgtgccagttttcaaagggaatgcttccagtttttgcttattcagtatgatactggttgtgggtttgtcataaatagctcttattattttgagatacatcccatcagtacctaatttattgagagtttttagcatgaagggctgttgaattttgtcaaaggccttttctgcatctattgagataatcatgtggtttttgtctttggttctgtttatatgctggattacgtttattgatttgcatatgttcaaccagccttgcatcccagggatgaagcccacttgatcatggtggataagctttttgatatgttgctggattcagtttgccagtattttattgaggatttttgcatcgatgttcatcagggatattggtctaaaattcttttttttgttgttgtgtctctgccaggctttggtatgaggatgatgctggcctcataaaatgagttagggaggattccctctgttcctattgattggaatagtttcagaaggaatggtaccagctcctctttgtacctctggtagaattcggctgtgaatccgtctggtcctggactttttttggttgataagctattaattattgcctcaatttcagagcctgttactggtctattcagggattcaacttcttcctggtttagtcttgggaggctgtatgtgtccagaaatttatccatttcttctagattttctagtttatttgcgtagaggtgtttttagtattctctaatggtagtttgtatttctgtgggatcggtggtgatatcccctgtatcatatttgatttatttttctacatgaaaaaatttgtcttttaggaagttaaggattttttaaaaaccttcattgtgtctttttagcttacaacataaggttcaaaattcttagtatgaaatttttaaattattctcattttttctcaatagtcttgcaatttcacattccatatttcaaccacactgagaaatttgccattctcccaacatatcattctccttaatgcttcagtatctgcgctcatattgttctttctactagcagcacccttttttattgaatttgatctcagtcttctaagccataggaccaagaaagcacctagcacatagcaaatggtcaataaatatgtgttgcatgtatgaataaatttgatcatacttaatttatttttgttttacattttctaaattggaatcataatttatgccttgagtacttcacaggcaaattcaagaaggttttgttaaaattgattaattaaaatttatgtcttaattagcctaacgtagtgaacttgttccataaaacacagatagaacaggagccaaaaatactatgggaaaatcattagaaagttgttcttaataaatcaaaacaaaggtaattgaagtgaaatgcagggttctaaacaacagatacattctcaaaatatgactttcagtacatttcacaaaataactaagttttcccgctacccctttatgttcctgtcacttttaaaaatgatcttttgagctttatttgtagcacagcaagtctcagagagttggagaagggaaaaaatgctttaatcttcatctttttccctcttatagatttataggtggaaagttttcttaaaagaaacaatgtatacaccacctaccatcagatcaggaaaacaaaacaagcgtttaattaactgtcttagacagaacattggaaaggccaactccaattctgtctacctattccccagctttgggacaaatgttgcctttatactgccctcttgttttctcacagtgtttgtaatgcacggaaaaaaaaatactattacattgattttcaaatgctatgtagctgcagttttaaaaataaacagttgttttttgtaatcttcaaaaatgctttaactgattaaaagactacttctcacatatagataattataaaaacatgtaatcaatttttataacaaacctaagcactatgtcatcataaaaatgcacaacccttcaaaagtagttttgaggattttttactaaaaccagattctgaaacaaaaaattaacttcaaaagacagactaaagcaatgacctcatgctactcactacaaagaggcaacagtagacaatagggtcatcaaaatgaaaaccatgccaagctaaatgaaaggaagacaataagctttctttctttcaaaaaaatggtttcatcagcatttctaatgacatctcaagggttatagatgaaaggtagaccaaatagctaggtggagttgttggttaaatgttttattttgttacaattaattttcaagttaaaattacttaaagtggtcaagttctaattaaatattaaaattttattcagttatagccaacttataaatatttactgctagaagcttacaaacaacatgctcagtttaatattttccatttgcaaagtatgacacaattgaagaaacaaatgggacccaattcattatttctggagtattattttatatttatgaagcttgttttataactatcaccttgatgtctagcacatattaagagctcaaatacttaatgttttattgatgtgccattgcatggcagatctcctgagtggtagatttaaatttgctcccaaacttcaatttaattctcatttcctaggccatcagcatttccaataaacaaaacaaggctttggcatttctctaaataacgataaaatgagtttacatgtttggaaaagttatttttctgcatcaataatgttacacattaatctcaataagagatttttttctttttctcaagtcagtagccacattctgctttttctgtttcagataacagtctttcaaattcgcgtcttggccacaaagagtagacatactaaaaatccattcttaatgcactcttcccctgtgactgatgactattccacaacctctcatctctaccaaaatcggcagcactatctccctgcttcattcttttttttttctttttattttattttattttctttttctttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgcgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttactccctgcttcattcttaactggtgacatttttcctatttaagtgagaaaatacacataatgatccttagaagacatgttccccaaactcccaacaccatgtaactgacctgcttacttttgtacttatctcttttaactgcagtctaatattatgaaaaagtttgtgtatccatctagagtcttatatcaactcttccacttgcagttcttcccttctcatttacttattcaggtttcccttgtaggacatcactctaccctgactttcctccattgttgctaaccactctttttcagtctcactgtggattccttcacatctcccatcctccaaatattggaagtgttcttgggctcaagccatggtgtcctctcacttctatccttatttatccttagtaatctcttctgttctcagtgagacagagaatagaaaactctcaaatgtgtagctctgaaatgaatttgtctcctgattccagattttatgtaagtcaacagacttgcatctgtatttggacgtctaataggcatctgaaaattatctagaccttactcttgatctttcttctcaaaaacctgtttttcttcaagtctttccattccaaggaagtggaaagttcagccttccagcttctctggccaaaaactccatcttctctttttctttctcattacacatgaaatcaggaaaacatgtttctctactttaaaaatttagcaatttccaatcaccttgttaacacccagaaatactgtaatagctttataaccaatctacctgcttctgcccttgtacatctcacttttaatctattcccaaaagagtagtcaacttattcttatgattgggtcaaaaccctccagctcttttccatatcactcaaagtagaaatcaaaatggataatgatctggtgcttcctgctgctttctttgaatccagtgctggctagacacatcaaccttctagctactctgtcctccaggctcttgcacttgtagttctctttggcttgaacattctggccacagatatctacacagtttattcccctctctatttcagatctctgatccaattccatctttcttaatatagtcttttatacctattaaatttgcaatctctttctttgccatttcacatttctcatttccaaccattttaagtagattttattgtgttatgctagatattttacttatgaactttttattttctccctacaagaaagtgagctataggaggataaagacttttctttatcccacttatgaatatatccccatcgcctagaaatgttacctgcacctactaggcattctaaagtgcaaaacctcttggatttgcaaagacatggaatcaacccaaacgcccatcagtgatagactagataaaaaaatgtggtacataaacaccatggaatactatgcagccataaaaaggaatgagagcgtgttctttgcagggacacgaatggatctggaagccattatccttagcaaactaacacaggaacagaaaaccaaacaccatatattttcatgtataagtgggagatgaaaaatgagaacacatggacacagggagagaaaataacacacactgtggcctgtggcaagggtgtgagggtagggagagcatcaggaaaaataggtaatgcatgctgggcttagtacttaggtgatgggttgataggtgcaacaaaacaccatggcacgtggttacctatggaacaaacctgcacatcctgcacatgtaccctggaacttaaaataaaaattactccatgtgcagttatataggtaaaagaccccttggatatacacacatgtagtatatataagtttagtgttacactggttcagaataaaaagtctcagagactatactttgttttataaggggttcactaaaatataaacaaaaataatttcaaatgtacaatataatatgtgtttatttgggagactacagtggacttctgagataaattatgagataaattgaaaatatattttaaaatgctattttatgcatgtttcaaagggaacatttaactatgtctgtgacaatcaaaataaaatcataaaaaattcagtaaatgtaattgagttttgctttctttgaaagtatatttgttaataatcacaatacctctttaatggatatttgactacattttaaataacattaaaattaatttcctagcattaaaatgtttgtcaactatatcattttaaacttaatcatatatttgtacttagtatgactctagaggtattctgtagtctttttatcactttaatctactaaacaatgtagacagtatactgtatatcaccaagaagtgttcacaagttgttttttccctccttctgaaaaatattatgtctgtgttttagtgtatatgtttgtgtcttttgggctataggtgtacatctggaatttgctagcattagcacacagaaatgtacactcaagtgatttgaagcaactttggtctgttgtcaaatttaatagacattttcagtttattatgtatacaaatatttattatatataaatatatacaaaaatataaaatatataaacacataaatataaaatgttatatatagatacaaaattttacatacacacagaagagaaattcctcaaatgcagagctaatgcaccaataaacaaacatttgtgagtatatttagcttattagtcatatctgatgctaagatctaccatcaaaaacatctaaaggagtttttttcttttttttttcttttttttattattatactttaagttttagggtacatgtgcacaatgtgcaggttagttacatatttatacatgtgacatgctggtgcgctgcacccactaacttgtcatctagcattaggtatatctcccaatgctatccctcccccctcccccctcccccctcccccctacccccaccccacaacagtccccagagtgtgatgttccccttcctgtgtccaggtgttctcattgtttaattcccacctatgagtgagaatatgcggtgtttggttttttgttcttccgatactttactgagaatgatgatttccaatttcatccatgtccctacaaaggacatgaactcatcattttttatggctgcatagtattccatggtgtatatgtgccacattttcttaatcccatctatcatttttggacatttgtgttggttccaagtctttgctactgttaatagtgccgaaataaacatacgtgtgcatgtgtctttatagcagcatgatttataatcctttgggtatatacccagtaatgggatggctgggtcaaatggtatttctagttctaggtccatgaagagtcgccacactgacttccacaatggttgaactagtttacagtcccaccaacagtgtaaaagtgttcttatttctccacatcctctccagcacctgttgtttcctgactttgtaatgattgccattctaactggtgtaagatgatatctcattgtggttttgatttgcatttctctgatggccagtgatggtgagcattttttcatatgtttcttggctgcataaatgtcttcttttcagaagtgtctgttcatatcctttgcccactttttgatggggttgtttgtttttttcttgtaaatttgttggagttcattatagattctggatattaaccctttgtcagatgagtaggttgtgaaaaatttctcccattttgtaggttgcctgttcactctgctggtagtttcttttgctgtgcagaagctctttagtttaattagatcccatttgtcaattttggcttttgttgccattgctttcggtgttttagacatgaagtccttgcccgtgcctatgtcctgaatggtaatgcctaggttttcttctagggtttttatggttttaggtctaacgtttcagtctttaatgcatcttgaattgatttttgtataaggtgtaaggaagggatccagtttcagctttctacatatggctagctagttttcccagcaccatttattaaataaggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcaggctcttttttggttccatatgaactttaaagtagtattttccaattctgtgaagaaagtcattggtagcttgatggggatggcattgaatctgtaaattaccttgggcagtatggccattttcacgatattgattcttcctatccatgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctttctgtttgtctgttattggtgtataagaatgcttgtgatttttgcacattgattttgtatcctgagactttgctgaagttgcttatcagcttaaggagattttgggctgagacagtggggttttctagatatacaatcatgttgtctgcaaacagggacaatttgacttcctcttttcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcttgtggtttttgtcattggttctgtttatatgctggattacgtttattgattttcatatgttgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtgtctctgccaggctttggtatcagggtgatgcgggcctcataggatacccaggaattgaactcagctctgcaccaagcagacctaatagacatctacagaactctccaccccaaatcaacagaatatacatttttttcaacaccacaccacacctattccaaaattgaccacatagttggaagtaaagctgtcctcagcaaatgtaaaagaacagaaattataacaaactatctctcagaccacagtgcaatcaaactagaactcgggattaagaaactcactcaaaaccacttaaccacatggaaactgaacaacctgctcctgaaagactactgggtacataacgaaatgaaggcagaaataaagatgttctttgaaaccaatgagaacaaagacacaacataccagaatctctgggacacattcaaagcagtgtgtagagagaaatttatagcactaaatgtccacaagaggaagcaggaaagatccaaaattgacactctaacatcacaattaaaagaactagaaaagcaagagcaaacacattcaaaagctagcagtaggcaagaaataactaaaatcagagcagaactgaaggaaatagagacacaaaaaacccttcaaaaaattaatgaatccaggagctggttttttgaaaggatcaacaaaattgatagaccgctagcaagactaatgaagaaaaagagaagaatcaaatagacgcaataaaaaatgataaaggggatatcaccaccgatcccacagaaatacaaactaccatcagataattctacaaacacctctatgcaaataaactagaaaatctagaagaaatggataaattcctcgacacatacactctcccaagactaaaccaggaagaagttgaatctctgaatagaccaataacagtagctgaaattgtggcaataatcaatggcttaccaatcaaaaagagtccaggaccagatggattcacagccgaattctaccagaggtataaggaggaactggtaccattccttctgaaactattccaatcaatagaaaaagagggaatcctccctaactcattttataaaggagtttttttcaagatgtttatattttaatgtctgtaacattaagtctaatctttgttctaccatcagtgttttgtagtaaatttcaaaaatatcatgaccatctgcaccattctttcacttcatgattgatgttgaaaatttaacagcataattgtattctgaaaaggtagtcatatcatatatcctgttgttcatggatttatattgtggaatgcattactttaaggtattcttctttaagacctgtatataattatgattgctatagatgataagttggcatggttataaatttattatcaaagttgggtttaaaatattaattaataatcttttattttggctcccaggggagaaaaaaccaatagctctgtattaattattttatgagagagtcttacaaattttgaagaactgcattttcatcagcattttctcaaatgatgtgaaaacatttaaaggttactaactagtgctacattgcagtagaacccataagaaattatatgtctgatattaacatgaatttatttcaaccagaataatttaggatgatttgtaaaaattcataaaattaggagttttttagataatacaattaaaaatgtaaaataataaaaacaactatcgtttctgctctatatgatgtttataagcctagattactacacaactctctgcttgaagcatatggcaaagtcaagtataatatgaatatggataacaacaaaaagtgccatggcaagaatcaaaatgaaataaatatctctgtagactttataaacaaggtctttctgtgttgcccagactgaagtgtagtggttggatcattgtctatagactataaacaggtaagaaacccaaagtaagatatagtattaatgggctctggatctaaaagcaagcaaaagtacttccagaattgtaaagtaaaggataataaatataatccactcagacagagtccaaaagtctcagcttaacatgtggccctggggtaggctttcccacagtagaaagaagagagcctaaaacaatgtaaccttttgggaggccgaggcgggcggatcacgaggtcaggagatcgaaaccatcccggctaaaacggtgaaaccccgtctctactaaaaatacaaaaaattagccgggcgtggtggcgggcgcctgtagtcccagctacttgggaggctgaggcaggagaatggtgtgaacctgggaggcggagcttgcagtgagccgagatcccgccactgcactccagcctgggcgacagagcgagactccgtctaaaaaaaaaaaaaaaaaaaatgtaacttaaacagtggcaaagcacaaatctggttactgcttttaaccagatcccagcctatggaagctaccaaattcatgactatgaaatgacacatgtgcctatggtattgcaaatatcatcaacacagagaggctaattactacctaagacatgatttggatggaggccccaaggacaggtaatttaaaaacttattttaaaaaagttgacaaaaataacaaaacaacaacagcaaaaaaagactttccactcaacgtgaacctcaaaataaaatgccaaaacaagtaagaaatcaaataataaatgtgatgggctgaataataccccctctcctcttaaacaggaggtcctaatctctgcaatctgtatatgctatcttatttggaaaaatggtctttgctgctgtgatcaaaatgtgtgtcttgagggggtacgattaacctggattcaagggggttgtaaataaagtaaaatatgtccttataataagaggcagagggatatttgatgatacacagaagagcctcttttctggtgcgatcatggaggcagacactggagtgatgcagtcacaagccagggaatgccagcagccaccagaacctctaagaggcaagacccagagtttcccctagaccctctgaaggaagcgtggccctgccaatatcttgatttgagcccagtgaaactaattttataatcctggctgccagaactttgaaagaataaatttctgttgttttaagctaccaagtttgtagtgatatgttatatcagccataggaaattaatacaataagagatacagctaagaaaaccaatcagaacatgaaattaaataaaattaattgtctccataatgaattcatactctgaaaagacaaaaatttgaaatatgttcaggatactttaaacattcgataaattaacaacagaaggtcctgaaagtaatcccaatgttgtcataaaaattattttataaaaaaagaaaattaaaatattcaagaagaatctctaaaactgacactactgaaggaaatattaataaattaaaatgtggtattgagaagcattaaaaaaagagatgaaagttttgtaaaaaacagttaagcatcaggtggttccaatgatcacataatacttggtatcacacgtatgcttgcagtaaaaaaactataaatgtgtatgtgtattagagcccattaacactatatcttgctttgtgtttctgatgtatttatagtgtgtggactacaaatgagccactgcactccagcctgggtgacacagcaagaacctgtctatataatctgcagggctatttatttcatttgatccctgctgtgtcactttttgttgttactatttatattcacattgtactcggctttgccatgtgtttaaatcagagtgttgtgtcatgatttcagcttataatatatcatctagaccagaaattataattgtttttattattttatatttttaattttattaactaaaaattccctaatattatgaatttatacaaattatcctatatatacatacatatacagttgaccctaggtagcatagattagcattgcatggggccacttatacatagatttttttcagtaaatttattgaaacatttttggagacttttgatggtttaaaaaacttcaagtctcagacatactatgtaacttagaaatatcaaaaaggttaagaaaaagttagatatgtcataaatgcataaaatacaaggagatacttgtctattttatcatttactgccataaaatatacacaaatctgttataaaatgtaaaaatttatcaaaatgtacacacacagaccatacatagccccattcacagttgaggtaaatgtaaacaaacacaaagatgcattattaaatcataactgaataaaagtgaccgtagtacatactatattgctgtaataattttatagcaacttcctgttgctattgcagtgagcacaaatattgtaagtatccacttaaaaatgccttgtgatgctgatcatcttcatgtgggaagttcatctctccaattgcctattgcagtaaaaaacgatatctctcagttctcacatatttttattgtgttcagtgctgtaccttgagtaaccatgggacccatatgaagtagcactagtgatgccaaaagtgctctgcaaaggaaaaatcatgatattataggaaaaatttgaattgcttgacatgtaccatagattgaggtctgcagcgtggttgcccactatttgatgataaatgaacacagcataaggaccgctgtaaaaaaagaaagaaagaaaaggaaactcacaaagccatcattgcagctacctcatcagctggagaaaccttgcagtttttgtgaactaccatttttatctcctctggaaagtgcaacttttatgtgggggcaggattgctataagaaaggcacatctgtagactctaacaggatttggaaaaaaaataaagttattatatgatgacttcaagcaaaagtaaggtgaaagatctaaagctagctaatttaatgctaacaaaggatggtgtgataattttagaaacatttttgattaaaaaaaaaatcaagatatcaggacaaatggcttctggcaaccaagtggcagcagatgagttctgaggggccattaagaaaataattggaggcagggcatggcagctcatacctgtaatctcagcactttgagaggcggaggcaggaggattacttgagcccaggagagcaaggttagtctgagtaatgtagtgagaccctgtctccactaaataaaaaaatttaaatttaaatttaaaaaaaatagccaggcatggtggtgcactcctatagtcccaactatttggaaggctgaggcaggaggatagcttgagtcctggaggttgaggctgcagtgagctgtgatcatgtgactgtactcaagcttgggcaacagagcaagaccctgtcacaaaaaaataaaagaagaaaataggctgggcacggtggctcacgcctgtaatcccagcactttgggagcccgaggcgggtggatcatgaggtcaggagatcgagaccatcctgactaacacgatgaaaccccgtctctactaaaaatacaaaaaaattagctgggcatggtggcgggtgcctgtagtcctagctacttgggaggctgaggcaggagaatggcatgaacctgggaggcagagcttgcagtgagccgagatcatgccactgcactccagcctgggcgagagagcgagactctgtctcaaaaaaaaaaaaaaaaaaaaaaaaaagaagaagaagaagaagaagaagaagaagaaaataaaatgattattgaagagaagggatatctgcctgaacagatttttaattcagacaaaagtgccctattttagaaaaaaaaagccacaaaggacaattattagtaagaaagagaaatgagtaccagaatttaagataagaaggaataagtttacttttctgtgcaaatgcagttgggtttgtaatcaggacttcccttatccacaatgcttttaaacctcaagtcttgaaagaaaagatagacaccagctgccagtttttgttttacaagaaaacctggacaaagcctccacctcttttgcctctgtcaccctgagacagcaataccaatccctcttcttcttccttctcctcagcctactcaatatgggcacaatgaggatgaagatttttatgatgatccaattccacttaatgaacactttttctggattggttcaatcagtgttttctccctgaagtcaggaaggtgtttccactaagagactacatttctaaagttcttttgatgttgaaaaatgcccctggcttcccagaatcccatgaattcagcaactaaggtgttgaggtggtctgcttgtcctcaaatacagtgtctcttctgtagcctctaaatcgggactttaggactttatcattaggactttaaggctcattacacacaatcctctatggaaaggacaaagtgcaattctgtctcaaaagaaaagaagaagaagaagaaaagaaaaaagctgtcaacagtatgaaagataaacctgaaagtgagaacaacatgaaagtctgaaagaattatatcattgaagatgccatcattgttatagaaaaagctgtgaaagccaccaagcctgaaacaattaattactactggagaaaactgctgaaatattgtgcatgacttcataggatttacaacagagccagtcaagaaatgacaaaatagactgtgaatatggcaaaatacggagtcggtgaggttttcaagatatcgatcctggggaaattcaatagctaacagataccaatgagaggagttaacagaagacaacttgctgaagatgaatgcttccaagctaatgctggacaatgaggaagaagacatagaagaagcagtgccagaaaaagaatgaccttagacaatctgtctgaagggctctgattattcaagaccacttttgtgacatgggcccttctatcatatgagcattgaaactaaagaaaatggcagaaatattgatactaaataaaaatattttttagagcaattgagaaagcaaaatatagacagaaatacaatgtatttccataaatttacactaggtgttccggtctctcctgcctccccttccaccttctccacttcttttgcctctgtcacattgagatagcaatgccgacccctccttttcctccttctcagcctactcaatatggacacaatgaggatgaagatttttatggtgatccacttccacttaatgaatagtaaatatattttatttttcttataattttcttgataacagtttatttttccagctttaagaatataatacatactatatatgacatacaaaatatgtgttaatgaatgtttatattatttgtaaggcttctggtaaagagtaggctattagtagttatgtttttggggaatcagaagttatactcagcatggggttggtacccctaacccctgcatttttccatggccaactatatatatacatatgtatacatacacgtgcacacacacgtatgtatgtattcagacattagagagctcaaggctattgtctttgtgagaaaggaggtaagtgacatgaatctcaaattttctcagattttctccctgaagtcattttctgaaggttgtggtgccaaaaaataaagctaactctagcagcaacaatcttgcagggtgtcagagactaatagtaaatttctggactattaaataaactaatggttaacggataaactatttgttgggggcacctaaagaaaactctagaagactggataggatagatatttccctcaggccttggctaacttttgagttgctcacaaatgtagtgagattccatagtactagataaaacagtcagactaggaggctgagaaatgagtaaaagttacacaatgctgaggagacactaaaatttggatccagccaaagggagaaacctcagtgaacactgggcatttatgtgcaaactcagaaaaaaaatcttgaaataagatcaaatatctagcagtaagaacaatgctaaaataagctttccctaacaaagcctaaaactaagtctcaacagcatcaaagtatttcagataatttaatagattttcaggaaaaaaaaaaccacataccactttctagcaaaagataaatatccagagcctgtacagtatatcattacaatgttcagcataccatcaaaattactagatatgcaaagaatacaaccaaagatgatctagatattacagttaacagataagggcttcaaaataattatgcttaatgagttgaaaaaagaaaaatatgagtaaaatctatgtatgaaagtgtagtaatttacacagcagaaggtaagaatactgtatttaaatagaaaatgtttattgtgacgcataaagagaaaaaaatggaaagaaccgataagaatatgaaaatgtgggtagaacacagtcagaagatctaacagatatataaggagttccagaaagaaagaagagagagaaagggacagaattaatatctgaagaaatagtagctgagaatttttcaaatctgataaaatatattatctcatggattcaagcaactaagcaaaccatcaaaacaataaatacagcaaaaactacaactaagcacaaaagaacacagctgacaagatctacgaaaaagagaagaccttataagacaggttacttttaacgatgcaataatcaacaataaagcttttggcttactttctagcagtaaacataaaataatggaaacacatctttaaaatgttgaaagaacaaataattgtcaaccataatttgacactcagatgaatccttcaaaaatattgtaaaaataattacatttcaagaaaacaaaaaaataagactgaagggattttcggcagcccacatgtgcataaaaatactaaagggaatgattcaggataaaggttaattatggcatgtagatgcatgaacatgtagaaaaaagcgaagaacatcagaaagggtaaatatattggtaaatataaaagatgattgacttttgaagaaggaacaataaaatatatttttgtatctctaaagtatgataataataggtcaatgagaagaaatagagtttcattatggaaaagcaaaatattattaaaagtttcttgcattgtttttagaagtgataaaaatgctaacatatggtagaccataataagttaagagtgcatactttaatctctagtgtgaatactaaaagaataatgaaacaagacacaaattaaaagaaaatagaggaggtaaaatgtaacgataaaatgatttggttaatctattacaatggtaagaaatgaagaatgaagaaacaaaacaggtagaagaaattttaaatattagcaaagtagtagccataaactcaactgcagttgtcgttacgttaaatataatggaggaggagtgcagcaagatggccaaatagaaggctccgttgatcgtctgccccataggaacaccaaattcaacaactgtctacgcaaaaaaaaaccaacaaacaacaacaacaaaaaaccttcttaagaataaaaatcaggtgagcactcacagtatctggttttaaattaatatccctgaaagaggtactgaagaggatagaaaaggtagtcttaaattgctaatgccacccctttcccacccctagcagcagccatgtggtacagagagaatctgtgtacttgagagagggagagtgcagtcattgagagacattgcattaagctcagtgctgccctgtcatagcaaaaagcaaaacccagctgaactcagctggtgcccattcatggagggagcatttagaccagccctacacgaaggggaatcactcatctcagtggtgggaacttgagttgctgcaagccttgtcaccatgggctaaagtactctgtggcactaaataaacttaaaaagtagtctaggccacaaagactccaactcttaggcaaggcctagtgctgagctgagctcagagccagtggacttgggggacatatgacctactaagataccagacaggtggctaagaaagcatttgcaccatccctttcccaatcccaggcagcacagcttgtggatccaagagagatttcttcctttcacttgaggaagggagagagaagagtaaagaggactttgtcttgcatcttggataccaattcagccaaagtaggattggacaccggtcaggattgtgaggccacccttccagtccctaactgggatgatgacatttctagacataccctaggccagaaggaaatctgctgccttgaaagggaggaaccagtttcaggaggatctatcacttcctaactaaagagcacatgggcacggaataacaggcagcaatacccagttagtatcaaaaacctttgatgagactctgagatgtgctggcttcaggtgagacccagcacattccaagatctgatggctacagtgagagagaacttctgcttgagaaaagcagaaggaaaagcaaagggaacactgtcttgcaccttaggcaccatcccagccacaatggagtatagcaaaagtgggctcttggggtccccgatttcaagctttgactctttgatggcattttctgggccttcctggagccagagagcagcccaattcactgaaaggtgggtcccaggcctggcagtattcaccacaagctgactaaagagccctttggtcttaactgaacatcatcagtagcctggcagtactccccgggggtctgtagtggtggtagccattacacctttggtagtagaggctcctttgactgtagaaaggagaggtaaaagggggaaggactgtgtcttgtggtttgagtgccagctcagccacggtacaacagaacactagataattttctaaagtttctgaccagtccctggctcctggatggcatcacttctgagagccttgaatgaatataggtgatagttgggtagtagttacagtgagccttgggtaagacccagtgctgtgctggcttcaagtaagacctagtagagtcccagtggccacaggggtactacagtcactccaacccagctacaagtgactcaccacagagagactctgtttttttggaagaacataatggaagaaatcaagagtctctaactggtaatccagagaatttttctagattttatccaagactactgtggcagtacctctataggtctgcaagaaccacagtgttactgggcttggagtcccacctaatacagatacagcttagatcacaacacccaagtcctgtcaaatacctgaaaaatcttcccaagaagggcaggtatgaagaagtccagactgtgaagaatacaatgagtacccaacccttcaatgcccagacactgacaaatatccacaagcattgacaccatctagaaaatatcacctcaccaaacaaactaaataagacagaaaccaatcatattgaaacagtgatatgtgacttttcagacagagaatttaaaatagttgtttttagtaaactcatagacattcataacacagagaaggaattcagaattctataaggaaaatttaacaaagagattgaaataattataaagaattaagcagaaattctttagttgaaaaatgcaattaatgtactgaagaatggatcagtcttttaatatcagaattgatcaaacagaagaaagaattagtgaacttgaagacaggttatttaaaaatacacagaggacacaaaagaaaaaagaataaaaaaggatgaagcacacttacaaaatctataaaatagcctcagaggggcaagtctaaaagtgattggacttaaagaggaaagagagagagggattagggtagaaagtttattcaaatgggtaataatagagaacttcctaatcctagagaaagatattaatatcgaagtacaagaaagttatacaataccaaacaggttttacccaaagaagactatctcaaggcatttaacaatcaaactcccaaaggtcaaggataaggaaaggatcctaaaagcagcaagagaaaagaaacaagtaacatacaatggagttctaatatgattggcagaagactttttagggaaaccttacatgacgagaaagacaggcataagatatttaaagtgctgaaagaaaaacaaaatactttcatcctaaaagagtaaaaaattcctagtgaaaaaaattcttcaaaaatgaaagagaaataaggactttcccagacaaacaaaagctgagggatattaccaacaccatacctgtctgtcctacaagaaataataaaggaactttttcaaactgaaataaatggatgttaatgagcaataagaaatcatgtgaaggtataaaactcactggtaacagtaagtacacagagaaacacagactattttaacactgcaactgtggtgtataaactactctcatcttaagtagaaagacaaaaagttgaatgaatcaaaaataatagctacaacaacttttcaagacatagtacaataagatataaatagaaacaaaaaagttacaaagcaggagacaaagttaaggtgtagaatttttattagttttctttttgcttgttcatttgtttgtttatgcagtgttacatttttatcagcttaaaataatattttataatacagtatttgcaagcctcatggtaacttcaaatctacaaacatacaacaaatacacaaaaaatagaaagcaagaaattaaatcataccatgagaaaaaatcaccttcactgaaaatagacaaaaaaagaagtaaagaacgaagaccacaaaacaaccagaaaacaaattaaaaaatggcactagtgaatccttacttaccaataacatcgaatgtaaatgttatttacattctacaaattgttaaaattatcttaatgtaatgaaataattggatgaaaggtcaacataataaaaattaattgtatttttatatattagtaataaacaactggacttttttttgtaacatctgaaatagcatcaaaaaacctaaaaactcaggaacaaatttaaccaaaggtatctaggaccccacacttaaaactataaaacagtggtgagaaaaatttagagacttaaataaatggaaggatatttcatagttataattaaaagcatgagtcctgtgattatatacatctgtagttatttctactctattgtttcatgctttacatttgttacatttttctggaggtcattttttatcttctgaacttttgaatgttttaattttttttaatgatttggaagttatatatcattttttctattcattctacagttacccacagtatttagccaacatgtttaattatacacttttcttttagcttttttgaaatgtataatacgttattaataagtatggtcaaatgttctcaccacaaaaaagatgagtatttgaggtgatggatacgttaattagattgatttgataattccaccatatatacatgtatgaaaatatgacatttactccaaaagttatacaattgttatttgtcccaattaaaaataaaataaaagtaaatttttaaataaataaactgttttctttcaatgtctggaattactagatatttatatcctccatcagtaataatgcagaaatgggccaggcgtggtgtctcacacctgtaatcccagcactttgggaggtgtaggcaggcagatcacgaggtcaggagatcgagaccatcctggctaatatggtgaaaccccatctctactaaaaatacaaaaaaattagccaggcctggtggcaggcacctgtagtcccagctacttgggagggaggctgaggcaggagaatggcgtgaacccaggaggcggagcttgcagtgagccgagattgtgccactgcactccagcctgggcgacagagtgagactccgtctcaaaaaaaaagaaaaaaaaaaagaatgcagaaatggaaacatgagaagctcaattgcattttgcaatctccacctcttattttgagatcacatgcaatatttttccatttgttttaatttacacactattagttaattttaattaaaattgttttccggttttgttaaaagtttgtaccaacattcttttagctgaaattgtcctacccatttctatggcaactctgtcatcatttggtagtctgccttaagtgagtcaaggctcacattctttctcttcttggaggttcttctctctccttagattttgggttaattggttttcctgacactgcaactctttgatgcattcaagaaaagtagttacgattcagtagatcttctagccttttcttatggttggtgagcacagtgaccttatcagatttctgcattttaggtaaaaaccataaactctttaaactttaaactttaaactctgtaatgccaaatgtctttgtaaatagttatattttaccctcacatgtaaatgctaatttagccaagtacaaaatttgagattcaaaatgattttccctcagaatgatactgcttcattgtagcccagtaaccagtttcgataatgagaaatataatgacactaattcttgctctataagagatcagttgggtttgtttgttcagtgtttttttcagagagtttagaatttttctcacctatgttctgaaatctcacttgaaatatgtctaattgcttttatctcttgttactttttttttaaaaaaatgcttctctatacctgctgggtctcctcaatgcttcccttctgttctgatcaattttctcctgttaattctttgataattattttcctgtctctgttatttccttttatcactcttaattcactgatattaaaattttagggccttagtttcatgtcttaattctttatactatttttcatatatattaatgtatatgttaattttttaagttctgggagaattcctagttttactctttagctccattcattctgacattcggttctatctacattttttcctttcacacaattttcattacttattttggtttttccaattaatggggattcactttcatatatctaaggacattaattataatatttatgtgtttacttactctgtttcctcatgttctttgtgtgaggactttcatgatactagttttcctcaactgcttgccaattcttggcagtatataatttttgtatttgagaattcctgctgcctattctttgggtggtagttcaatatacctttcctgcctctgcaattatatgagcaccctgaatgtattaatgtattattatctggggattctgatagtttttattttgacagtgagggtttcttgcttcttctgagagtaattatctgggcccatttttatatttctctggtctcagtgcgtgcaccctatatttgttgtaggagaaaatatcactgctgcccactgctcagtacaagatgctatgtagtacagttgctcaaaatgcaattctgcagtgactcacctttcagattgcctcaaagctttcttgttgactcttactttgcatattccctggtaatttttctcaccatgaagaccatcttttcgtgcaaatgctttatactcctattttatgctgaatggtttttctccaaatctctttttgtttccatcagtttctcttattcctgaaatgatcaaaacaatcaatctgctaatggtactcttttgtgtttgtttttcacagttatcaataatttatattttataaattatactttgttctcattttatttgatttggggcatattgaaaaatacagattatgtacacagtctgcaaatttgaatcgatctcaaggtcctaaaaatatatttgacttatttagattaaaataggcccctttaatgtgaagtcaatctaagtacccatcaactaatgggtagataaagaaaatgtggtatatatacactttggaatactgttgagccattaaaaggaacaaaacaatgtattttgcagcaatgtggatggagctggaggacactattctaagtaaagtaacacatgagtggaaaaccacaaactgttctcacttataagtgggagctaagctttgaatacgcaaaggcatacagagtggtataatggactttagagactcggaaggagtagggtggaagagggaacggataaaaaactacacattagatacaatgtgcactacttgggtgataggtacactaaaatgtcagaattcatcactatataattcatccatgtaaccaaaaccacttgtacctaaaagctattgaaacaaaaataaatacatatgtacatacataaatacataaataaaataggctcttctaaaacactaaacttccttgttaaataaatcagttaatattgcaaaattcgattatacaggaaaaaaatctctatctattgatgattcttaatttatctagatttatagatatgtaattttaaaataaaatgtttgacctctttattttcatataatttttggtgttatgaagctttctgcttggctattagttctaaaaactaggatatatgatggatatccttatttaagttatgtcttgttagagagtctttgggaggacagaactccttctacttttgagagccacattttccctggctctaaagaataagatgactgtcgttttctcataaattgtaggtttttctacaaggctcattactgattcctttcagagctcattttcctacaaaatacataggagatctcagcgtcctaaaccagactaaacttttgaattgttgtgtgtagtagaccccaatacttgacaaattatccactccaattaactattaacgtaagttctttaatgtagagtctcagcatgtagcctgctaaatttttaaaaagagccagccacctttcctctccctaaactgtaaaacagagaacttaataggtaattctgtaacactttctgatagctttctccttaatgagctgctggcctgtgtctcagagtccacttccttaaatgagaagagcatggttttcatgtcaactattttaatattgacttcttttatactcattttgttaagaaatcaactgagtcaaatatgactacttatagtttttattgctttgcactaaccaataattatgtgtacaaaattgagcggtcaagaaatataagcttaacatagcccctcagctgtaaatgctttcatgaatactaaatcatataaaactatcttaattagtataggtagatgtgttctgcctgaccaggtcacaatttcaagtagcatgtactaaaactatgttttaattctccttttttagctcctttttaatggcttcctactaagttcaattaattggacacatgctgtcccggagtagcaaacttaaaaatatgtgtgtttttatgttgatgaaatgttttctctttagggtctaaaagttattaccagaggcaactggtcttgctgtctaaatagataagaattgcttactattaactatgctaaataataaccatcattcttaaaagttattctccaaaaatgaagcattcattttagtcatacatcagttctggagacaaacgtactggagacaaatgtacatagtccacagaagcctatgttgctatatctatgataggtaaatcgtaatatattttttgaaagagttgaggcccaaattaaatatgctgcagaactttgacatttctgagcatttatcactttatttgggggtagggtacctttccttttgatgtagtttcagatttacagaaatagtacaaagaactctcatatatccctagattcaccagttatttatattttctctatattctgtattactctctatgaagatatggatgtaatattttttctaaccatttgagaggatattggagacctttaagcctaaatattcatgtgcacttttgaagagtaaggacattattttacataaacacagagcaattccaaagttgggaaatttagatagcactatttttaatccccatattcaaattccataaactgtatcaataatattctttagagatattgtttcctgggtctaggatctaatctaggatcaggcattacatttacttaatttttttttttttttagttcctctaatctagaacactgttaacctatgcccatatgtctgcagtttctttttcttcaggtaaaatttccattcagtgaactacacatatttagagagttgacaaaggcctctatttcatataaatatatatatatatatcatatatatagtatatatatatatttcatatatatatagtgtgtatatatatctatatagtgtgtgtgtgtgtgtatatatatatatatatatatatatatatatatatatatatactttaagttctaggttacatgtgcagaacgtgcaggtttattacataggtatacacgtgccatggtggtttgctgcacccatcaacccatcatctacattaggtatttctcctaatgctctccctcccctagcccccaccccacaacaggccctggtgtgtgatgttccctctatttctataatcagcactactattaatatacaggacatctctgttctcctcaaaagtgggattacgtagtatatgctattttatgtttggcttttttagttcagcataatgactatgtgataatacatctgtgtctttgcatgtatctgttgttcataccttgtattacaaagcaataattaattatctatatatggcaaaaataacttattcctgtgttgacagctgtttagactgttacgaaaaagcttctttgtaactttttgtacaaattttattatatttggtgcatatgtattttcatatatatatttttagtaaatagaaacagaatcactatatcataaggtaaatatatgttcaattttactaaaacctggcaaaacctttttcaaagtggttgatccatattacatccctaccagctatgtgtgaaagttgccagttctaaagaacaggcaaaatggatcgatgtgaaaaaaaaaattagaaaatggattgtctcagggttgcgataatttcagagtgactaataaagtgaattttggacttaacttggagacctttatggcccatttttctcagataccacacctacttcttattaagaattccagtcagacttctcaactttcataatagatattccatccttcttttcacctctttgttttccaaagcttaagaactaccatatatatagattgctagcattttaaactcatgtgcaagattttatgagcaaactgtctgcttttcagtttttaatcacaaacttaactaagagaattgatattcaaggaagatggtctatttgaccaactattcatgtattactctaggaattctatgttatgtcctattatcaggtcacacagcccaaatgtcagttatctgtaacatgttattttgcatataaaaaatctatgttgctagattgcaattcaaaataaaagttcttattttttatttgcttgtttgacagttgaaattctattgatgtttataatgaaaatacttgcttttttctcctctctaggattctgattactatttcagttttattcatatatgccaactaaaggcatttctgaagtgaaatatcacagttttaaaccttcaaatacaagttaaaagaaaaatatccacaacaacaacaacaaaactcagctggcttattcagagtgcttttcagcaatttactcactttgggaatatctagttttctttgtggattaaacacgtctgacgtgactcactgctctaaaattcccagttttgaagtaatattttgttttatttgtcctaagagactgagggttaactgctttctcccatttagctcttaaaatgtatcagtttatttacagtatttaacatacatatattaggaccttcttattctataaaaatagaactacttgtttaattaaaccactaattgccttagccaaaggaaaacatcttactgaaataaatgatttgtcttggtaatagaagtgtcaaaagtgcaaatagatccctaattgctagataatttcccaacaattaattctgctgcttaagtattccccagctagctccatgttgcctctcattttagatcagcacatcaccatctcctgcttgattatttctttgcctccagtcttgcccactttatctacgctactacctttcatctttataaagtacagttacggccatgtcactctgctgtatgagacattccattgtcttccttctcataccactgtatagttcaaaataaagcctaacctctttatgttggcttaaaagcccttcataattcaagttatttctgtctcatctcttaccttcccctattttgcacccctactccatttataaccattttctagccttataaatgtccttctcttccatgtgaatctttgtgtatgccctcttttttttttaacctggaacactctacagcagcttttatacttcatgcacttaatgactactcttcctgtgatgtactactgagtagaggaaaaagttagagctatttttaattagtggtgaaggtaagcctctgacagcatgatattggattctgaagatgagaaaacagccttctaaggagaaatatgagtggtctagaaagggcagaagtcctgaactggggaagattatggcatatttgagtcatagaaaaaagtcagcatagctggagagcattggaatggagagagaggcagagtagagagaatgacagaagatgaaactggagaggtatatactgagtgcctaaatcatgtgtgatatcacagaccattccaaagaccttggattttagtctaagatcatttctaagccactaataagctttaatcaggcaaaaggcttaatctgaaaaaagttttgaagagattgctctgtttgtattgtaaacagtggatagaagtggaggagggtgaaattggcagctgagagatctgctagatctctctagcagtaggtggcatccaggaagaaaataatgatggcttgggtaggtgtaagcattgcacagggataaaagctactaatatataacttaggggatgagctaaacagaacttgctgaggaatagggagttgataaaaatcctcttatatttatgtagagaatttcagagattggaatttttcaagcgtgtttttttttttttttttttttttggtggtggttctctttttttccgcaacagtaacaatgcatcaacaaaaaattctgatagataccttaaacttaccacacacttattttgacagcttttcgtcttattttttagagtttagctgatctccttgataaacaagtttattcatggatggctgaaacatgcttattatttatatcaactaaataaagtggcctgcagtcgttgatcttgacaggacaatgcaatagctttcttgctgatgtgactcattattttctcttccaaactcaccctgtgaaccctatgcaccaccatcacaatttcctcaagaaccatttcaattaattttcttttctgcttaatatagtttttatagcccactatactcaggactaggtttatctttcaggcttcatttctcttttcttttcctcatgaatgcaatgtttcagctaaaaatagctagttagtattccttgaatcctccagaattttatcattattttgtctttactcttgcagtctttcacaggacatattaatatcgtatctctaaaacaaaattctactacccttagagcttggaatgagagtaatgcatagtagttaagaaaattagctttgcagttaaagaatcataggtgagaattctgcctctgtcacttaatagatgcgtgaccccagcaagttcttagcctaaggaccagtttccctttctctgagatggggaagatgagagtatctactttatgatgttgcactaaaaattaaataagatcttacctgcaacacattttataacattgtttgacataaattaagcaccgaacaaatgataggtatcaatatctttattaaggttcactttaaatgctatgactttatatgaaaaacccatggcatcagcttgaactatcaacttgaatgtgatgttatatattcccattgctgttatatatattatgagacatatatacataagcacaaacaatgtcttacatgttcattatcataaccaattgtctacatctgttgcatcattctttccacattctgctgtgcaataagattgtgtgtataccaaatatatgataattttttttgtcccatatccaattcttagataaagatttataccctcctttcacattgcttgtacctgtattagagttaagcctcagctctctgaactctacatgagagttaagcctcagctctctccaaccctgtcacagctatcggggacatggatggacccttggtgttagttgtttcaggtacattcttttcctccattacttagaaatcagagcctgagaatatgtcatcttgggcaatgttaacctagagcttggaatggccatgttcagatctaatgcattataaaatagaggaagttatgctagagagagagagagaaagagacagaagaatgatatagttgatcacagagaaggagagatgggagaccatgcagtcctttattgacagataaaataatttcaattcatagcttccttgttcctggtgtcagtccattttgcaatctagctacacttcctgccaggtcttttggtgaaatagcctatagtcttccatgaaattatcttcagttttagtagattttgttactaacacataaaccatctttgtaagaggccacatgcctatctccattcccttcaagcactgtagctgcatgaatatcttttccatcttcatctaggtcagtgcctaacacagagcagcagtaacaacctgatggcaataaattggttttaccattgctcacagtctagaatttaacacaatactattcaggcacaaaatcaagctgatttaaaagtaaatttaaattaattttctttgaaaacgttggtagtgttttataaaaatccttgagattttctctgagatcctgggctgggaattactatattaaaccaaagtgtagtaagtatcaaaactggctttacatatgagtgtgtctcatacatttggaaaaagccaagatgtttctggattgagatcttcttctagtaaataatagcttctttgaagctgtgttgtattccagacatttcacttattaaccaaggagaaggcagatatttgtatattgctggcatgaagacattctaaatttcacattctaaatctcaaatggatatttcaaagctttcatagttgtattttttgaaacttcaatttatgtagactagaaaatataactattttgaaatataatttaaaattattggtcctgtgaagatggcaatgtcgtgattccaagggagagtaatgatgtgttaaaaggtacacaaaaagttaatcagagaaaatagattgcagaggttaccagctagggctcaggagtcaagcagcttggacctcaaataaattctgtaaaattaattgctacttgtataattctgagcaagttatccaacatctcttagcctcagttttcttatcttaaacatcaggatgtagatgcaaatagtactcacagagtttgggaaaaattaaatcaagctatttaagcaaaagttttggcattatatctgacatgtgaaaatcttacaattcatgtgggctattggtggtatttcattgtagtaatcattatggacagattttcatctgattttacttttttcctggcttcaataagaattagatgaaaaagactataaaactgcatctgtgacaaaaattatatttataaattaattatgcataaacattgaaagggcaaactccaatattttaacagggatctttgttaataaagataagaaacattttcaattatttctgctggtacacatatattttccaaggctctactaaccaagacagacttaatttgccctcagcttaagtgaactttagacaggtttattccggactataggaccttgacttgacctccctttttagagcactttttaatgaaaacttttaattataaattatttatctgcctctttgaaatgtaaacattctataatccacaaatgtctttcccaaagtcctgggagtcatccctttgaaatataatcatggaaggacataggatcattgtctcccagtctctgtgggaccataggaacctaactttaataagcaacaattgacaagcacagatgacctaatctcactgatggacttctcccaaaacatcctccagtatttttccattagttcactcctgcctttaaaaattacctgccttagttcaatggggttgagttcaatttctctcccctatttcaatagtctctctcctttattgtaatagtcttgaatgaagccttccttgcttgtttaacttatctggtgcagttttgtcttttacattacaaggattatatctatggtaaaatagaagtgcagaggatgtgtgggtatgtgtgtgtatgtgtgtgtgtgtatgtgtgtgtctatctgtgtagacataagaaaatttttgttagctaaaaaagctaaagaggaactgaagttcaatgttgttaaagtgtttgtcttcaaacttatctcttaatagattacaatgattgtattttaggagaacctgctaaattcaaacagtcagctatgtcatggcagtatagtgtcagtcccagagacttagcagctaatagatttctttctaaagcacagacctcccatctaagtccaagtccccactggctactgatttatagagtagcatttggcaaaagacggtcttaatcttacctgggtctcattttcctgcttataaaagagaaaaaagaggttctgagaagaagtacaaaattcaaaattgaaaaaagaataaaatattttcacctagaaagattttctctcctttggtatgcaagacggacttgcattagagacagaatagcatggctggttagagccactctctaaagtgggctggctgcctggttatgcctttaagtgtctgtgcctccactgtgtaatgagaatgattctaacagcatttatgtcatagttttcttgtggagattaaagggattaatactaatagagaacttgcacttttaatgtgccttgtacatagtactttgaagtcatcctagctttatatgtttgctcttatatcattattattattaaatattttgatacacgttaaggagaaacagtggccaccagtcaatttgattttgaacatgaaagcagagtctgttatgattttcttttggcaaaattgtaggattttattataaccatgacaagatgagggtcacatgcacttctgagatcaagaaattactacatcatatagtttgaaagaaaaaatgtgttaacaaagtagaaaagaggctggtgtaattttgagtaggtagtgtctctgtcatagtgtccatttccaaggtaattaggtgttcttcctcaacatagtttgttgttgttgttgttgtttgtagcatgtcttttattaaatgactgcattataatttgaataacaaatttcctatagttgaaatattctggatagtttccaattttttatcattataataaatgtgataaacataaatgttatacatccacaagggaaataaaaacatataatgataaaatatcaatcttcagcagattattttgtaaattcttttttttccctatacttctggtattaatttttgaaagaggatattttttgatacacatatttatttgaagatccaatgacatttattcatccatagatttacatctatgtacattgaataaagatgtgtactttttatggtagccatttttattctgatactttgtaaagatactaaaggttagattgctttgtttaggaaaattaaaatgtatggctttctgaaattatcatttttaatagatgtaataattgtcccaattttgaattagtgtagttaatacagtttaggaattttgttttaaaatagactaaacaaaataagggatatataaagagcaccattaagtatcaccaaacagctgacttacccaaacagatttcatctccaagcacaatttgtatccaatcagcaaacaattcagagatcaaagaagatgatttttacctgaattacaaattacagttaattgcataatcatattaacgaaatatcttatcccattatcgttgtgtattcataatagttttctgagatttgaatgtgaaagcaggtcaaatacttcataaggaaggaaacagaaagaggcccatgatattttcacaaagtcaaggattccatgcatgaccgtgcctgtgtctcactctgctcttattaaaactcaacacctgcaatcattatttttgctttgacacataatattgaattttcaattttagttgcttaaaacattgtcatctcaactgatcgtgtcttttattttattttttctagaagtattgaaagctgtgaaattatgtgagtctggccttgagaagtaaaattttgggggccactgatactttagcactgagtttgatgaattctgctctatactcaaatatttccgaaggcaacaaaaacagcaaaagttatgtagttgactttctttgttaacttaagctaattttaggactgggtgtagggaagatacataaaaatgaatgaagaaaatacagtttatagaaatggttataacttgtatatcattccccaaaagaagcaatcacaggcaacttcagtagcggtttagaacacagatttaggaattatacagacattttgcccccaaacttagttccatcactattacaaggaacagccattgttcagatgtgtaatgataggtgagagatgcatttttagatgtggaactgcagaatgaggatgatgatacatatagaaatgtaattgctattgccaaattaccctctaaaaggactgcatgcatctgtttacactcccaagagtaaatgaatgtgcttgtttcttcatacactcaatgatactaggttgtataaaaacattatgacttagtttaatgagagaaaaacatgaagcctctaatgtttccattaaatttctttataagtaacattattttatttttaaaagtcagaataaatctaaggaaactttcttagtgcctctgcatttcaaactaaaagttttacataataaatatttgaagatataaagcacacaatgaaccatgcatagaatattagaaaaagtatagacataatccaaaatgtccttttaaaataatattttaaagtggttaattgcattcatgaaattattaagtcagttaaacactatccaagttttatataaacattctaaatttgcataaatgcacacatgtttatattctccttgaatttcatactttactggaaaatctgagaatggccaatattggaacaatgcagctcttcccacgtatttatgaaatatattgccacttaaattataaatttgattctagtggcaattcattcatttagagtatcttttcaagagattttgcattaactaaaagaaacagtatataaaatcttatttttgagcagtaagagctatatatgtaaagttttattcaaataattttaattttaaaaacaatacatttccagtcacgttatttgcctttacatgaggcactaattattgagaaaataactaatataaacttatagaaacatttgtttttatagttcagaaaatgagaaatttaaaaagaaattccactctgaaaatacaacccagtttatttaggaacacagataactcaagagttgatttaaaggaaaagatgcttgcacagccttgcctaataaccttttttcctcaagtatatactcagctaaaaccttagattcccaggttcttgcaattagtagggaggcatatgacaatagtttcccaaatgtgcttaataaatagagttgtacttttgaaaaacaaacacagaataaaagtatttttaaaagacttctgatcagtttcacttgcaagaaaaaaagtgagtcttctgagtatttttcaaatacaatgctccttactcttggaatatttgaacgctcttgacagaactatattttccttatttgtttgttctgcagtaccttcatgcaaaaataggtaaggcattagaaaagacgatgaatctctcaactgcctcatgctgttttctgtgagcaatactagtgaaatgcatgaaataagagatggttcattattttgagttctgaaaattagttgtgcatttaatagttctgtgagatcctattcagtgagaatattcagggcttgttttgataacaaagtcaaatttgattcagttagactcctgaaggaagttgggaatataaaggctaagtcaacatcctaataggaattcccagttattccctatatgcactggtatttttgcattctagagactcaaatatattactaacagttaaataatactgatatttttctgcaaatataattacctctttcttttaccaccatctgctcttctagttttccattcacatggatatcactcagggaaattctcccataaggtatacaaatgtggaactaaccacctccctcatcctgaactaacaagaacagggtgtttctctacccattgttggcaaacatcttggaaaggctcagatagtaaatattttcagttttgcagctcatacagttcctgtggcaaggattcaactctgccaatacagtctgaaagtagccttatgtaaaaaagtagaagtggctgtttttatatttatttacaaaaggaggctgaaggccagatttggcccatgggtcttagtttgctgactcctacctgtaacacaacatgcctaagaagaaactaatcctaaaacttcttttgagagaattagtaattttatttatttatttaacttttattttagaatcagggggtacatgtgcaggtttgctacataagtatattgcctgatactgaggtttaggtttctaatgatcccatcatccaagtagtgaacatagtacctgataggtagttatttaacccttgcccccttcccttccttccccactttgaaatcccagtgtctattgttcccatctctgtgtccatgtgtacccaatgtttagctcctgcttataagtgaaaacagaacatgtggtatttggctttctgtttctgcgttaattcacttaggatgagggcctccagctgcatccatgttgctgcaaagggcgtgatttcattcatttttatggctgtgtagtgagaattagtaatttttaactaaggatgtagagtaaaatgatctagaaacttatctgtattttatttggcagttcagtgacttaaactatgtggagaggagttttagattttaaagaagcaatatgcagaggccaggcatggtggctcatgcctgtaatcccagcactttgggaagccaaagcaggcagatcacaatgtcaggagttggagactagcctggccaatatggtaaaaccccatctctactaaaaatacaaaaattagtcgggtgtggtggcacacacctgtagtcccagctacttgggaggctgaggcagaagaatcgcttgaaccatgcaggcggaggttacaatgagccgagattgtgccactgcactccagcctgggctacagagtgagaccctgtctcaaaaaaaaaaaaaaaaaaaaaaaaaaaaaaaaaaaaaagaagcagtatgcttggttgaacactaacaactgtaacccttccttctggcatcatttaataattttagtagggcagacaatgctggtcacttaatcaatgtccattccactctctctcctcacggacaaaacacatatttattttgagggatggccatatagctggctaaaaacctggatgtctcacatttcttacttaaatatcaatagcaagtgaagttcttctaacaagtcgtgtgagagtggaagtctactcaggttgacttccaaagctgttgtttttaaggcaaaaaaaaaaaaaaagagtcagcttttgctctgagcccttcttcctgccttcatggaatgcagttctgatgcttgacatttctcaggcatattgtgaccttgaggataaagccacatgtttaagttggaggaaactgaaaactgggagaagactgagctgtggactcccttgaggaggtgtaagtatcatggtgtgattgaatatagattcttggttaggagtaaaagaaaccttatttgattaagccactgaagccaagattctgatatgtatagctcaactcaatactatctttagatttaaaatagtgtctctattttatataagatgaacatgatctaaaattcaattttacaccagagtctaatttcattaatttcatgtttctcttcctgcttctattttaatagttattttttcaaagagagttctatttcagaagatttaggtaggaaattaaggaaattgcaaaaaccctttcactgtgctaaggtgctcttactttgcaggtatgttcaaactaaatacttctgtctgcaatattctcagcagcaggcatcgctgaccctaaactagagtataaaagagtgggaggatgaaacagaaattgaaaaagctcttaaaaatcaataaaatgttaggttgtacaagatattgaaatacaagacattgctcttaagaaaacagctagatagctaggtcagagtgcagtaggtcaagtcctttttatgaactgagcagggaggttgtgaccatgaaggagctgcacagcagggaaagattgctgcagagcaggtaacagcctgccaaataaagacggcttcatgtcaggaaccacacaatcttctgggagagcagaggtttgctaaaggattctcttaagatttttttttttttaatttttggggcctagtgcaaatgcatttctttcccacaagaagcatgactaattctcctgatctttacaaataaataaataaagattcccttaagaccttggtcttgtccacacgtgacttgaagcaatagaggtagaaatgaacctcacacacaaaaaaatccttactgattctcttaactctacattataatgcttggaagtatttctgacagtcagagatttgagaaatttatttgagtactttgttttaaaataacgaatacttttcaaatattaactgtaaggaatttaaaaggtagattatatactagactatagagaatatacgtaacattcaaacactctccacttcgtctcaaagaaatggtgataattttgaaatgctgctgcatgagaaagtgtctgaatttttctgttctggaatctttcctttttttttctcacattgaatttattctccatggtatagactgtgatggaatgccaaattatttcttctgaagccttattagtaaatattagtctaatcaaatatttagtcaagacataatcttccattactgaatttttatttgttcattacagaagtgctggatatttccaaacctgaacacactctctgtagatacttcatgggaattaatattattgcactatcacatgtatgttcttatcatgctatgaacatggcaattaaaagccctgtgactactactactaactcagttggaaaagcaattatccacttactcatcaccaaggcacttcttaggaatgcatttcagaacaataatcaatagagatatttatgttgatatagtattggttatattcatgtctgatataatatgggttacaatgacactacaaagtttaactttggatatgccatgggtagaaattaaataaaccttgtaattaaaaccagataaaagttcatgctttgtaccacagctgacttggatcttggccacaatagctaaaagatgaaaggatctcggtaatgcctcagaggtagtgggaaactagagctacccatttgccatttaagaatttctcagatgatcctgagccttgaaaaggaatggtgtggcttgcctggggcacataccttcaacaccttaccatatgccactccctcagccagggaggtgactctagtccactctgagttataaagaattttttctttcacgcaccacattttcagcttctcctaaaatctagaaatatcctcaaactaacattaaaccaacagcggtgtctgtaggcctggctgtatcgctccagaacattgggctcagccagttaaactctgacaagcaatctttatgtcctgattgtccaagcacaaatggctgaccatcagcaattaaacatagcatccagcaattcacattctagcacatgtcgaacgaatcctccaggaattatcataaccaatttaactcaacacttccaaggaagaggattaagatgtgcacaccagagtaatttcttctcactcattcttttagcttgcttgtggcacaattggtccttagagcaagagtcacatcagagaaagtatgcttggatgcatttattccagcaatgtcaggaaactcatcctggttagtagcccaaactgtagcttctaacatgggagatcttttaaaaatactttagcccatttcactatgtgtttgtattgcaaccagaacacataaaaaataatggcatgcagctgggtgctgtgatgcatgcctgtagtcccagctactaggaaggctgaagaaggaagattgcctgaggccagcctgggtaacatagcaacaccttatcaagaaaagaaaaaaaaaaaaagataatgacatgcaaagaggcagaaaataaagaaagtcccattttaatcatgagaattcatctgggaaatagtagactttttaatagaatttaattattttattttgattgtagtgttattcaaattacaacttatcctgttctagattattgttagtgatctgtaaatgtcttccaaatcatttgataaaaacactttctaacagtgagctactgcttgatttcagaacaggctggacttttgaatccacaaaatgacactgttataaatgtccaggattctgcataaactctgcttatttttccttactcttaggaagattagatagtctgttttcaagtcacagtcctttttctggtctctcatttggtgtggatcaagtcacttaaccttctatgtgtttgtttcttcatctttaaaattaggttaataattttgaccttttgccttggcgttttactctgaactaaagaaaaacattaacacatggaaattatcctgggatctgtagatgaaatgtgcagagatggaaggagttattctatttaaaagaaaaaattagacatacttcagtgaattcacttcacatgtgtgttctgcttcagtgaagttgaaagaaagtggttactggaatagacagatgtttacatgcatgtttggactggtaagcaatgatattgaaaatattactattcctaacacatagagacttactggcctgatcaatttgattcttcacttatttattcacagctgaattctgcttgcagtacacatgcaaagcattcttgctggcaggtaggggaataaagattttttagtttgtgtttttaaaatgaactcaagaagaaaattaaattccagatacttcataaatatatttttacaaatatgtttctataaattttagtttacctcttgctgagagaaaatcaaatgcattgtgaaaagtggagaggatatgtgaagaccaccttccctttcttttccttgacctctgcaactgtcctttattgcattgtttttgatctgggtagaggttatggaaggtaactactctccagaactatgaagcctatctgctttgtcgtttctctttaagtccctttaaaaaaatctaaagacatgaattagatgcttggacatgtcttttactttacatacctctatttccctatttccctctaggaaatataagaaatccagtttttcccccttctgtgattaatataaattttgtgtagtattaatacccaacagcacaattcaaaaaaaatttatcaaagaaaaccctgataacaaatcacattttaattcaaattttataattttactctaaagtgacatgaaatcttggatttatggaaattatagatgtttggattaaacacataaattatttaagacaagaaagaccatttcttacataaaattgaccatagacaactgacaaccttaaattcttaggctcaaatctaaagtgtggcaaggtagaagtatgcccaacatacttcctttttttcgacttctcctttgcaaaaaaactacacctaccagtcatactgtccagatgaaagccactcagtctgctttcaataagaacatgaattaaatactctcaatggaatcccactgctggttgagtcaagcattctttgcacatcctgcttcacaaagttccacaaaatctgaccattccttatattttaacatgattataattcatacatactgagcatttgctacatatcaggtgctatgcaaacgatttacttttccaaacttaaataataatcccaagaattccacaaggtagacactgatagtttgctaagttacaaatgtgtaactaaatctagagaaaactgagtaactttgcaagaggctcaaggttagtaagtgacagaaacaaaatataaactcggatctgcctgatttgggatggttttcttaatacttacactgtcttgtctcctgtccaaataactctggaaattgttttattctccctgttgttagttgctactctctgtcttcctcacttccacttccagaaaacttcaagctcttaactgctctaacctgttcaccaagttcctactggtgaacaggtgtgtattagtccatcttgcattgctataaagaaatacctgaggctggataatttataaagaaaagaggtttaattggcttacagttctgcagactgcacaggaagtatgatgctggcatctgcttggcttctggggcagcctcaggaaacttacaatcattgtggaagacgaatggggagcaggcatgtcacatggtgagagcgagagcaaggcggggcggaggtgctacacacttttatacaatcatgtctcatgagaactcactcactatgatgaggacagcaccaagttgatggttctaagccattcatgaggaactgcccccatgatgcagtcacttcacacgaggccgcagctccaccactggggattataattcaacataagatttgggttgacatagatccaaaccatatcaaggtaagcaagtgattattgttctagtagtttttgaaaaagtttataaatgattatctataaattatacctctgcatttgattacagatgctaagtagtttaggaatctgaagttagtaagcttttctttttaaaatattgatacatccaagaagagaagataataattaaatatagcattgttttagttttgtgcttattatatattgttgatttttatattatatacattgattttattgattttagcagaaaatttagctctgatggagttttgtcatcttgatggtgaaaacagtctcatcatccttttaaatgagtcactgctaaaaaagtatctgaatagacacatggctctaaatacacacacacacaaacacacacacacacacaagctgatcatgtcaagttatttaaagtcagaagacttaccaattgatcctgcgctggcagaattttatcagtttggggaactaactggggcctgatcatcactggtaaaaatatgtgctatataatgataatttctttgtcttgtgaaaacactaaaattcctaggagaactggctaactcatatttattgtctgcattgtaggaattatgtagaaccagaaaataagaaatacctctgtacaattgtgtgtgtgtgtctgtgtatgcatgtgggtatcaccaaaaaatattaaaatattttccaaacaaaactaagcatgtgacttaatattaattctgttggtcttcatgcccattaagatgttcttaatcagtggatctctgtgttacaaaggtggttctggataggggttagcaagattaatatgttgaagggaaatataaaaatgaagctgtgttcttcctaacattatgaggaagcatacttgaaccctaataaaattctaaaagaattttcctcttttcagtttccctaaatgtactgctatctctgaccctcatcatcctggcatttaagtcacaatgctgacaaaatctaatcaggaaatggcaacctataaattttgtggaccaatgtaaaagggctccctttatcataatatgataatatcataatatcaaatatacccggggtccccaacccttgggccacaggcaagtacacacttttttggggagattgcaaaaataaagggaaaagccacaaacgcagaaaaaggaagggaaattaagatatgtaagctgagtcttccacttaggttatggaaaatcacaacaaaagatcacctctcatcacagcaagaacatgctagatgttctacaaaacctaaattttgtaaagaccatcagaaagctgaggttgtaatgtaaactaatgaaatgaaaggctaatgatggactagttgagaagaaatccttccacaggcaagtctgcactcatccacacaacccactcttttatgtggtctttacttaaaagagagctcatgaagattctgagcagcacggaggcatgaaaaagaccctttgtactgcaaacaggagaagtctgcctaagtttgagtgtgaaacaggaaaaacaaggaaaaccctcccacattctggattctgcatgagtttaaaggcaaagatcttttgtcacttaaagaggggccagcaaacactccctttactttcagcctagcagcaagtacagagaaatgttatctacaatggagggaggtcaggactattgagaaagcccaaccccagggcataggtatacagagactaagactaaggctgaaacaagagagccaaaagaagtcttcttatgatttagattctgcctgagagtgaggtaggaggtcattagccacagtgggagggacaagaattctatttgtattccagaacttgtacagagaagaagacaaaggttttctcctgcctatactcttgattataggttgaaccatgaggcagaagtcatctgttactaagtgaaggggtggaaaacatgcacatggtgtaaagtctgcaatgactaggaagaagtgtatgcttctgggaaaagagcagaaaaattgagagtgatttcctctggggtgtaggtgcagggtgagcctgcacccaatatgactaaatgcgaagcaaagaactggactaagtgagggctactgccaatgagcagttaactagagcttttctatgagagagaatatcaagtaaggaggaatattctaagacaaagcacctggctaagaagctggaaaagacagatggagtgataaagaaacggatgcattttgcaaagagcagctggctagagtagaggaaaggaactcagagttctgcaaggtcaccactcaacataattagaaagctgctgaagaggtggcaggaaagttcaagtgcataagtctcatccagtctttactgatccatatgccacaattctccagtattatcaccagaacaacccaaaactctcagctgctctgctctggccaaccagtatagacagagcatgcttgtgaagggaagataaaatgaacttttagagcatgcaaaatttcttcaacattaattcaagggatgcaacatattttttttcctagtaagaaaataacctatttgaagagaagagcatcaaaaagtattatgtagcagattcaacagaattatattacatcttaatcagcaacagtttaaaaagccaaggcctagatcagggatcagtcatcaaagaacactcttcaatattaataaacctcatttatggtgattaaaagagaaggacagctctctccacatttttgtatttttaacttaacttctactgattataaattatttctcttgtaattcagctccatcattcggtgaacctacattctagcaaatttggagtttgggtggcaggggctaataggaatggaaagaggaggaggcaaacaatcttggggcaacagtgctatgtggaattgtctagactgtggcatgttgattttctctcttttgcttttttcctttgattacttaagagctatctcattttaacttctaatagtgatcatgcaaacaaaaagacaaaaaggagaaaagatgtacctttttactggaatagtatttatgattaaaagtcaaacaaggcatttttgtcaatataaaggcaattttagccaggcacaatggcttacacctataatcccagcactttgagaggtcaaggtgggcagatcacctgaggtcaggagtttgagaccagactggccaacatggcgaaaccctgtgtctactgaaaatacaaaaattaaccgcgtgtggtggcgagcacctgtaatcccagctacctgggagactgaggcaggagaattgcttgaactcggaggcagaggttgcagtgacctgagatggtgccactgcattccagcctgggtgacagagcaagactccattgctgagaccagctcattcggagagactctaacccagcggcgctagaggaattaaagacacacgcacagaaatatagaggtgtgaagtgggaaatcaggggtctcacagccttcagagctgacagccccgaacagagatttacccacatatttattaacagcaaaccagtcattagcattgtttctatagatattaaattaactataagtattccttaagggaaacgaagggatgggccgacttaattgaagcaggaacacgcccttaagacacagatcgctcatgctaattgtctgtggcttaagaatgcctttaagtggttttccgccctgggcaggccaggtgttccttgccctcgttcctgtaaacccacaaccttccagcttgggcattagggccattatggacaggctatagtgctgcagagattttatttatggccagtcttggggccagtttatggccagatttgggggggcttgctcccaacactccatctcaaaaataaataattaattaattaattttaaaaaattaagggaattttggcttacacaacttctcctttaccataaatactgttatattcacgccattcactatcaataataaatgttttgtgatgaatattggcattgtaaaaccaaaaactcaaaaaccctcatccaaaaactttatgggcaactgaaaacccctcccatacatggaactgcacagagtaccaagaggcagctgtctgccgctggtagacaagagcactgagaaagatatagctctactcctgtgtccaagtcacaggtgcacagagcctgtttacgcgtgaaaacatacacattgaaacaaaacttcacacaaacacatactctaggacttttagcaagtactacacagtagcaatgtacttctgagatagaagaatactgatagaaagtacttctgtgatgcacgcacacagggccagctgaagtattagtgtagagaactaatgataaggtagtgtctatatgcaaatcaggtacttgaaggctgtggacactgatcttaaataaagcaacaaagaccaaatgcagctcaactagagattgagttagcccaacactcgtacttgagggctcacagaaaaagaagcatgtctgtttctgggtataaatattatatgcattaatctgtactgttcatctacaaacaatgttcagtatttaatttaaaaattatttggcacatataagtcaagaacatattgctcatcatcaagaggtataatagtcaatacaactagattcagaaatggggtggggggctaggggagggatagcattaggggaaatacctaatgtaggtgatgggttgatgggtgcagcaaaccaccatggcatgtgtatatctatgtaacaaaactacacattctgcacatgtaccccagaacttaaaatataaataaatgaataaataaaaacaaatagcctacatgttagaattatcagaaactttaacaaataataatatattaaaggatttagtggaaaaagtaatgatatacaacaaaaatgaaaaatttttaaagtactataaaaaagaataaataaaaatgctagaaactaaaaacatggtatcaaagataaagaatttttctgatagtcttatctgctgactagatataggagaggaaataatcaatgaacttgaatccatgcttataacctaactaaataaaaacacacacaaaaaaacagtgccaaataactgtaatggagcacttgtgatatttagcacagtataaaatcatttagcatatacactattggagtgcaagaaggataagagagcatgaggtagaaaaaaatggaaaagatactatttgaggatttaccaaaattaataaaagatacaaaactacagattccagaagctcagagtatccctaaaaggacagatataatgaaaaacatgccaaggtacaccatagtcaaacttataaaaaataaagagaaaatctttaatccaaccaaggggataaaaaagaaactttacatacaagaaagcaataataagaagatagcagacattttagaaaaagcatgcaactaaatgatgtttttaaagtgcttcaattaaaaaagaaactagaaatacatatccaaaaaatatgtttcctaaaaagtaggtaagatgaagaactcatacaaaaatgtataaataaaacaagacagagtaaatatgttaggaaatacaaaagttcctttaaaagtattcttaacatatgatttttgaatgcatcaagtaaaataataagaaatagtttaccatgtatactgaaatgaagtatatgacaccaaaacatgacatattgaagagtattagttgaaaatatacattaatattattttaaatggatcatattatagaattttaacataaactgtaataaatttatgatgcggccaggcacgttggctcacgcctgtaatcccagcactttgggaggctgaggcgggcggatcacgaggtcaggagatcgagactgtcctggctaacaagatgaaaccccgtctctactaaaaatacaaaaattagccaggcgtggtggcaggtgcctgtagtcccagctactcaggaggctgagacaggagaatggcatgaacccgagaggtggagctttcagtgagctgagattgcaccactgtactccagcttgggcaacagagcgagaccccatctcaaaaaataataataataataattttatgttacatattttaatgtctagtgcaactatgaaagtgacataggtagacgtaactaaataatcaatagaaaagataaaacagaattctacaaatgttagatctactaaaaagcatatagaaaaaagagaaaagagagaaaagagcagattcaccaagtatacagatggtattttaagtatacagatggtatacagaaatacaaacattgaaataattacattaaaggtaaataaatacctaaattaaaaggaaaaaaatcctgaatgaataaaaacacaagatccaaataaatggcttttaaaataaatacattttaaagacacaatctgttttaaattaaatgaataaaaaatgatataccataccaacactaagtaatagaaaagagatatgacagtactaatatcagacaaagtagacttcaaaggaaagagtattttgagatgaaaagtgggatatttcatagttataaaaagttaactaaataacaagatatagcaattctaaattcctgaatatgtatgcatctgatgcgaaagttctcaaaaacacgtagtaaagattgatggaaacaaagggaactatggaccaatcacaaaatgtaagtgcagaattttatatcttttcactagtaattgataaaacaagtaggcacaaatttccgtaaggtaatacatgatttaagcaaaactgttaaccgcttgacataatgatatttatagaacttgaaatacagcaaacagaataaatattttctgctttcaagtgcacatggtatatttgccaagatagaccataggctgagtcagtataaacgtttctacaactatcttaaaaacatttatgaaactgtccaagacctgacatcatgcagaatatgttctctgaccaaaattgtattaaaatagaaattagtaacaataagatatccagaaaatgtgtgaatatttagatgttattgaaagcatactactaaataatatctggttcctttaaaatattaataaaattaataatcactagaaagactggtgaataatatagaatacacagattgccaatatcaggtttaaatgaggtaacattgcattagatgcttcaaatatcaaaagaataaaaagaaaatttttggaacaatgttttgacaattaaaaagctaatttaaataaaatgtgaaacaatcttgaaagaaacacattaccaaaactcactcagaaaagaataaaaaatctattttgtcttatatatcttgcataaactgaattcatgatttaacaagttccgacaacaaccagaaaaaatactccaggaaaacatggcttcagtggtgactctagtattttaggaatatgtaatattaattgtatgcacagtcttttagaaaatagaggataaaacattctctaactcattttatgaggccattattaccatggtatttgttatagaccataagtttatgttccctcaaaccccaatataatagtattatgaagtaagtagactctttgggaggtgattggacatgagggcgtagccttcgtgagtgggattagtgcccttacaaataagacaagagagcttgcctcttctctctggcctaggccatgtgaggatataacaaaaagatgtccatctgcaaaccaggaagaatttcataactagacactggatctgtctgcaggcaacttgatcttgaacttcccagctttcagaactgttagaaataaatgtttgttagctaagccacccagtctgtggtattctattatagcaaactgaattgactaaaaccacactagaatgacacaagaactttgaaagataatacagaccaatatcacacatgaacatagatgcaaagttcataatgaatgttagcaaatcaaattcatcaatatttcaaaatgttaatataaaaaccaagcaatatttatcctatgaatgtgaagtttaacacaataaaatgcatagaagttattcactacataaagggaaattaataatgtgatccttttaatagatgcaaaaatgtatttaataatataacacacttgtatcataattatgttgcttagttttctttactatatggccatctacctttatcattaaaggataagaatgcaaggtattgttctaatcttacctatgttacctctttgtttattacctagactgtaaggtaataaagcagattcactctttaccacccgctttgcacaataccctatttgttttcccattattgtgtgtaaatgtgtaaagtagcatttttttctgaaatatgtatgccatgtgctgtctgttctcaataagagctgattcattacacaccctcaaagaacattttccttccaaatggattatgttctctttaaatggaggaaggttactgacaatcattgtatgtgccatggctgaagtaaatgagttcttgtcagaacaaggggagaaaaatagaaatttgggctaagccaaaacatgaggctggcaaaatttggcctctggattcttagaagtcctccccatctgtccagtgattgatagtcctcttttcatcatacaaagacacttttggaagggtcttttataagagatacaatcactttggtgtaacgttttccgtaagtattggatttgcaattagtattttgttgatgtttaatagcaagacgttgaaatattctataataattgtccattttttcctccatgcagtgggtatccattttcactttgtgtattttaatgctccatcatcattatgaagaaacctttcttattcctggtaaaatatctttgctctgagatctaatctgtcttacagtgatatggcccccctagctttcttttgacaagtgttgacataatatgtgttcttacattcttttcttttgactcattttgtcctcatttttaaaaaagcttgtttgtgtagtcaacagagttgacctcacgcttttatccaaatgaatactctctgtcttttaattttggtgtttagaccatttacatttaatatattattattatgtttaaattttatttattatcttgttatttattttataattgtccagtctaccttaccttcttacttttttttttttttttttgcattttcttgcactgagtacatttaatgattttcttttatctcctttgttgtcctcctggctaaaacactttatcattttaatggctgctgtagagttcatagtatatttttctttaacttacagaccagtttcaactgctattacatcctgataatatttgattggatacaaaatattaatttttctcatttctgttggctatttttttttgtattgcaatacatatcccagtgtttggtactatgattcagctagttatgtggagtcagttttatacttttatttcctgcttttatgatttttttaaagcaactccaaagtagtgctgaatctatgactaattatcctctactgatgcatgacttttctgaattatctattcaatatcctgtcatttttttccagttttgttagtgaaaacagccactattcctggctttatatgaatgctagacactgtttttcttaaactgtttcagatgatttttttttcctaaactggaacagtttcctcacagagatgcattgttcagtacactgaaaacttgcagcagatctctgggtttttttttctctacttaaacttgagcactcagcactgactaaaccaaatttgtggctagatgtctttaaacaaaatctcttcttccagttttctgtgttccttaaaaacattttaactttgcaaacttcctaaacacaattaatcttttaactattcctgtatatttccaaagcacattgtgtacacccttattaagaaactcaacactatcttacagaagtgtaagcacttgtctgtcttccttgaagggaaaaaaaaattgatttgttgatttgtacatttttacacttcatagtaagaataataaggattaacatagtagcaattaacaatatttgttgttagataaacaatacagaattctcaatcatttctgtaactcaaaaataaaagtatagtcctggaatctagaaggctaataaaagaaacagaggtaccccaaattttcaaacaggattccaaaaatgagtcaagtgtcaattgttgtgagtaaatgaatcaatttccttctctttattatacaagttttgtgtgctggtaatacctaatattaaataagtataatatggggtatttatattcagtactaacagagtattaaaaaaaccctctcctttttttccaaaatagcaattttctctctctgacacagttgtactatagtttatgtttgttcttaaatcatttaggacaatttccaaaaggtctttgcttgtaagacaaggcttcactctaagaaataggctttcaagtacatagggtccgaggaagtgagtagcagggtacgtagcaataaggattttataagcctttcttcctgtcttctgaccaaggctatccacgctttaatgctcagatcatctgttgtttataatttccagagaactattgatcttttttttctgataacatatagagcataattatatttcttgaaattttctatttttagaaggatttgaattatttgtcaaaaattgaattcaggttgagtccactgttctccctgtagctgtttctaattccgtgaggttcttgttctttgtgctgagaatattctctctttgaaagaccgatctgccttcttcttcaaatccttagcttagatgtagttatctcaccactgtctaccatgagcatgtttcatttaaagaatgaagctaatgaaaggttttggcccttgctctgcaagtgagtaacagtcggctccagtattattacgtcacatgataactatgtagttttctccatacctgggaaacatctcttatacttgatatgggaagtgaaaataatttcaacagatacagattttagactgtttaaaatcactttgtatgagttaagaggataatctttaaatacacttccaattcaggattaagccccaaacttcaagaggttcatttgattttggctgtttctcagttcattcaatatcattagctgtgcttagtggcagattcttaagaagaggtcttacttgcatgtaagtcaattgttttagagaaaatattaattaaaataagtggtgagtgaatttaaatcaagcagggccatgcctctattctgagtttaaatccctgactcatttttttctgtcttcctggatacaatatagaaatatgtatttgataaatatctccatccagaaaaatgaattcaaaatcacatttagagctttgaaccaaatctttcacagtaacagatgctctttcctgaaacaagcttattccacccagtgtatttaatagcatcacttttacaagtgaggggcaggtgggtggaagaacatgcatctcataacctgcctcccttcatactcattcatatattgcatgtttttcccatttgtgtttttataagcacacagattattatacttgcatagccagggtgataccagcgaggcctggggcccagctttgcagtgactgtgacaagcttggaaaaataacctggttgacaacacatttatctgctaaatgtgtcttggagcagagaatagcaacaatggagaagatacttttactctttctgcccagaaagtcacctctgcacttaggataaagaataataaggagccttgtggatggaaaagaatatattatttatttatagtacctttttggtttttcttctttttcaagagactgaaagaattaaagcaacgggaatttgctcgaaatgtagcttctaagtcatggaaagatgagaaaaaacaagaaaaagcacttaaacgacttcatcagctggctgagttaaggcagcaatctgaatggtaagaattaaaggtgtctgggatgcttcaaaactctcgtcaacctatggggaaattttaaaggcaaatctactgtaacaatgtaaacaaataataactaactaatagatatgtctgaagggcaaatatagttaaacatacataaattaataacttttggcctttgatatttttctttcctaatattgttaatttaatgtactctataatgaaatgatcccagaatgattcaaatacattagcatttattctatccagttgactaaatggattaatatcacttcttaatatattttttaaattttgtaataataattttaaaaaccataattaacaatatatcttagggggtggggaataagtcttctgaacatttccgtgtacacacctgtgtctagtacaaataacacgatcattgtctggctgacaaacaagatgtaattaatgcagttaaatttaccacacagtgccatttaaattgataattataatataacaagttttatactaatacattcttgtagctgaaaaatagcagttttaccaaagcttggaaccactggatgtttcaaagttgttacctggaatgcaattaaatttgtggattgtgatttgtgttcatatgaatcataatgtaaaacactaatgtagctaattaatgtgtttgacagcaacctagtgaattgtgaaacttatgcctctgtgccagaatttaaacacctattgcttaaatggaaagtaatatataataaacaggagtgagtggctcaattagttaccacaaaatattagacttaaaaggtaattttaaggaaacatttatttttgtaggaccaattatgagtaaaaatgcaattaatattcagcttgcatgtatttatttataacttttagaataatctaattaatttatgaaaatacataaaagataatcatattaacaagaaatgagaaatttcatatgaagacaaaataaaggtacaacatgtagccagaagtaaggttaatacaaaaatgcatgctctggggtcttatacaactctagaagcaacgcatacatttggtactgagctttctacagccaacacaatgagggacttacaatatgttgtgcaaacatactgttaatgagaactcagtccttgccaaaatagggcttagaaggaaaagttctattgttgttagggtagcatgcaggaaaaaatctagggaaagtgttaattcctgtgattaataaggagatgcagtaagtcagatcataacaaatggtacaagttctaacatagatatacgtctttagacaggtcccttaagggcacaacagtaaatctaaatagtcttaacaaatataattttggttgtttgttattatgaaagttgtcacacttctacatttctgcttacccattctatattttcctctggagtaaataacaaagaatcagaggtgccttgctgatggcagtggtcatggtgatggtgatgatgataatgatgctgatgatgataatgatgctgatgatgataatgatggtgatgatgatggtttatttagaagttccaagtttgctagagctacccattaagtttctttcaaataaaaaggtccactctattaagtttcagctgtccctctggaagccttattcactaaacaaacacaaacctaaccactccttttggtgatttgataaaataggcaaactctctaggtcacaatgtgcccgtattgttatggaaaagacaagtgttcagctttctagatatagagcctgaaactaggaaaataatttttttttatcgtctactgcccatcacctgcctcttagccaattgctctctctgcttaaacagactcatggttgaaggaaagtcacttaacagaattattaaatactttattttagtaggtgaattgacaagtgaaagttaaaaataaaataaaaagaaaaaatcactggcattacccttctcctggacaatcttttctttgtcctttttcctcataatgagggcttctgaataggatgatccaggtaacacaattcttctgtgaccctttgggagaagagaggtgaatttactggtagtgcataaaatgatggcaaaaaaatggtaacagatcttataaagggtcatcaaatttgaccgtctcttaactagttccagccaacctgtttcctcagcaatagcagttattatatggggctgagggtttagtccctctctgtatgtgaacttcttatgtatgtaagttttagtacatcttaatatggaaatttttccaaaatttaaaaattttagggccactgattctgagactatgaattttttaagtggtgtcatttcttaatgttccacgttatctagctcttatatgaagtttttcatataagagctggaaaatggaacacgaaagaatgacaccattttaaaaaatcatgttgttttgatatgtttttctttctgtttggtaaggatgctttttgaacaggagagaatcaaaatgtgcatttgttaagctgcagagtattagaatttttggagaacaatttgaatggaaaatccatcaataagaattaaaaaccaaactctacagacactttattaaccattattttaatataagtaagaatatattttcaaaactaaagaaagttccaaagaagtgagggaaatattaaatgtggagaaaactataaaaattgaagtttcattgagaatgcaactgtggtttcaaggggcgggctggtgggagaaatgtgaaggtattgttcaaagtttataaactttccgatgtaagatgaataagttttgaggatctaatgtagagcatgattatcttagctaataataccgtattgtttacttgaaatttgccaagagagtgaatctagtgcccttatctcacacaaaatggtaactacgtgtatgatagatgcacaaattaatttgtttgcatacatcaaatgatcacattgtataccttgaatatatacaatttttttccagttatatctcaataaacctagaaaaagttaaagctttaataatgttataatacccaaacttgtattaaaatagtagaatttaaaaccccacaaagataaaaacaggattttccaaaataataagaataactttgatttaagaaaaagcaaattaaaatttataaagcaacaagataaaaagtttaaagaataaaagtaagaagtgtcaaagattaacaataaggacaaaatgttaaaacttgtgaaaaatctgtaattataaatgcagtttaaattggaaaatgagaactagaattaaggacaagaagctagagaacattgtattagaaaaacaataagagcaaagaaattttaaaatatttaaaagaatgtaaaaagaagaagcttgcatattagagagctacatggtaaaataaaacagcagtacagaaaagaacatttagattaacataaagcaagaaaatgaataaaacagtgtcaggataatcagcaaaattattattaagaaaagtatatatataatatatttaacatgatataataaatactaaaataactgcataataatggaattgggaaaggaagaacaatagtatccatacactagacttgtggaataatttcaactgtgtttcatacaggtgataatgtcagatcgattgaagcttctggagaagattaacttaatccagaagtatagttcctacttaatccaaattgtggctacaaatatggaaaataatctctttggtaccaaggcaaagttgaatgctgcagctgtttctggatcacttccttctatctgcaggctggaggcactttcaaaggccaataatgttgtaataaagtctctacgctccttatttacttttatgcttgaaagaaacattcagtaactcatatactatcttagaatgctcctcactattcattttattaaatatgcctaatgaacatcaaaaatttactcaataaaaggagattaatgtgatgaataagaactttccgttatgaaagagttactgtaaggaagataatacagcttttaaaaacgtctaaatttagttttttacaagatttaaaggaactctgtaattctaaaattacagccattcatgaagaggagacgttctaaaatcattaaaagctaaatggtggctaaaattagtgtttgcaagttaaaatccatatggtcataatttgtaaacagattgaatattgtaaaaaaaactgagtcagtaaaatagaaataaaatcaaagaaattctccctgaactatagaaaaagactgaagacagaataaagtactgagataaatatcaatacctaaaggatatattcaggagagccaatgattttaaaacataaattccaaaggaagcaataatcagataaatcaagggaaaaaaatgtatctgaactgaagaaagttaaattgaaagtgcccaagaacaaaaattcacccaaattaatcaaccttaactatgttctattaaaatgttatacatacatatatgtatatattaatatacatgtatatatactctttatgtaacaaatctaatgaattatatatatttatatttttacactttataagaagggaaaagcatacaagcacacaagcagattcatctcaaagataaataaagggaagctaattcaatatgtctataatatgattcatctagagacaatgaagcaaagtacatgaaatttggtggacaaaaggaatgtgatgactctagagttcgatgctgatttgccaaagaatggtaaaagaaaccaacaagaatttgttagacaaggactcagaaagcactactctacattagaacttgagcaacatatggaagagataccagttggcttagtattttatattcaagcaacaaatgactagaggaaagtaaaataaaaatcaaaattagaaataagcaaacaaacacatccaagtatatggaacaagaaaaagaatgccagttcaaagcaaacaataagaaaaatgatgtgatttgtattgtcttctttccagtgaagccttcttttatagtagagggtatatagatagactgttaaagggcatataattttaatctaaagaattttatctcttatatatgttgatattttcaatcttctgtatgaattgctaatgaagctcagtagaacaaataaccttttgagacctttaaaagataaaacatataatgcagaaatggtagaaaaaatattttggtgagtaagaagcagaagaaaagatttcaaaatcattgaaggtatttagatagattgtacatatgtcttattttattatgcatttattataattagtcaaattactgacaagtcataaagaaagaacttaccactgtgtttcaaaagtaagtgaatatgagggaattttaaacccaaggagctaaacattataaaatgttagaaatagcacataaaagcaaatttaaaaaaatttttatatttttaaagtggcttttaattctatttaatttcttatttaatgtgaatgcactgattggaaaactattagtgaaatcatgttaaatctgtattccaaagattgatagattctataggacatatattgtgatgtaaatgctttagaagcagtagcataagataattcacttgctattgctttttggtaattgcaaaatactacatgtaaacaattcattttagaaatagccactatacaatttatgctaagctatataaggacaacaaaaggttatgttttagaagatgtagctcataaaatgtaaaataactcatcttagaaacactatgaaatgttcatatgtagatatgattccaaagctaatctcttaatcatttaaatatttattgtatttacagtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaataagtgttaaagcccctcctgtggataatttttttaattgtcactacctataaaatcatacatttaaagaagtctgtcaattataagatttaaaatattgctgccaattcaaaatgtgacaaatatataaatatgatctgaattgctaatactaaaacaagagcattttaataattttttagcttgccaaaataataggcaaatttgaataattttatgaaagcgtagagggaagagggaaagagttaaagatttgttttggatgggttctcgcataatgttataaaatagcaacagaaaacattcaagcagagcattaaaattaaaaagaaaaatcaaatgaaatatggcaccctgcgttctaagtatttgttgtgtgaatgaatgagtgttgatttggcttatttgttagataataaaaggtcagtgaaatgaagcaattatttaaagtaatttatgtcgttaactattgactaagttttcaattaatgtagtctgttactgtattttcataggaaataagaacaagacattttctgattaatttaggttgaaaattacattttaatgaaaaacaatctttatagattatacttttgagtttctgtgaaaaataaattatcttcatttcacacaaatctatgtcaagataattttgtaattgtaagaatcagcaaaatctaaaactaagaatgtttaacttttgtataaaaacatatacaaactatcattagtatttgataatgcaaactcaaaaataaaacgtgctcagaataaccttttaaatatattggtcaatctgtcaaatataacaggaactaaaatattgtttattattcttctactcaaaaattttactacgttcagccaatacatgtataaggatagaggtaaaggtttgaaaatgtcagtgtttttacatgtttattgaggatatcttattaaatatctggtgtgttttattcaattgtactagatatttatgaaacaatgaataatgatgaataaattcaccatccatgtaatgttgcaaataatttcaaacattcattcaaaatggtttttggccgccaaaatttgcatttcatacatctatattggtgcataatcctacagttaggtttattattttatgttcttaagcatgagtttcagagaaaatcaaacttaacagaaatggaggtaatcatttatctaatgctgtctatacgaagatgcaaactcctctaccactagaagattagaggatgtcttcttcagccttggctgcaaaaggaagatagctatatttaaggcttgttgtgattcaggtacagttaccctatccacttgtttgcattatcttctttaattttcacaactgtattttgaaatcagtattatcattcctcattacagataaggaaaatgaaatagaaaggttaaatactaaatacttggtaaacagtaggaaaggacatcgttgattcaggagagactggtgagagagaaagagaaagaaagggtggagggaagaaaaagaataaaaggagataaagtaaatttgaaattttaacagaaagaaaaactgcagttcccaagatatcactagaaacttgtgagatgagagttctgactggtacataacactgacagaatctaaatttaaaatgaatggagaaatgaagaaaaaccatcaaatagcaaggagctatacttgcatggaattccataaaaatgattataaaagatcactgatgaacattgagtaaatccaaaaagaagcaagacaaacgaaatatttcttataaaatggatgacaaatggtctagcagattttttaagtcctgtggataattatttcctaaagcaaattacaaagctgatgcagagccaagatagagtaatcatggaaactcactagatgtcctattataaaaaacactgaccacttgattgatttttataattgccttggtgacaatttaaactctcagaaggttagacccgagcacctctactgagcacttaattttgactaacaaagacagattgatatgaacggatgacatggaagtgactattccatcttgtattaacagtgatgaggtgttcactggacaaactaatttggactatgtggaaagcaaacatctccctttaaataaaagataatttgtactccagggtgagaaattggaaaagttgtggcatcacgtgaggaaagatgcaattatgcaacttacttccccccaaatcagtaactgtaggctgaaacactgttttattttccattttaccttgagataaacacactttgggaaaaaaaaaattttaatatatattgaaccctaaaatagttcgattttaaaaaaattgtcactgtgatggattgtatttttagcagtgtttccttccatttacataattatttgacaggtgacttttagcattaaatttattttatgactattgcctgatatttacaggttaattttctttatgggattactgtttcacaagtggctcatggaggcagtttttaaaaaatctgtcttaagctctaaatgcttaagaaaggctgtgaaatctttccacacaagtacacacacatgcatgcacaaacacacatttatctatctatatgtctttcttacagattatgaaccagtctagcatcagatagcatcattggattcgaggtaaatgaaataaatgctttgtatgaagcactgaaaatttgggaatgttcatcttcttaataattgcctgccaaattcagcaagaaaaaaaatacaatgggcctataaaaatgcaaaggtaaacttaaggttcatctttaagacgttataaatgaaatattggaagtgattagaatatagagaatgatttaaaaagtctccaattcccagagtttttgcttaggtagacattttataaaataatcccttgaaatttgtttcacttcccgaaaatggattttacagtgactccttttctttagtttctgccaggacttaatggaatctctctgttatctctaaatggaaatacacttaaagaaactaattctgtaaaacgtttctgttaaatgaaacacttaaccagtacaattactcaagattatattgctgaatctgactatctccttagtgcatgaagttattacttacacagctcaaaatgctggcagcaacagagctttctgaattttaccaccatacttttaagttgatcctaaaacattatacatttcaaatcatttgatacaataattggagatatggagatggctctacccattaggataccgattggtattcaagtgtcctagatgtatatgaatgaaacgtccagatcccctccccaggatgtgtggatgtttaactctttagtggtgaaatagtactgctgatcatctcaaatcagtagcacatttcttaatcattcctaaaaagttctccacgttttcagtttctgagttttcagaaacatagttaacattctgaaaaaaacatgtaaatgtcatatccagttttgtaaaaacacaatttaaaagatctaaatcttacatatcaatgtatgcagataagatactcaggggcaaaatggacctaatgctcatctctggctcagcaaagctcatgaaaaggtttagttttgattctttaaattagatgaaattctgaaggaaaatgtgctctcattggcaaatagaaacattattaaaaagcatgtgagtggctagttccacacaatagtcaggaaaacagatagttgccttttgtgtttcagactgaaaccacttcaataagatgagcatttcctactaaaatactagttctcgtgccaataagcctgggtctagaggattttcaaaggttatcatttcattccagcaaaaatattatccacttcttctattaggtagacattgaaagtgattgttgtatctttggattaagctatattaaaatggaagcagcagctgaatgggttaggtttagaataagccaatattagaaagagaagccaaagggtcattttcattctatggagctatatataggggggagagctcccaatccacttttaaaattattttctcaaagtcacttcctctttttgcaaccccccatttttcttaaatagcaagagtaagaatatcttgtgagaagcattaaaataaaatcaggcaaattggaaaacttaaaatatgtatgagtgcacatgtgagtgtgaatctgtgtgtgtttttaataaatatactctttagtctttaattgtacatcttgatctttgttgaaaatagtgttttttaaaacatattcacatattgaaacaacaacttcaagaagaggtttcttatccccaagcaaaattgttagttccttccatatgtgagataaaatagttgacaatgtaaattagtcgtatagctgtttaaagcaaattcccatcttactcaattctatttaaagtactaaatttgtaattaaacttggtgatcctctggcaatatgacacataaaccaataattttatgttgcattttctgtataaattgtctttttaaactatactgtggctaagtaaattgcactattgtacatgcaaagcagcttttttaggttattcaataaattacttggactgtagttcaatgcaataatatttttttcgataaaaagcttaatgatataggagtgttagtcatgtatttctaacaaaaagcataccaaaatataagaacaaactcaaatgcaaaatggtgtggaaatattctgtgttttacactgctgaattaaagtgcatttatcattttatttattactgtatgtatttatattatatatttaaaggctgggatttcttagactatttcttaaaattttagtgttattaaaataagctgtttcctcaagctgaaaataaatataactttaaaaattctatggatgtattctttgttgaaacctatcatatatatacatatactgtaaaatctgtttctttttatttgcttttaaaaatgtgaactaatgctttgcaatgttctaacaaagcttcataaatagtctcaggaatgtattctctagctggtaatatcatataatatggtagcattctacacatttattataactttcatatgaactctagagatactttaattaaaagaaaccccagtaagttgttagtctcaataggactcaactcactaggaaatctctttaatcaagcatgaccaatgttgtgggaaaatgacatttcatacaactcccattcatctttactttcttaatctttgcactccagagtacctggatgctactctgatatttgtgcaaaatatcagaaccaggtgttgttagaaataaccactagatactcccttgttcttgaattacatctatccttatccttccctttacccttcaataagctttaaccaaatcctaaatctccttactttagtgttttaattgaatgagctgtcactacctgtgcatttcaatggagcagaactttgcaatgcactctcaactagtggtagagtttgagttttcagtagataaatgtttcagaggccagtcacctgctgccctacacttccagcctagattccctacttttatgctagatcatttattagaattctgctatgtaataaaaaagtatcttttcacacaatacatacacatccacacacaactacatgcacacatgtgcatacctacattgttggtggagtcatgacagaaactgtcctttcttaataaaattgtcaccatttattgagtacctaatatgagccaaatactgtttatgtcctccccactagctatattcctggattccccctgaggagaaaaataagtttctcctgaaaatgaaagtagattttatatatatatatatatatatatatatatatatttttttttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtaagccaccgcgcccggccgaaagtagattatattaataattacactaagacaaaggagcaaatggtaatctatggtctctatactcagagcctgctcttcataatgtgtgagccttctgcctttgttcactctgtgtcattttttggctcatcataaaaatttttgcaccaatagaaaatgactgtcgcatactctttttttaaatttttttaagagacaggacctcactctgtcacctaggctggaatgcagtggcaccatcatagctcactgcagcctcaaattcctgggctcaagcaatattcctgcctcatcctccagagtagctgggactacaggcacatgccaccacactctggctaattttttaaatttttttgttgagacaggggtctcactaggttgctcaggctggctgcaaacccctgcctaaattatcctctgagctcttcatcccaaagtgctggaattacaggtgtgagccactgtgcccaacccaacacatactcctgaggttgttttcttttactacatttactggtagacttgagtcatttcccaaatatcactttattaatactttgaattctagagaggaaacatagcagaactttctgaaggtgcttagcaataaataaataaatgaaaccactcagcagactggcacactcaagagaatactatactttataaagaatcatcagtcaaacaccttacaagttaaatgttttctttatattttgtttatcagaaagagatttcaaagacacaggatttcaattatttgtctgggatacagcatgacatcttcagaagaggaagcaaactctgatacctattcatggaattgcttcattcattatcaggatattttaacagatgcttttgtcttttgttatattttattcatagtttgtgggcaaaaatatttcttccatatttccaagacttaaagaaaatatattctaaaaataggcaattaggaaataactgggatgtaactctctgttctttaaacccctaactccccaaatagttgcttgggaaattgtattattctgtttcatactgctataaagaactacctgagactgagtcatttacaaagaaaagatgtttacagatatacacagttccaaggctatacaggaagcatggcttgggaagcctcaggaaacttaaaatcatggtggaagggtgaaggggaagcaagcatgtctgccacatggtggaaggagagagagcaaaactaatatacattacgtagctactgcatgcaaggcacaaatatagcagtaaataaactatctaaaatttctgctcttaccgagcttccattttagtggaggggtaagaaaaagaacaaaataaataagcaaaagatgtgatcaaaattagtaagtgctgaagaagccaatggccatctacacataatggaagagcctatatttgttccaaaatctgttttattatgaaatctatgcttattcttctacatgaaatggtataagatagtgatgattatctgggcaatgatgcatgtttgtttggttgctccactaaagaagaatgatgagtttaaagaaattcatctattttgaatggcctgtagagaatagttataaaatttaccctaatgttcgccatgttaagcctattttgactttgagcctggaattccgtaattgcactgcttcaaaatgtgttgctattgaataatttaaaatgcaatatatggttataggagagacgatggcatatttacgaagatatgaatgcaacattgtagtcatcagtaattaatgcatgttcaaaaagaaaaaaatgatttcagagaatgacaagtgcagtagtcatctgagttctctgttttaggaaggcagttaggtgtgaggaaaacctctagcttttggcaaaatctacagggaaattccatttcatcaaaaggataggctcctcagggtttgctgccattgtctaactagttgctgtatttattaaagtgtgactgtttcatgtctctttgatgtgaagccattttcctaaatcccacaatcaataattatttactgggctttttgttttctgttatcctagttatttcttttttttcccccactgacttaaacaatagcacaattccttttttctccgtctaggagcagaatgaaaactgtaaaatcatcccatatgaaaatctaaactatatgagaaatgttacttcttgatttctaattgattatctttgcaaatgataaataaattaattatcaataagtgaggctgtctaataaatgaagctttttggattgttgttacacagaaaaatgtatctttggggatgatatcaagtgtttctccttggaaagccagactctgaattgcagcactgcctggccttggtttcttatttcaaattgagctgtcccattcttgatggcagcatggggttggttgtcaccacttatatatatagatgtttcagtgcttcaggctgatttctggcatgtccttgaaggattacactggccctcttgggcatgcctgttctccttctgctccttagatattctgccctcatcaatttttctcacatgccaatcctgttggaattgagttttcacaataattgtgaaaaatataaagaaacaaatgcatcctgaaccctgactagtgtgaattttattctgcctactgaggttgcatgggtggtagttgcactagaatttagtaactagctgtgacaaggagtcaaattcttataaattgagtgtttgtaaccacacagttactttgtcaacttgagatctgatgtatgatagtgttctattaagagaaaatgagttcatgtgccaatttgagaggcgtgtcattaatgaagatttcagagagataagagcttaaatattttcatagaggagtgagcttatccaaaacttttcaatgttattcatgtttcctcagtcaagatgtacagacatatcaggaaaaacatagcaatcatagttgactagcaggttaaagagaaatggtcacaatctatttgtctcatctactttcccccacaaaaatgataaacatttaattggctatgccaggattgtcaagatctagaacagtggtgtacttgtcattttgcatcctccttttttttttaacttactattataacattttccttcttgctacattgtttcttaattagcattttgaattaggaagaaaagtgcatggagtgtatatactataatttacataaccattccccatgttattgttatttagactttcccccagctttttgcaaatataaagaatgcttcaatgaacatttttgtagatgtggtattttttcttcttatcattactgatatatgattggttcttggaaaaggagatcaaaacacacatattaatgttttgtatatattaccaaattgctttccaatgagttttatcaaggtcataaatataaatatatcaaaaaccatatcaaaaacagtaatgtgctataattcattcaactcttccttctcctatcattatcattataatcatcatcctattattattattctagctatactataattataccataattatataatgattgaagatttaaaaagactttggtatgttcttttgtcctttgtaagttaaaaaatagttatagtttctactttttgaattatctgtcaatatctttcggaatctatgtaaaataagaatgtgtgtgggagtttatagctcttgttctttaatggactacaaataagccttaatcattatgcttcacaattttactcctaaacttgcatacctacactttataccccatcgaaatgtctaattgcctgtctaggaatcaaatatcttcctgtaggatcttgtctcttgtcattgtattacacatatttcctttagaaagaaaaaattatactaacaataaatgctaactagttctttcaaagatatcaataatggtaaaaatgctgttcccatatagtagaaagtcatagaatcttataattaggagagaatttagagatcatctggggccaagaacagcaactacaatcttgtagacaccctgtttgacttactgaatgaatgactgaatctaatattgtgctttcatttttataaacaatgaattttctaaagtgtgtcccaggaatacaaatgaatttgccagtgtaagctggtattgaataaagaaatttaactcttaactataatactgtgccatccagatttagattgatggcaaaagttaagagcgttagtgataacttagatgatggaccttagaactgaactactcagtttcaaaccccctttcattttctagatgtgtgacctgaggcaaatcagttaacctctcacagcctcagtttctttatttaaagatgtatataatgatagtacaatctgtataataaggaatttgactggaattgtagcctctaaacccttggaataagaaatttggctggcctatgtcctgggtttctagaaggtagtctctaaattctaggacttccctgagtgatatgtgtgtctttgatatttgtggttagccttgatagtttatccttatgaggtgacccatggtctgctcctagacagtttaaagtaatgagattactcaggatggaagccggccgtgccaaaaagacaacatgtggttagcgagttgtggctttgagccagatgatatcagcccaacctccagagaggggagaggagaaatggaggttgagtgacatgggcaagaatttaatcaattgtgcctatgtaattaagccctgacataacctatgcatacaatgttctggtgtgcttccttggttgttaacactctgtgtcatgactccaggaagagaacaatggaagctttgcatttcgaatcctcttagaggttgttctatgcaactcttcttttagctggttccgatttgtatcctttttgctgtactaacattgtcatcaaatgtatagtactttagtgagttctgtgagttgtttgtcgtgaattgagcctgaaggggtagtaggaatccccagatttgttgccagttggtcagaaataaagatggcctttggacccttgaactttcagctggtgtctgaagtaaaggtagtcttgtgaaggattgtgtctttaacctgtgaagcttatcacaacctctgggtaattggtgtaaaaaattgcaacatctcatagagttatgagaattaaataatgcttagaatagtaaccatatgtaataaacactgtgtaagtgttagatattgtaattatcattaaaagttcaggttttctcatgactgataaatataatgtccatataataagcattggtcattttttacttagtactttttatttaaccattaaaacagttctataaaatgtttccatatggccattttcccagttgtctgttttaaggaaacatctagtgagtggtagttctgacattaaaaaaagaataaaaggtctgtgttcttcattacaatgtaatatatagcctttcccacttattccaaccaaaggctaaaatctcattttctagaaacaactattacatttataatcacttaaaaattttttggctgatcttttgctgacaaaagaatggaaagtttacttccagatttctgtacaatctaagctaactgactcactgtactgaatgttcagctatctgtcatagccaatagattccagaaattataatagtgcaaactcaataagtgactattttaaaaataaaatttattaaaatgtatttgtaatagaagcactgaatgaataaataaatccacaagtctcttgaagccagcaggctgataggtgttcttcgtcttcaaattctggctcccaatgctttcttgagtgtcatctttaattcaactgaacagaggtggggaaggaagtggggagcaagaggacatgcaggagaggaatgggaaaaaatataaaacatttaatatggtttaagcctagaagtaatttcagctcacattccattgactagatctcagtcaggtggacccatctaagcgcaagggaggctgggaaatacagcatgtctgtggaagaagaggagaaaatgcaatactaatagtttaatatttcattcttaatttttcatatgctttgctgccctatcaagtccttgcaggaagtagtccataacaattcaatgctgattattttattaaaatcctttccttcagtgaaataccctacttgcctatcacgactaaaagtctctctttttcacaggtgaaattgtagttctgattctggcaaatttaaatatttgtttcttcttctgagtgaatgaaaaccaaaatgtttaagattgtgcttgctctttttcttattgtttctggcttcttatcccaagccttaacacttgcttttctttctccttctcttgacccatatcatgtgattaaaaaaggggggtggggaaatgatgtttgctggtcctgagaaaatggaaatgtgtaatttcagaatcccagggttttctaagggaatgttgtgctaagagcatgatccaggctctattttatagcaggtcagttattcatcctctgaccctcacccctctttcttctgacacttcttgtcctttggtttcaaaatattaccttagaaaactataaaataataaatacctagcactgtcctgttgcacagcagtttcttaaacattgcactcattactgaattttccataccgcacctgccagttcaatgagagatagtctatttcattgtataattcctcatcttgcagatttgcttcaaaagtctacaaaatagacaagcacaggctttataaaagtccttacctttaggtgcttggtgatgttcaattgacctatgaaattacatatttataattgatcaactgcttatggttatcatgctttcttttactttacattcccaacaacttagcatatataatcagctgaattccctttcaacagaagctttatcattcttgaaataagaaaagaaaaaaaatcaccaaaatgatcacttagaatgtcacaactacactttgtacactttgcagtatgtgacctatcctgggaaaaggcatattcttggcagaatgttgccctgaatcatcatttcagaactgttatgcctgggaaccaatactctaagtgtggaatacaactgaagaccaggagaggatggagaagcattaagaattaggtttcacctctgatttctaggaaagtggtgcattcttataatgaaatgtagatattcccacagtttgatcaataaaacaaaaattggtaggagtatgaaatatatcaaaaatcaaggcaaaaatgtataaatcatccaagacattcattattatttaaagcttttggatacttggaaaactatttgacctttgttaacttccattaaaaaattaaggcaatgaactttcatactaaaatttttccccaaagaaagtgtgcacattttaagtgtctgaatacattttagctaatgccaaaatgtttctatcatttcttttgcatatattttacttttttatttagaattctgtaaacacacacacacacacacacacacacacacacagtgttgtttttatttcatttttttgtttttgtttttcatacaggcttgttttcaaccaggcataaaggtaatagaaaaatagagattcttttttaaaaaaatagtttgaactaaacaaagttttagattagttaagagacttctggctttttagtccagtatttttacaaacatgcagttttgctttctcttcattctggttcatttgggtattatttttaaaagaatgactttggacaaaataaaaacctgcttaaggtcacataagttagcataacatgctaatagcttatattcacgttaaaagatacatattcaggtcaagtccttactgattttaagactgagtgacctatgccaagtggacatttgctgtcagaaaagtgtcccttcagtatctctagggagcaacgagactacaggtgctataagaacctataaataataatgaatgtcttggatgatttacacacaatgtgactaaaataaaataagaggtgatagttgaaaaattctaatttgttttgacctccaaattttttatcttagaaagtatgcctcctaacaggcagtgctatcgagtaaagaacaaaacctttggactgatactatctgatttcagattccagctccatcctttaccagctatggatacttgggaaactacttgacctttgttaacttccatttcctcatctaaatgagagtaataaacgtaggttctaccttaggaggttatagttagcattttgtaaaagtgtttggtacatatggaggtgtagtcgtattggctaatggtttgattaagcagcataccaatttaaaagcatattttaaagtatatctttcatttgaaagcaatatactatgacaagataataaaaatgggaaggaaaaacccacagtttggatttttctaaaaggaaaaagccatgcccctcactgccaccttagatagattcactcactcatttttttcctgtctttgggcttagtctatggactttagtgtaagataagaacagaactcctgctttcctgaactgtcccaagtaaccaggccctaaacacacctgcttcttcatactgcacactgctatgaatatataaaatagcatcctgatatgtcctggagattcagcctttattattttgcagaaaatctctaattgggcaacttactatccaaagtattaatatccacaaggatcatacaatcttattaaaaattattttattgatttctatctttccacctgtgcttgtcacctgagaagcagatgccagattggtaattacatgtataaaggatttcttggagaaaacatctgtgaggaaaaatcaccaggagggagttagaagggatcaggagaattatcagacaaagatgtaggtataattcccgtaaaagaaagaaaaaagcaaggaaagttgagtaggagaagttgtgcaactctaagactgtttccacaaagctaatggggagcacttgagccaaagccattcattattggaatcttatatttccttaaataaggcctcgcctagactccctgttgtatttaatcattggctatgagcacctggtgggaggcatggcctctaatcaaacatatccctggatttcctagtatatcagctgggcccatctttcaattatgctcccttcaatgggagacagagaatacttaatgaccaccaaacgacctgatgcttgagtctcttctacactatctcctctctgcaatgctagagttccatcaccccctctgctgaggtaccagtttagcatttaccctttgttccctctctctgccttttaatctatctcaaataatacccagatcatcccttatgctgttgaatgtatcacaataaattccaaagacaacagcaatgtttaaattattttttgtttagaattaactattaatcaagagatatagaacataaataataattcccagagcaagcacagtctccagttgttattaatctttgccaagactgataaatgattgactaattacatgaaatattatagactcaggaaagcagagcagaatgttaaaacagggcttaagcaacggtctgcattaatattgtgttttgttcacttatgctgcttgtgatctgattgtaaaaacaaatcagcatttagatattccaaagtttctccgaacctataaaaaatactgtttagttgtattttttattcattagcgtttataatgtaaacaattatttaaaatgataatcaatgatgataataaaatcattttcaaaacagatttacagcaaagggcattagacattataaatcagtgacaataatcaatttaccatgcttccaaatgtacataggctaaacttttctcatgaacatttcaaaacattcaaatttggtataattttgtaacaagttataataatttatgaaaatgacaattggtagtcagccactttctagggaaacaaaaagagaaactcagagctaagcttagagtgctttgcagttagttttattaattccatttgcctaaataaggtaaagatttgccttttttttttctagagtgatttaatcagttcaagctgctataacaaaatactatacattgggtggcttaaacaacataaatttatttcttacagtgctagaggccgagaagtccaagatcaaagttcccaaaaagtaggttttattctgagatctcttctcttggcttgtaggcaggcactggtatctcactgctcaaatgacctctttgtacacacccacagaaagacagagagagaacaaactctctggtgtctctcctttacagacgctacatgagggccccaccctcatgacatcatttaactctaatcatctcccaaaggcccctctccaaatactgtcacatgtgtgattagggcttcaacatgtgaatgtgggggtgggggcacacaaacattcagtctataccatagaggaactgccatagcctcggatctcaatctgtaacacagcacaaattcacaacatgatcaaatgacaatatttcccaggtcaatgggaggtacactcttttccctctgcagttgctctttgcaaattctcccatggttccccagggttctttacaaagatcagcgtttcattcctcctttgtactgaaaactgtctgctaagagattgggatttcaaggatattctttaaagccagttgatgcaatagtgacctcctgtctgttggtcttgattacttccagggccaccatgaccaaattggaatcctgggttactgattaaaccattatagcaagaagcaatgccccatatttagtacagcatcactgcagtcccagtgccatcttgctgtcaccacggtgctgatgtgaagctctgctgattctcccaggattctgtgagtaactctagtgtcaaactcagtcagtaacatcctacagcaaaaattacctgaaccccagctatcacagctttcatccacacatgtgcaggtgtacacatgcatgtgcatgcgtgcacacaagcacacgcacacacacacacacacacacacagctgttttctcaacaagatgcctaggatgacatcaccaggtacttgcaaggcagagcccaaactacttctgccctaatacatggctggtatagagtgttaagcacaagtccagacttttcctcccttatagtgaagcttacctctgaggttttattttgcttctgtatgtcttaggctcctcctgtttaatcctatagatttcagtacacttaaaatttcagagagaggctgggcacagtgggattaactcactgggcacagtgagactgtaatcccagcactttgggaggacgagggaacggatcacctgaggtcaggagttcaagaccagcctggccaacatggcgaaaccccatctctactaaaaatacaaaaattagcctggtgtggtggcttgcgctgtaatcccagctactcgggaggctgaggaaggagatttgcttgcacccaggaggtgaagtttgcagtgagccaagatttgtgccactgcattccagcctgggtgacagagcgagactttgtttcaaaaaaaaaaaaaaattcagaatcttttgacaaagtttgtctgattccaccttcagccagaagtttctattatattcttcataacgaaatgaatacattacttatatcaacttgatgtaagacatatcaacatagacagatagatgatagatatagattagatagatagatagatagatagatagatagatagatagatgatagatagatatagctagatgatagatgtgggttcttaatttgaaaatttaatatgataaaaaacactgcattatatgaaccaaaaagtaataatgacacagccttattgtagtccttgatgccctagagaagtagctttgataccctggacctctttgcctctaactcccacattattgctacattacaaagttgaaatacaaataaatagaaatcatgacacttctattttgatatgtgttttccaccaatttgctttgaattcttcattcgcaggggaaaattctaaactcactgagtcttagaatcaataggtctgactttttgagaaagctttctaagttaaagatacccacaggcaagtatctgagctccaaaggaatgtactcttctggctcaaatattgccttgcaatgcttctgcctagtatctaagggaatagttcccctactcaataccaggcactgaaattccttcatggcccaaagcccaaaaagaagctgagaggtatggggtcaaaagcaagtggagatctggagatgaggctgatgaagcaatgctctgcaggagacccatgcgtctttgtctttgccctatggagcatggtcgtcaggaagaaggttctaggtgaaaaactgtccttcagtacttgtcacttaaaattaaatgtggcaagtcccaccaggcttttgttaaaaaacctaatgatgcatttccattttcagttttatttcttcctcctgaaccattggcatttctttaacatcaatcaggtggaggttgctgtgaactttccctgtttgaactcagtcaattctgaatttgttttctaggtagtctaattttatcattaaaaacactttagctctgaaattaaagctaagttatatcaggtttcttgggaatctgaaatgtatgccatattggcctccttaagttttatttcttaatatgaaaataaaatctcacattttaaactttaagaagagagagtacacaggctttgggaattcaacagcatctagtcacagcagcaatacttgtagcagcaaatttgtagatacaatggcatgaaagttcaactgcttattactctcattaatctttactcttacttttgctgtctttatgcctctgactgtctcgttgtcctcactggagtaatgccaagctagtatccagtttcaaagttcacatgttggcctcatttcctaaactgtaggcccttccaggatagaggccacatcctcttgtctatagctctgtagcacctagcataattcctgggacattgtaggtgatccaaaagtatttaatttttagaaatcaattttaaaagacttgccaaacctccatttaaactgcttcctggaggcaacaatgcagaattcctggtccaggtgtcagcatttacctgtgactaatctgataacggtgtgctgaccatgccttggccttctgcctgggttgggtacagtgggagtagggggacccatgaaatcttagactcctcatgacatgctgcaactgagtatttgaggggtgtaggcatagatgtccccgttttgatctcccaatggagaagtatatagcttgttatattgtcattagggatctgatgtggtctgcccacattagggtgaaggtatagctcatgtaaatggtgagaattcagtgtcattttgagtaattttaagtaattatgttacttgaacacttaacatttctgaaccttagcttcttatctgcaaaatgagtaaaataatatcttcttttctctggatttttatgtatctgatgtaaaataatacagaaacgctttgcagatcataaaatcctattcaaacataagatatcagtatcactatcttatctatagtaagcctgtgagtggtaaggcttctgaaattttctatcagagacttcagcaaaacaggtaactaggtataaattatgcaagaatttggataattttgtagtaaatttggaaataaatgcaaactccaccagttgcagaataagagcacatgttagcatttgggttacatgttgaagtgcaagtgaagtaagtactcccagaaaatgaggcaatgatagagaccaatatctgaactacctgactccagttaaaataccaataacttttttcaaagaaaaacttctaccttcaaaaccacaactgcttaccacaggatgatatgacttagaagaccataaaataagagctgatgttttgtctttatatgcaatgaaaaatgacagaattgcaatgggggcagccctaggaatcacacccctcagaaatattcaggagccccaaataatcacggatgccactaaaaacaggaaatgtcctcatataaaagatgcaacagcccctgtggcatcctcagactcactgatgcccagacgaatccttccctcatccagagtcaggcttgcagcaactgcaatcaagccttctcacaactatcccccacttccctctacttcttgcctttaacaagtgttcaacctgtccccctaccatatgaattgttttccatgaggatttcttatacttagatctctatacataaagatcaagaaattataatttgtaacaaagcatactctgcattctcaagcttagttaacagaaaacagtattgaaatatacatgccatatgaagtacttcatttgtgttgacaaagggtaatatcataaactatttaatcataaagagacttcgcttttcaggtcaagtgctgtgtagttttttttttttttttttgatatttctctacttaaaatgacagtggaattacactaactcatcaagactagaaacctagaaataaagcaaaaagctccataactttgttggaagttatctttctgcacactaaacaaattacccaaatgtttcattctttgattacaaaatcatttttcctaagtaaattttctctgagtgttaagatgtacctccaacaggagtatcaataaagtgcctaagaatctagggttctagggtttttatgtgtgattagatttctcttcttctatggccttcctgagctaaaatatagttcaggagacctgtccttgtttctgacccaaaattttcttgcattgtgaaagaatagctcagcttttctgttagccaacaatctgcagctctttcaagactgcaactctccctaggatttttttcacaggatctgaatgcaggtatacattcactctggctcttcctttttcgttattcagacattctcaaactatatattttattttattttttttgccaaaggaatgaatgaacaggtaatatagagaattataatgagacatgagatcacattcttaaatatctttgtcatctaaaataaagacagcagtctaccgcttgttttgctcaccattgtatctctggaaaatattatagactttggcacatagggagccctcattatttatcaaatgaatgaatgaatgaatggtataagaaaatggcacgtgcttaggaaaagaaaacactccacctcttgtgatcatttactgcccttatcagggaaccatgagtcacactttgggtgaactctcctcaattaagacccccaagcacatctgggaaaaattaaaatctaacattaccttattttatttattccaaaatgaagtgacagaaataggttacatatacggaaatacacaagaagcaacacattatatacagcatgtgaatataaagaatcttgatataccacctttccttaaatgcaatccttaccattcataggctctggaaaatcatagcaatgagaagattttttacttcgagcatactcactgattagctctgctgcatcccctacttccagaatgcaggcttgacatgccttcacctgcgtgctctacttagtggactccctcaagtgagccatgggcacaatcttaacattggaagaaccatggaagtgtccacatttctattacttcttcagtgctacactattttcttttggagggggagggactttcattcaagctcactaatatgaggatcctgacacataattcagtccaaacacttgctagaggcactgtatgtttttttctgattgatgtcaggttccactgaattgtaaaaacagagagagcttcccagtgcagggacaggcatcattgtcgataatggaagatgctcatgagtaaactcctgagagaaaaaacacacaacacatttagagaaaggcgagaaacatctttcagttggaggttggggtattctgtgaaagaagaattgatgtgtgaacagataggtttgggtgagaccaatctgcttttcttttttttttccttgatgtagtgaagtcatcccatatcagtgtctttgctgtttcttctttttggaatgatatttatctacattattgcatgactgattttttattttacaattacagatacaactcaaatgttctctcctcagagatccttccttgactatctatttaaattacctcctatgtcattatgaaacattagcctattctatagtcttcatagaactaatggtatttttttctttttttaaattatactttaagttttagggtacatgtgcacaacgtgcaggtttgttgcatatgtatacatgtgccatgttggtatgctgcacccattaacttgtcatttaacattaggtgtatctcctaatgctatccctcccccctcccccctccccccaccccacaacaggccccagtgtgtgatgtttcccttcctgtgtccaagtgttctcattgttcaattcccacctatgagtgagaacatgtggcatttggttttttatccttgtgacagtttgctgagaatgatggtttccagcttcatccatgtccctacaaaggacatgaactcatcattttttatggctgcatagtatgccatggtgtatatgtgccacatttccttaatccagtctatcattcttggacatttgggttggttccaagtctttgctattgtgaatagtgctgcaataaagatacatgtgcacgtatctttatagcagcatgatttataatcctttgggtatatacccagtaatgagatggctgggtcaaatggtattcccagttctagatccctgaggaatcaccacactgacttccacaatagttgaactagtttacagtcccatcaatgtgtaaaagtgttcctatttctccacatcctctccagcacctgttgttgcctgactttttaatgattgccattctaactggtgtgagatggtatcttactgtggttttgatttgcatttctctgatggccagtgatgatgagcattttttcatgtgtcttttggctgcataaatgtcttcttttgagaagtgtctgttcatatcctttgcccacttgttgaaggggttgtttgtttttttcttgtaaatttgtgggagttcattatagattctggatattagccttttgtcaggtgagtagattgcaaaaattttctcccattttgtaggctgcctgttcactctgatggtagtttcttttgctgtgcagaagctctttagtttaattagatcacatttgtcaattttggcttttgttgccattgcttttggtgttttagacatgaagtccttgcccatgcctatgtcctgaatggtattgccaaggttttcttctagggtttgtatggttttaggtctaacatttaagtctttaatccatcttgaattaatttttatataaggtgtaaggaagggatccagtttcagctttctacatatggctagccagttttcccagcaccatttattaaatagggaatcctttccccatttcttgtttttgtcaggtttgtcaaagatctgatagttgtagatgtgtggtattatttctgagggctctgttctgttccattgttctatatctctgttttggtaccagtaccatgctgttttggttaccgtagccttgtagtatagtttgaagtcaggtagcatgatgcctccatctttgttgttctggcttaggattgacttggcaatgtgggctctcttttctttccatatgaactttaaagtattttttccaattctgtgaagaaagtcattggtagcttgatggggatggcattgaatctataaattaccttgggcactatggccattttcacaatatcatactgaatgtgcaaaaactggaagtattccctttgaaaactggcacaagacagggatgccctctctcaccactcctattcaacatagtgttggaagttctggccagggcaatcaggcaggagaaggaaataaagggtatgcaattaggaaaagaggacatcaaattgtccctgtttgcagatgacatgattgtgtatctggaaaaccccatcatctcagcccaaaatctccttaagctgataaggaatttcagcaaagtttcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggaccgggacaactacaaaccacggctcaacgaaataaaagaggatacaaacaaatagaagaacattccatgctcatgtgtaggaagaatcaatattggtatttttttcttaattgttgccatctctctacgccataacgtatacactctttccattcacctccttttttttcactgctagatcagcagcacctagaatagctcttggccaagagtaactgtgtggccaccttactgatacaagtaaagggcttgtaataccaaggcatttctggtggacaaaacggatctactggaattttttcagctatgggagaacagaggtccagaattgggcctcagagaaattatgtttgtggcaacatgcagtctggaactgaaaagagagatcctgggtcagaaagactaaaaataagatgttttaaatgtatgtgtggctgtgtgggtgtttgtgtatatatatatatatatatatatatatatatatatatatatatatatatatatacacacacatacatgtaatttctatatggttttgctgatattgctttaatttttatttatttgtacaatatattagctgtttaaactataaacatgttttaagctaaagtaaatctatcctttaagacctgttaaacttgatagattatacatatttccgaactcagctattagtattgttcgttgttgctttttggtggcttaaggttatcagcacatctctgtataaatgaagacaactactaaccaaagcacctaagcattttaacccagacaatataaaaagcctcataattcagaatttactgtaattattgcagttaataaatagtaaaggctatttaaagacttcctgtcttgagatggtatgcccttgtattccaaaaacttaataagggataataataatgattaggataatgataatcacattaagatcatgaaagtatgtttaaaaagcttaaaacgagattcctgcagagatgataaaaagggttctctaagactaagttgagaattgaatttccacatagtccaattaatttcacacagaggaaaggcaaaaaaataacgattacatggatccatgccatactctcaatcctgtgtagcaaccacaacaaatcaacaatataattattcagtacctaatgtgttagatgctgatggtcacatacaatttgcaaatacatgccactggacaagtagaaaaccagatatatcagtgccaactgcaacctctggcaaatgtcagaaaaaaaagtcactctgagcaagatcatctttttttttaattcaagagttgggtgctgtttttatctcttatgacttctctatattacttgcagtaaaacttaaggaaaaattgtaataatgtgtccccacatcttatttttatcagatggccctcatctgacctccccttcaattctgcagagtatatttaaaaggcagatctgatggtaactctccactactaataaacagttagtagctctcaagaatcaactgaagaagaccaaccttctaaaccttgcttttaacattctctattgctagtgccttgcttaattctcgcttaataatgtatcagtactaactgtttatagtagagacaattgcttgcctctactcatgctgcccaaaatgcccaccttgcttattctaccttcttacttcctctgtttgctaaatcttactttatcttcaagataaagttacacatcatctccttaaggataccttccccatatcttgagccttagttaactgtctttagttgataattccatgcactctgtggatgcttctattccatttacaattgacttcattcatatccagttacatcactttacctaatttcagaatcacatctgtcgtcactttattccaaaagtgtatccattctcaccacttctttcaaatggctgaatgacaacaaaaattgatgctaaatgtaaatcaccatttaaatgttgctatgttgcttgactaggtgcaatatatagttgaaacttctgtaatttttattaaaataataaattataaaatataaagctgcagaaaactccatgttgtaaatataaacagatcaacataaatttttacaaattgaagatacccatgtaattatcacatagatcaagatattgaggtataaaatattttcggcaccacagaaacctaatcctggacctccctctcataatcattaattcctgctgaaattttgcatgatgtttaactttatataaatgaaataacacaactctgttgtatttggattaattccctcaagtttgggtttatgagatttgcccgtggcccccgtgtagaaatagtttattattttacagagctgtttagtattcccttatatgaatataatacagtttgcatattctttggttgatggttatttggtttctttacagtttgtggctagtgagaagaatcaatctctgcacatttttgtacttgtcttttggtacaaatatgtatgcatttctgctgggtatatgcctaggagtataaagtcaggtcacatgatatgcatatgttaatctttattagatactgccaaacagtttttcagaccggttatgtcaatttacagttttctttttttgtttgtttcttttttttttttgagacggagtttcactcttgttgcccaggctggagtgcaatggtgcgatcttggctcaccgcagcctctacctcccaggttcaagcaattctcctgcctcagcctcctgggtagctgggattacaggcatgcaccaccatgtctggctaattttgtatttttagtagagacagggtttctccgtgttaaggctggtctcgaactcctgacctcaggtgatctgcctgcctcggcctcccaaagtgctgggattacaggcatgagccaccgtgcctggcctgtcaatttacagttttcacaggtagtgtatgagagttccgcttgatctacatcttcaccaccagttgctgttttcagtcactgattgattgatttatgcattttattgtagtttaaatttgcaattccctgatgacaaattacgttttgtacttttttaaaactgttaatgttcacttacgtgtccttgttttaaagtccctaacaggtcttttgtccacttttaatcatgtgactaggtttttcttatagactccaggaattatatattctgcatatgaatcctttatgaaataagtgaattgcaattattttctcttactcagtggttcccattttcattcccttaatgctgtcttttaatgaatacttttgttttaatgtaaaccaacttatcaatcttttcctttgtggttagtgggggatgtgtggtgtgtttgtgtatgtgtgtgtgtttgtgtgtgtgtgtgtgtgtgtgtttcttctgaatacttctaagattttctctgttttctgctttagcggttttcctaaagtgtgcctagatcttttactttgaatttattctgcttgggtttcataagacttcttgaatatgtgcctcaatgccttttacttatttttgaaaatgattggtcagtactacataaaatcttgcttctgctgattctgctcttctcttttggaatatatatatatatatatatatatatatatatatatatatatgaatttctattcttatctgtattttccatacttttattctttaagctacagcccgaatgttttctgctggcccgtcttctagttcattaattctaactctcttgtcttgccatggtaaatacttacattaagttgttgatatcttactatccattgttggatttttctgttccagaattggaattggaattttaaaatagattctatctctgtggtaaaattattcatatatcatatattttcttgaatatcttatcatattaactttaaaacccaagacagattatcaccaaaaactgggttatttatatgtttgttactattgtctgcttttctttcagatatatttcttagactcagtaatttttttcaatttcttaaaactattaaaaagtatagatactttgcatgatttatctttccagagtaatttttagtaaagtaaaatttatttttatcctgtcttctctttggatgcctgagttagggacaaacatttttaacatccaaccatactgaattgtcttgaatgtgagttggcatttgtgtaagcctggatattctcttgttccctcactaagaatcccaactgaaaactggaatgtatatgggatcctcttccttgtcagggcctcaacaaaatttatacatcttcaacaccatgacctaatttaaagaaacaaaaaggattataagagaatactgtaagtcaacaaatttgataacttagataaaatggttaaattcctaggaggacacaaactactaaaactgatacaagaacaaatacaaaatctgaaaagacctataactagtaattagagtaaattagtaatttattttaaaatttatttttttaaattgacaaataacattgttttttaattatttacaacatttttgaaggtatatataaattgtggagtggttaaacctagctaattaacaagtacattacctcacatagtaatcatttttatgataatagcacacaacattctttttagatttttcaagaatacaatgcactatcatgaattatagtattcttgctgtacaatagttctcttgggatttaaaaacttcgcacgcacacacacacatatcaaaattcaggctttactataatctacaaatacttaaaaaagtaatacctacacttcacaaactcttccaaaaaacaagagcgaaggaaaactttctctttattctagaaggctagtgttagcctgattatcaagtcaggcaaaggtaccactagaaaggaaaactatagaccaatatgacttatgaacatagatgcaaaaattttcaataaaatatagcaacttgactccagaaacatacaaaaagagattatacaccatgaccaagtgagatatagcccaggaatgtaagactggtttaacatctgaaaatcagtgaaaatgatgtaccatgttaataaaataaaggacaaaaaatcacattatcatcatagtagaaataggagaagcattcacaaaatctaatatactttcatgataatactcaacaacttaagaatagaaggaaacttcctgaagctgataaagggcacatgaaaaaaaacccacagataacatcatacttaatggggaaaaattgaatatattcttctaaaatcgagaagaaaataaggatgtccatactgactgcttctattcaacactacactgtgattctagccagagatattaagcaagaaaataaataaaaaccatacacattggaaaagaagaagtaaaactatgtcttcatttgttttgtgtttctacaacatctgagactgagaaatttataaagaaaagaaatgtatctggctcacaattttggaggctggaaagtccagaggcatggaaccagcatctgcttgtcatctggtgagggccatattgctgtgtcattccaatgacagaagatggaagagctactgaatgcatgagacagaaagagaaagagggccaaagtcatcctttttcttatgaactcacttttatgataactaaccccctccctgataacagtaatgacattaattcattcataagggctgcccttatgatctaatccccttcttaaaggactcacctcttaatatcacaatggcaatgaaatttcaacattaatcttggaggggacattcaaaccacagcactatttttattgacagatggcatcatttggtataaagaaacttctaagaaatcacacagacacgcagacacacacacacacacactactacccctaataaaggaggatagtaagattatatgatacaagatgaacaaaatcaattgtatttctacatgctagcagtgaaaaatctgagaataaaattaaagaaacacctcatttataataatattaaaataaaaacttagaaataaaataaacataagaagtgaaagaattgtatgccaaaattatacattatttaaagaaacttaataagatcaaaaaaggaaaaacatcccatgcttatagataagaaaggtaagtttttgttttttttttttttgagacgaagttttgctcttgttgcccaggctggagtgcaatggcatgatctcagcagctcactgcaaccttcacctcccaggttcatgcaattgttctgcctcagcctcccgagtagctgggattataggtgcccacgaccgcgcacagctaatttttgtatttttagtagaaacaaggtttcaccaagttgattaagctgttctcgaactcctgacctcaggtgatccacccccctcagccgcccaaagttcttggattacaggcatgagccactgcgcccggccaagaaatcttaatagaagatggtaatactcctcaaattgatctgcagattcaatgcaatgcctatcaaaatctcaacttgcttttttgcaaaaattgacaagattattttaaattttaacactatgagcttgccaaaatctttattctgtttttcaatatctttctgcttttagcatgttagtcaccttctgcaaagtttcagaatgtcttaaatgtcctgatgggggatatacaagaataatgttcaatttgttgttcatctctactcaccaatatattcaccctcaaacttctagcaaactgggaattccaaactccatttttttatctcaccagtttcaagagattttcacatgctctactggcttttttcccccttagccttgtccctctgactcatgacccattccaaaatcaacaaattccctgaagggtaaggtaacacacagaatgctagcttacctctctgcagatttttctctccattactttaactcatgagatctcgtgtctcaggagctctccaatgccttgtttttggttttgtatgcctttcctagtttcctcagcaaaagtgatggttcaggactaatttctctgttctgaagtgaaatagagttctcaattttctttcttaaaaatgtatttcttttcagttataattctcctacttatcatcactggctatatttcagtttcctttcctagtccctcttattaacctgtacaattttactgtttcaagaatcttccctgaattttttttcttttttatgtgcatttctaagcagctttacccagtctcatggcttgaaatcctgtttatgagcaaatgtctcccaaattcttatttcccatcctgatcaccctctcaaagcctagacaactatatcaaccttctacttgttatgttcactgagagagtttacttggcatcttagtcttattaagatggaaatgagaaatctcaaattcataaatctcaaagctgttacttctaccattttactcatctcagtaaaaggcaccaaaatccactcaattgtgttagccaaaattccaggttttcttgagtgacttttctcaccttctacattgatggcatcaggttcagtaagctctcccattaaaatgtgacccagtctattcaatgtatccatctccactattactacctagtccaatccactcatatgttgcctgcattattagggtcaccagtctcattgcttctgttcttgcataaacccgtcaccaccattatcattttctcatggcaagcagagtgattttttttatatattaggtggttatatcactcttgtatttgaaaccctccaaatgcttgaaaacaggtaaaatcataaccctagttaatacacttttaaaaggttctgcctatgacttcctttttttcagtttttaccagccttgtatttgtccttccctccagccaaactcaccttcttttttttttttgaaagataattcagtagttactgcccggtacttttaaacaatttgttctttttgataaactcaacactcctccttcattaacaaacacgtgaaatataaacagtgtatacttcctttactagtatgtatgtttgtgtttttacatttattcctaaagccagcattatttttttaatagtcaaacattggaatatttccatcaattcaggaataagaaaaaaatatctattttctttacgatatttaacattgttatagaagtactggccaaataaatttcaacgtagaattaaataaaaggcacaaatattggaaaataagatttaaacagttttatttgccagaaatatgattttatacacattgaatccaagagcatcaaatagccatcagaactaaatgagaattagttatttaattggttaaagattaacatgtttaaatccacaggtttcctttctgaaaattataataatttagaaaatattatgaatagttatgacatttgcattgctaaacatatacctcaggataaagtgaacaaaaatttcaatacccatatcaggaaaaatttaaaactctactgaagtgtaccaaaggcatcttgaggaaattgagaggcatgcttttcttaggcagaaagagcaatatgattacgtcaattatttataaagcagtcacggctgggcgcggtggctcatgcctgtaatcccagcactttgggaggccgaggcgggtggatgatctgaggttgagaccagcctggccaacatggcgaaaccccgtctctactgaaaatccaaaaatttagccgggcttggcggcaggcgcctgtaatccctgctacttgggaagctgaggcaggagaatcgcttgaacctgagaggcggaggctgtagtgagctgagatctgccactgcactccagcctgggcgacaaaagccaaactccagatcaaaaaaatcaatcaatcaatcaataaaattaaaaaaataaagcagtcacacacacacacacaaatgtaaaatgtactttgaaagaaatctggtaatgaatgtgggaatgaagaggatattgtagccctgtttttaaaatatatgaaatgaaacttcacaatattaatgtttggtactagaaaacaagtcaggtttatggtataacccaaaattataagactgtctagcacataagtgtgatagagtttcatagcagtggaaaaagtagacactgtttaacaaacttttgttaggaactactttgctgcttaatataaggacgtattcctaatacccttcttgtaggtattttaaacaaaacatatgagtgaacctaacattaaaatagagttttcgtatcataatttaatagccagaaggcaaaaagtaaaaaaacaacaaaaaagactgatgatagatactattataaatattgctagtaggattgtaaataaccttctgtaaagaaaatgtaacactctctgtcataacttaaatgtgcatatactttgacccagaagttccgcttcagggaatttttctcattcatatcctaatgtgaatgaaaaggttgtgaacaaggttttacactgaaataacataactgaacataagtaatgaaattatttattataaagttgtataatgagattaaatattacactgtcatcaaaaataatgaaatagaactctgggtacagaaaaacagagagtattttttaataagtgaaacaaggcaagttgtcggagtatatgatagagatgctatatatattaatatgaatacagattacgaatatgcctatgagtgattgtttatgaatattcatgaaatatacactccatattgatagcaaatgccatcttggcagcatttcattcatttagttattctctaacactctatggatttaaagcttcatatcttcatttttatacttcatttttatatgatgtatgattttatgtcaacccaaactcatgctttaaaataattgccttgattgtatgtacatatttattcttccaattaactttataattagcttgtgaagtatcacagaaattatgttgggagagccgggagcagtggctcatgtctgtaatctcagtactttcagaggctgaggctggcggatcacctgaggtccggagttcaagactaggttggccagcatggtgaaaccctgtctctactaaaaataaaaaaaattagccaggcgtattggcatgggcctgtgatcccagctacttgggaagctgaggcgggagaatcgcttgaacctgggaggcggaggttgcagtgagccgagatcgagccactgcactgcactccagcctgggtgacagagggagactctgtctcaaaaaaaaaaaaagaaaagaaaagaaaagaaattatgttgggaatttgaaaggtattattttggagatatagcgtgacttaaaggaaattgatatctgtatagagctgaatctttcatcctcacaatagcgtagctgtagagttcaaagtttttctgtgtttttataaatctttgtagattgtcttcagaataatcttgcaccactttttgtcatgatattcctaaacacattagtttcttttgttattatgacatgtaataattttctactgcaagttttaattggttactgctcttctatataaacataatggaattttattgttgatcatgtatgtagtaatcttgttgaattttattactttatttcttgaatttgcttattttctttacttagagttgaagaaataaatcatacattttattttgttcaatttttgtctcttttggtcttagggctttggttaaaaaaaataccctgtaaaatcaattggttagtcatctatctaattttttgctctaacattcatataggacaatagttacctttatcttgaaaatgtttataaagatatttcaacttttgatcatttgtatgtgtgtgtgtgaatgttgagtagtatataactttgaatgatattttaaatgtttttgatgatttttagtattaagtccctagaagtttgtccactttatctaggttttcaatttaaacggtacaattatactggtattgcactcctataatttttgttctttaatctaccaatgtttaattacttttttctttttaatcactcctggtgtctttttatttctctctttgattaaattacaaattttctaagttgttattcttttcaaataaccacttataattttctccataattttctgctcttttgaaaaattatttctaactttgtttcccttgattcaggaaacatttcttaatttgagcttttagttctctaatttatttttttaactctatataatctgctcttcatctagttgttttgttttcaattcaacaattaaattcttaatttattatatctctaatttgttttattttattgtcctcagtttttgtttcatagcatcttgtttttacttaacagtgctgattcctttcattgcttcatataatcaatttaaagtgcttttctgttttactagtaactaccttttttctatgtaagatctccttattgttgtggttctgtcatattggtctttctcagatgctctttctctcaatttctacgaacccgatctggcctgtctttgggaagctgcatctgtttcttctgtggctatagtggagtgacctgcagtggttggactattcagtgttcccccgtgggactgtgcagccttttgaaatagccttgtctatggcaagcacttggcttacccatgcaatatcacttgtcaggcatgccttacagcttcagtccactgtgaattcctcttcctcttcaggagcttgcctgtatatcacttagcttaatgtttatctgggctttttcaggttacatgcaggtgagggagatttcagcatgagttcactatctggtaagatgaatttaccatatcacttttgtaataaaaatattttaagcttaaaatatctacacagtgcctggaatatattaatttccttgtaaatgtctgttgaactgaaataaatattatagtttcaaataattaaatttgataagcatagaatttgatgcttgatccaatttatctttttcaaaatcaaacaatcctttactactgtcaatttccagacaatacacactcttataataatataatgccatttagtttactgaatgacagagtatgccagagtacagcttcctagccataaaatctggatctatcacatgctcttttcatagaaattctaatatttttctattatcagtttcacaattcatctattttttacacgaaaaaacatataacattttagtgtgtcttttttcattgactatcctcaaatcataatcatatattgcaaattaaaaattggcctttacttgacagaggggagaaatattttctttgctcataccttttatggtatgacctaaaaagttatagatgtccatgctcggaaactcactcttacttgacaactttttccaatgattacactttacttccctcttgctccataagttccacaataacctttgctcaaaagtaatggaatgtaacctgaagatataaagaagtttgcttttgagataaactctgaagttagctttctacaaaagtaggcacaccttaaagcatctgaacaattcagtattatcatatattgggctgtctcaaagaaagggagattttcatattcttctcatatatagaatgttatctcccaaagtttgaaccatagagagaccatatgctaagaaaaatgtcaatcccttttaagaaccttgtagaaatgctttatagacctggcaaagtactttgaactctcaagctagttgtattatttttcttctatttatacgtatttatttatttatttatttatttatttatttatttattcattcatttattgagatgcagttttgctctgttgcctaggttggagtgcagtggtgcgatcttggcccactgcaacctctgccttctgggttcaagcgattctcctgcctcagcttcccaaatagctgggattacaaacatgtgccaccacgcgtggctaatttttgtatttttagtagaaacagggtttcactatgttagccaggctggtttcgaactcctgacctcagatgatccacccgcctcggactcccaaagtggtgagattacagccctgagccaccacacccagccagttgtattcttcatacttcagggctcaggtttcctctaaatgctctgtgttccctaaaatacttgccacaacctcatggccaatgtgtccatagaatgattttgtatgatacaataccttcctaaaagtacacgttacttaaaaacaacatagagcagctcagggcaatagagtaataacgcagttaaatgttaacattatctgttattttgattcatttttatgccagataaaccacatcagagagatgttgcttcaattttagatttgcaactattttcctttcctctgttcccatagtttatgtggaaaatttattgatttcagattactttccctaccactgacaagcttaattctttaaatttaatttaatttttcatttccatagtttttagtgtacaggtggtttttcggttacatagataagttctttagtggcgatttctgggattttggtgcaacatatcatctgagcattgtacactgtacccaatgtgtagtcttttattcctcaaccccctcctacccttcccctccaagtctccaaagtccactatatcattcttatggctttgtatcctcacagattagcttcctcttataagtgagaacatatatgatatttgcttttccattcctcagttacttcacttagaataatgtcctccagctccatccaggttgctgcaaaaaacattattttgttcctttctatgactaagtagtactccatgggctatatatatatatatatatatatatacacacacacacacacacacacacgcacacatatatatacatacacacacacacacacacacacacacacacatatatctatctcacattttattccactcgctagttaatgggcacttaggttggttccatatttttccaactgtgaatcatgctgctataaacgtgtgtgtgtgtatctttttcatataatgatttttttaatccttaggcagatacccagcagtgggattgctggattgaatggtagtactactgttagttatagaaggtactccatactgttttccacagtggttgtagtagtttacattctcaccagcagtataaaagtgttcccttttcaccacatccacaccaacatctattattttttgactttttaattatggctattcttgcaggagtaaggtagtatctcattgtggttttaatttgtatttctctgataattagtgatactgagcattttttcatgtgtttgttggctattgtatatcctcttttgagaattgtctattcatgtcctttgcccactctttcatgggattacttgtctttttcttgctgatctgtttgagttcctgtagattctggatattaatcctttgttagatgcagtttgtgaatattttctcccactctgtaggttttctgtttaccctgctgattatttcttttgctgcactgaagctttccagtttaattagttcccatttatttatttttatttttattgcatttgcttttgggttattgttcatgaattctttgcctaagccaatgtctagaagagtttttctgatgttatcgtctagaatatttatggttttgggtcttagatttgagtctttgatccagctgtagctgatttttatattagttaagagatgagaatccagtttcattcttctacatgtggcttgcctgtttcccagccccatttgttgaacaggatatccttttcccgacttatgtttttgcaggctttgtcaaagatcagtgggctgtaagtatttggatttttttaattgattctctgttctgttccattggccttcatgcctatttctataccagtaccatgctgttttggtaactatagccttgtagtgtgaagtcagttaatttaatgcctccaaatttgttctttttgcttagaattgctttagttatgcaggctgtcaatatccctgatgaacatggatacaaaaatcctcaacaaaatactagctaactgaatccaacagcatatcaaaaggataatacatcattattaagtgggtttcataccaggaatgcagggatggtttagcatatacaagtcaataattgtgtttatgtgacatatcacataaacaaaattataaacaaaaatcattatcatctcaatagaagcagaaaaataacttgataaaatccagcatctttttatgataaagaccctcaacaaaataggaatagaagggacattcctgaaagtaataaaagccatctgtgacaaacccacagccaagataatactgaatgggggaaagttgaaagcatttcccttagaactggaataagacaaggatgcccactttcaccacttctattcaacatagtactggaagtcctggcgagagcaatcagacaagagagagaaataaagggcatccacattggaaaagaggaaatgaaactgtcactgttcaccaatgatatgattgtatacctagaaaactcaaaagattcatccgaaaagctcctagatctgataaacaaattcagtaaagtctcagggtacaaaaccaatgcacacaaacaagtagcactgctttataccaacagtgacaaagctgagtatcaaatcgagaaatctatccattttacaaaggctgcaaaaacaaacaaacaaacaaacttagtaccatacttagccaaggatgtaaaaaatctgtacaagaaaacctatgaaacatggctgaaagaaatcacagatgccacaaatatagaggggtagaatcaatattgtgaaaatgaccagaaaataacttcctttagcatttcttacaggacaagtctagtactgatgaacatccttagcttttgttttgtggtaagttttttatatctcctattttttttttaagaatgattttgtcaggtataatattcttggttggaggttttttcttttagcactttgaatataccatcacactcctttctggcctgcaaggtttctgcttagaaatccactgactttacaccctgcttttccaggaaacattagtataaatctgtctagttattcatattaaattttctaaaaatataaaatgatattttttctcaacatttataattttagcattaactaacattcaccactaagtactgtatttggccttgagagttgagttaaatattttgttgggcaagaatcagaggtgaggtataaaacacattgttgtgctaaaaggaccatgcagattatccaacaaagtttttcattgctaaaatattacatcataacctgtataaatgatccatgataataatactaatattttacatttattacacatttgccaggttctatgccaaatgtttatgttattattttactaatacttggggcaatcctataaagtaagtactattgttatcccattttatagatgataaaactgtggcttatagaggctatcaggatctgtctgaaaacaaataagaagttgctgaagagaggtgaaggaaggtgttaaaggaaccaacaaggtacaagactaggaacagtaaaaagttatcatacctctaggcttgagtgacaaggagaaacaagattatctgaaatcagttaagagccgaaatggtgtaaaaagcaatatgtttctgaaagtacagttaccatcaaacaagaaccctaggtttcagattcccaggcaacttatcttttcactacagcccaagggcagagcttcaagaagtatccagtttagttatggtcattttctctgggtttagcaccttgcttttcccgcagaaaagtagggtctgaagcactaactgcaataggagtatagcagttaagcactgggttccggtgagcgtcacttgcttatgaaaatcagatacaccatctcaaaggctgttcattcttagaggcccttggagaggagcaggaatgcaaatcaaagaaaagcatgatagcttgaaatgagaagcagaaatagcctggtaaacattccacagtggaatgtttataagaaccatcttataagaaccatcaatacgtgtcttctaacaaattgacttgatacactttattgcgctctacacaatgctgaacacttctgaaaccttttctagagcctgtatttctagaggctatgttttctagagttgtgggccaacatgcctatgtcaagaggaagggaagtaaaaaatgtgaggttctgaaaagcctgtttattagttaaagaaatagagatctttatccaagaagagaaaaaaaaaatcagtggagtcaagtagtataaaaaaatccataattgccatgggaaaaactggggcttaaatgagaaaaaataaataaattaaaaaacgacttagttttatgttaaaaaacatggctctaattataattcaaaatgctaaattctgtctaaaaacaaaatggattgtcttgcaaggtgatgaattcctcatcccaggaagtatttcagcaggatgtcatgaaagggcttcctatattcaaatatcttacaagattatctcaaaaatacttttgaagtacatgtaagattctgggcaatgtcacaaaagtataatctttagaacgttgcaggcctctgtatgatctcttatcttgcaaggaaacatttgcctagacagttcagctggctgaaaatgagtttctaaaagtttccagaaaagaaattttaaaaatatgctttcttctaaattatattgttatgaattctaagtaaataccaaaaaacttcaataggactttgccaaaatttatattgcttttattgttctattttcatttgattagctctctgcagtgtacatcaaccctttagccagaatgcagagacaatgagaaatttaacatttttctcccattaacattctatcattagggctgagcaagttaaatttccactggttcagtgtgctctgcataagatagcagaaatcttccacattgagggagttcttcagggtacaggatatcatatcactaatgtattatctgctgaatgtagtcttcattttggagtataatgagagaataaacgattgtctgggcttggagtagatgacacatatgggattttgcttgaacaaaaggaattacaatcacctaatggttggaaggagttctaaatatctacagatcagatatttcttctaagatgaaattgctacttacagttaaccagataatttctcagtttgaattgtgggtcattgagggtcaagggcagcagccgtacagccacagataatagctaagtcttgctaaatatcagcaccctctgaaatcctactaaaacgtgtccaatgggaaataagttattttctgccgttctgattagcagtcatctctttttcccatgtgttcttggggaaaaaatttattttctgcctttctgattagcagtcatctctttttcccatgtgttctttaagtgtccagaaactctagggtctctttccccttctcctgttaaaatctttctaaagaagaaagctgagagactcatacaactcatagtgatctcaggtacatttgtattttaaaagcacttaattttattttgttgctcttaaaacttgtatttaccttatcttagctactgtatcaccataggaatagttcaataagacaaatgatgctattattttagtgatgtatacactacaataagataaatacaaacttgagttgtacatgctataacctagcacatctgcaaacatatatacacgcatatacacattcagtcaaaaagagaatccagaaagcactcattttactttattttaacccacagaatacaaacctaaatgactaagactacaaaaggccatttaaggtgctggtcagaaggccccacaggacagtagctatgtaactagaatattcttaaccccacttgtgcctttgcatcagctgaagtatttcccaggttaacaaaatacagaatattagtgtttgaggcaatcatagcaaatttgttcaagtctctcaacctggagataaaaatgcaaaacaaaataaaacacaacaacagcaacaaaaccctgagactcaaaaagatgtaggaattgattgtcacaaaacaactgtccagtgtcaaaatcaaaatgaaaactcagatttttcctacttgtagtcttcaaaatatttatataccccttcattcattctttgatattctgcatttttatgtaatatcttgaagttatgtggatattctttttatgtgagaaatttaagtgaagatgtgatttttaaagtagaattatggtaatattatatataaaaatgtattttttaaggaaaatattttgatgagtgcatacgtgtgtgtgtgtgtgtgtgtgtgtgtgtgtgtgtgttggcaggagcaagaaattaatgtttcagagtaaagatgtgtttttatgctattaagtacaactcaagtgtgtatttatcatatcataatgtataaatcactaaaataagtgactacctttgttttattgtcttttgtcttattgagctatgcctatggtaatacaataactaagataaggtaaacacaagttttaataggacttgctataatctagcatatttgcatatgtatagccacacatatatatatattttcaatcaaagagagaatccaaaaagcaactatgtaaacataatttaaccagaatatgaaatcattctcaaaaattagatatttttccaatatttcaaccacatttaacaactttgtaaaatattgaaaatactgacttagtagaaaaactttcttccatcaattctatatattcatcaaaatacaacactgtcattctccaaaattttatcagtacttctataattcatgtcagtgacaacttgtcattaaaagctgtttttaataaactatcaaaagcactacaaggggagagggggttgtaaagaaataaaaataaaaaagcttaaaattgagttgatgcaaaattagattatccccctaaaaaatataatgcaaatcatcattgataacttgattataggcaggaagtacattatagtctttgcatctcaaaatcagaagctgtcaaatgatgcttgtgggttgatattattttgaagttatattgtgattattagacacattctcaaatatttgtttgtaatttatctttatttgcaaaataataaccaggcatgaaagttgaaatttaaaaagtgtccagaaaatgaaaatagaggaaagcattaaagctgctgcctatgattaatttctttctcatttctctgggaaagaaaaaaaaaaagcagatgactcagattaatttccttataaatttgatggtaattggacttcctgatatatagactatttgtgtttgctaagagaagagcctttatctatagaaaggttttattaagagaatcctggattaagattgcttatagtaaacaaatatagaacctgtggattcagcaggcatgactccatggaaaatgtctgatatggtttggctctgtattcccacccaaatctcatcttgtagctcatcttgtaatccccatgtgttgtggagggacccagtggcagatgattgaatcatgagggcgggtctttcctgtgttgttctggtgatagtgaatgggtctcacgagatctgatggttttaaaaacaggagcttctctgtataagctctctctttgcctgctgccatccatgtaagatgtaacttgctcctccttgccttctgctataattgtgaggcctcccaagccatgtgaaactgtaaatccaataaacctccttcttttgtaaattagccagtctcaggtttgtctttatcagtggtgagaaaacaaactaatacaatcaattggtactagaagtggagtgcctttgataagatacctgaaaatatagaaacgactttggaactgagtaacaagcagaggttggaagagtttggaggtctcagaagaagacaagaaaatgtgggactgtttggaacatcctagagacttgctgaatggctttgcccaaaatgcagattagcaaaatggacaataaagtccaggctgagttggtctcagatggaaatgagaaacttgatgggaactgaagcaaaggtgactcttgttatgttttagcaaagagactggtgacattttgcccctgccctagagatttgtggaactttgaacttgagagagatgatttagggtatctggtggaagaaatttctaagcagcaaagcattcaagagatgacttgggtgctattaaaggcattgagtttcaaaagaaaaacagaacataaaagtttggaaaatttgcagcctgacaatgcaatagaaaagcaaatcccattttctgaggcaaaaatccaagcctgcttcagaaatttgcataagtaacaagaagtggaatgttaatccccaagacaatggggaatatgtctccagggcatgtcagggacctttgaggcagctcctcgtatcacaggcccagaggcctaggaggaaaaagtgtttttgtgggccatgcccagggtccctatgatgtgtgcagcctagggacttggtgctctgtgtcccagcctctccagccagtagctgaaaggggccaatgtagagctcaggtcatggcttcaaagggtgcaagcctcaagccttggaggcttccacatggtcttgagcctgcaagtgcacagaagtcaagaattaaggtttgggaacctctgacaagatttcagaggatatatggaaacacctggatgcctgggcagcagtttgctgtaggagcaggctcctcatggagactctctgctaggtcagtgcagaagggaaatgtgaagtggcagccaccacagagtccctactggggcaccgcctagtgaagctgtgagaagagggccaccattctccagatcccagaatggtagatctactgacagcttacaccatgcacctggaaaagccgcagacactcaatgccagcccaagaaagtagctgggagggaggctgtgcactgcaaagccacaggggtagagctgcgcaagactatgggaacccacttcatgcatcagtgtgacctggatatgagacctggagtcaaaggagatcattttggacctttaagatttgacagccccactggattatggacttgcatagggcttgtagcccctttgttttgcccaatttctcccacttggaatggctgtatttacccaatgcctgtaccctcattgtatctaggaagtaactaacttgcttttaattttataggctcatatgtggaagggaattgccttgtctctaatgagactttggactgtggacttttgagttaatgctgaaatgagttgatactttgggggactgtgggtatgacatgattggttttgaaatatgaggatatgagatttgggagaggctgggcagaattatttggtttgactctatgtcctcacccaaatctcatcttgtagctcccataatccccatgtgttgtgggatggacacagtgggagatgattgaatcatgagtgcaggtgtttctcgtgctgttcttgtgatagtgaatgggtctcacaagatctgatggtttttaaattgggagtttctctgtacaagctctctctttgcctgctaccatccatgtaagatgtgacttgctcctccttgccttccaccatgattgtgaggccttccaagctatgtggaactataagtccaataaacctctttcttttgtaaattggccagtcttgggtatgtttttatcagcagcatgaaaatggactaatacaatgtcatataagctgtgtagctatctaactataaaatgaatatgtcttataacttaaacactccttactccatgagttagctcacatagttcaatagagactaaatgtaatattctggcccagagtataggcctgatatgacaaagatttgggaggctatccttgatgtctcaaacctccctttgctttgcttgtgtgtcttgatagaatgtatccttgaattatgtagcaaatcaaaattctgacattaccttaccttattcatgtgaatctgatttgataatatgatctttgtgattgcttgatcatctgtttatatcctgcctcttagaacattgtcagtatcaaatgttctcccaaactcagtcttatcaccacaattttcttgacaaatatcatggcaccacaagacgtcccaaattcccacatcattcccttccagattctcttcccaatagggctccagtattaccttatctgcttttattccatacccctcctgagatttctaatgcttctactgtgcccttagtactcggaggatataatcagcataatgctatgtttctctgacattttttttttctgaatgattttcacagtaactttttttaactgtaacctgattttcttctgaggcactacccactgaaaaaaaaattttcacatggaagctgttttatctttcacatattctgtctcactgagcccaaagatagatgtctatcttgcttctcatttcttttcatctcattttatctctatcatcccgtaactctcacactgactacccactttggcacaatttcctacaaaactttgacaattcattccttggtgactttagctgtcactcattataatgtgatgatttgtcacagttagctgttcctagcagacatacattgctatgaatagttttatttattcatctggaaaaattgtaagtgtcatgagatccaaagaataaccacttctttagaatccaaaccctctaacatcaaagatacttgcacccttttctccaaatcttttccacatttttagaaaatatttccaataacttggtcttccagttccttgtcctcctgttctccaatggccttgacttctggtctatctcagccactcattcctatctttataccataacatttaatgcctattttttttagaactctgaagtgtctattattatttataaatcttttatatagatatagacacagaaaaaaacacaaatctatagatacagacataaatagaatttgaggaaacttcttgaggacctcctctctcattggccaccaacaaaattaggcatttctaacagagattggcaatgtttatatagccttttgtagataacaaggtgattcttcagacattcccatacaattgatacaaaatgatttctcctctgctgatttttatttccatatgcaatggcattcattttaagaaatgttttttgaagattcaatactaacccttgattttttagcataactttggtacctgataataacttttaaattatccacttattattttttgtacctgccacgtattaaacgtgtatctgaaggagacagagaccagtgatgtgtttaaaatagcagagacactgaagaagtgattatgtgatctaaatagacagggattgagaagcagaaggatgatcaggggaaataactaatatttattgtttattaaagtagaatttaccttcatcagaatgtacaggtattaactgtttatctcaaggagttttacaatcatatacacccatgtggccactacccaaagcaagatatagaacattttcatgatttaagagagggttctcattcttatttttagttcatccttcacagaaaattcccttcctgacttgtatcatcactgctccttttgcctttgtttggactacatagggatggagttcatatcttttcacgcaaaagatattgagagaaattctaatcttataaggggaaatatgaatacttattatttaaaaaataagcaggaagataaattctcaaccagtaagaattacgtttaaaatagaaagaagctgtgtgtttacaagtaaagcatgtataatagatgacaatttctctttctcacacacacaaacacacacacacaaactcacgtaaatacacaatattataaagacaatggaaatgaatagagccttaaactgtagtaaaagttggatgggctatggttgaagaaaggaagctcagacagcaatcagggaatttcagggaaacataatcatcagtgatttgtaaagattaggctgtagagaaagcctgagaagctatttttaaaataagccttataacatcactaatcagcagtagtgactggccaaaatatcagcatcgcactgtagtttctcacctaaatgttgatttcacattgattcaaaaggttttgtttttaaagagaaaatattactgcactccattctgacgtggtttgctagtatatggatcaggaaaagaatgcatacattaagaacagtaaaataccctctattgaatcacattattatatttatccttgattgtaactattttatcccctgcagtatacccattagaaacaaaatgggtgtcctaaacacatactgtcctcttcactgtgggttaatgccctatattagtcttaaggtttttgcataatatgatagcacaacaaccaatcgaatgtgtacttttctagaatatgtgcagtttatttcctaattatatccgttgctattcccggtctcacctgcagtccctggacctttttgaaacaagtgaaggacattattgttggttatagcacctgaaataagtgattcccgcagattggtcttcctctttcagtaagagagatctcttttaaaaagagatatcaaagcaaagcctaatgggacatttttcgttgtcctaactctgcttggcatatccagtgttagacatttcccaagaaattgaactgatgccactctgactctcctggaatcagtgctcaaaaaagcaaccaaccagcaagttcttgtaaagcacgcttcagtccgcatcactcctcagttcataaccttttagtgggtaaaaacaaggtccttttcttattaaattgcttctattaatgttgatttcttattaatttgtatgttatttttatgtattttgaatactaattctccttcaataaaaaacattttaaaatatattctccaagtttgtggcttacggtattttcaaatcattttaatgtagtcaagttggtgaatgatctgttttagagtttgatattttgtaggtctaattttttagttctttctctattctaatatttaagtatatattctatatttgtttccttacactttgaagttttgtcattcatatttaagtctttaattcaattgcattttttaaagtgttatataaaatcaaaaacggatgccaccttttatattgttaaaattgtctcagaaccatttattaaatagtcatttccccactgatgcccattgttaatacatcagagtctcttgtcatttatcatttctattagcttttgactccactgccaccttcccaatgaggactttacttattttcctataattatactctacccttcacacaatcacagataagctttctatgtacctttcttggataatttttctctgtagcaattatcactactgatgtattatatgttttagttattcatctcattgatttattttccctcagctataccacatctccataagaatagagttttatttgctctattgttgctgtatcactaaactttcaaacaaaattagaatacaataagtgctaaaaacatattaactcatgaaatttatagtctgtatgttttttgccattcctatacaaaatgtcttaattattattttacaatgtgtcaatattttgtatctcaatctattcacctggtcttcttcactgagagtatcttggaactgggttaaatttacttgcacagctataaaaaataccctatttagggggatgttaaatcagcataccaatttgggagaaactgaaaattttttacattgagacttcttttccacaaatattgtttatctctttagttgtgtaggtcttatttaattgcctttaagaatatttgtaattttgtatatacaattcttgcatacattttgctagtgtgtttcttaagttcattttgtatttgttgctgttgtaaatgataatttttatttatttatttatttttgagatggagtttcactcttgttgcccaggctggagtgaaatggcgcgatctctgctcacagcaacctctgcctccccggttcaagcgattctcttgcctcagcctcccaagtagctgggattacaggcatgcgccaccacgtccagctaattttgtgtttttagtagagacggggtttctccatgttggtcaggctggtctcaaactcccaacctcaggtgatccgcctgcctctgccccccaaaatgctggggcctaaatttttttatagaggttaaattaggtttttaaaatacagactgaaaaatgagttttattttctatttcaaacacagatgtactttgtctcttcttgtgtattcttttgtcttaatatgatggtgaatacctctaataagttgttgaatgaaaaccataagtcagttttatctttctccttattttaacaatagcatttacaaattcaccactgaagttatatttgttgtaggagttttcctgggggtattctttttcagattaaaattttttatttgacttatttacttcatatttttattaaaaaagaatattttaaaactctattaatgtgttatttagactgttattgtgacttccatttttatgttctgtagacagcattataatgctagaataagacttaagtcataatattgtagtatacttttgtatattacttgttaatctttaaataatttttatgtatattcttacatatatattatgtatgtataataaaaacagtctttattagtcttttctcatttggctttgagtttggtgttaaagataaaaatatcccataaaataaattaggaggggtttttgtttattttttcctggaatagcttatgtatattttgacatatgtattacattatgttactatatattgaactcactctaaaaaccatctcagtctgaaattttcccctacagaagaattaccaattgctgtttcaattttgttaataattttaggactatttagtctttttgtttctcctgattcaattttggttaatgtggtttcaggaattgttcattatttctaatttttaaaaggatatatgttttttcttttaatcatctatgggaacattgtatatattgcattttacttttagctttttattatgtaaaaataagacatccacaaacgtagataaaatactgtcacaaactcccatgtatacacatctatcagtttatgtgcattgcatcaataaataaataattctacagaaattaaagttaattaactagaacaacttatatgaatagctatgattctcgaaagagttgtataacagatgcaaattcccagatgtgtatgatagaacatcatttaagtttagatgtaataatttatagctaatatttaagaaaatatatcacaaaaatattgctataggctagttttaatactactgctcaattctgcgataatttcactgttatcccttccaaaactgttcttatgttttattatgtcctcacagtctgcagcaacttgtatggcattttagttctgatgtcttccttttcaaattgctggcagagggcacctagtttctggttttagggttcacacagggcattatctcccaaaaagttcaatccaatgtcttttcagtactaggagggatttaaaccttagagttcaaattccctctagaaataaaaagaagggatttaacatttagagtttgatatgagatggaatgacaaggcatggcgttgcgaataatttgggcggagctataattctacttcactgtttatgaatagaaaacactattttagatgactgaccaatttttttaaaaaccatacctattattttcttctcctcgcaacatcatgttagggtaagagtggtgctggtttttttttgtcttttttttctctcctttctaagatttgttctttgttaaaagagacagaaatgccatgcttcagtattattcagaggcaatatatattatatattccatagtttggaatttatcaatatttagttgcatctaatatttccttgaagcaagttggaattttccacttagcaatttttatgtaagattcagatcataagtgcacatactggaacatgagttaaagatgggatgaggaaggatgagattgttgttatcctagaaactagttgatagcgtttgcctgtgtccacacccaaatctcatcttgaattataacccctacaatttccatgtgttatcagagggccaggtgggaggtgattgaattatgggggcaggtctttcctgcactgttctctggatagtgaatgagtctcacgagatctgacgactttaaaatgggagtttccctacacaagctctcatttattgcctgccgccatccacataagatgtgacttgctcctccttgccttctgccatgattgtgaggcttccccagccatgtggatccgtaagttcaattaaacgtctctcttttgtaaattgcctagtcttgggtatgtctttatcagcagcatgaaaatggaatattacactaataatagttaagtaaagaatttagaatttgaaagttaagtaagtaatttagacgttaccatattgggaagtaaaatggaaacattaacttcactttacaattgtttttttcaactatatggcatgttagatacaagacaaaaaaaaaaacgagaaagcaaacactaggacccatctaacaccaactaattcagaatcgctgagggctgggctcaggtgttggtaattttaaaattatctcctaagttacaaggagtgagtgttgaaatactcaccagaaaagtatttaaaatcaaatgttaataagcaacactattagatggtaattaacatattaaatgtgcaggctttaattatatatgtgtgtgtgtgtatataatatatatttggatttagaccctctatatttcatagctaattaaaataattattatgttccaatatttacttcctataatgggtctttaaatgtattcagaaataaccaaactatcattttagtttttaattgtttaaaattggggaaaaaaatctttgagactaaaggatatgcaattaaactcactagccagtgtacaatttccatggaaaataaaactaaatgttctgaacatcacaatattcatcaaggaggaaaaaaaagccctttgctatgggcttttgtatggttaaatttttagaatatttataaaaataatccatataaaaaagacattatttaaaatatagcaagaaaggaagatgctctggaaaataggatctgtatcatttcagttaataaaacaaaatatgatgactcaagagacataaaggaaaacaatatgaagatgacttttgagcatcaggtttagagaatatgtttatgtaagaactccatttcaaaagacaactctttttctttaggaaaatttatagacggtctttttgaatgtcaaatgtgacagatgcccatcctcatagctagaatgaaggataaagagatagttgagttacaatgattaaagttggggaatttttagcttcttgggacaacccggtagactcatgggggaaaaaaaagcctcaacaacatggtagatcgccagcaacagtctgagaagggaagaaggactcttgtaggatttgatttgcctttgaagagaggcaagggaataactacgtaggagtgggaagagggtatcaggccaagaaggagccagggttttataaacccacagtttggagtcttgatccatttcattttattttaaattttaaaaagagtgtgaccccatgtgtatgaattacacacacctaacaagcccttctagatagtccaaaaataaacttcatgaataccaaaactataaatccaggattctcaaattagggcacttaagaatagactccagtgtggtgtgagaagagatggagttagaagaaggataaatagtcttaaaatagggtacacagactatgggttacactaaaacttttcaaagaacaacatagccataaatattaagataattaatcagtggattctaatttccatttttactccttcctaaaagatatagctacagtccaggtctcttgttcattttccatttccctttctcttttcaaaattactcttctctcactttacaaaagaaaggcacatttgtccagcctgccagaactttttagcactcttcaagttttcagtgttgctcagcagtggagtgcacaaaattctcgggaacaaagggacaattctaattattagtgttgaggggcctccttcaatcaagacaacaaaaacctttagtgtgttttgtatctttctatgctttttacatatttttgttcaggacaatggatggtattagcgataggatattttggcctgtgtaagtgcgataccatggagtttgtccccgcaaacttcatgttaaactttggtcctcaatgttgaaggtgggacctaatgggaggtgtttcggctcatggggacagccattccctcatgaacggcttggtgccatccttgcagtaatgagttctctttttattagttcccaagaaagttgatttttaaaaagaatctgccacctccccccgcttcttacatcctctctcatgtgaactctgcacatcccagctctccctttcctgctaccacaagtggaagcagcctgcagccttcatcagaagcagatgctggtgccgtgcttcttgtacagcccgcaaagctgtaggcctagtaaatcccttctctataaattactcaacctcagttattcctttatagaaacgctaaatagactaagacagttggataatctgaattcatgaatattgtagagcatggtggtagaattaaggaaaaattccctttaatgtctttccctctactcttcaataactattgtcaaatagtacattattcctgaagaacagttatttgagaattttggcaaaagtttttttttaatgctatgaatccatctccttctaaaaatattacttacaaaatttctgaaatctacgaaaaagctattaatttttaattataaaacattaatattagtaaaagtgtaagtaaagctagaaatctcatttagccaccaacattatcttgggagccttttaaattagcttttcccagtgtgaaagctaggacttagtgtaggaaaaattataatatctgttgcactattgatagtttaaaaatattagatgcaaagtctatcatggaaattaaattggtatcctgtgaatacagaactatactttacagatatcagaaaacaggagagaacattgttcaatacattttgtcaaaacttgctgtaaataaagagtacaatttgagtgatgaggtccagggatgtttccaatctctatctattaaaattggatattcatatgtattttaaagaaaatcttcattaatgactatgtgtgatgtgcaattcttgtcaaataatattatcctataaacatatgtccagaacactatcactgttgtttgagtagattctggctggatgggcagtgatcaggcacaagaatggtttactgttcatccttccactttaaaaattaccttatttgaggaatgctatttttaaaataatctctttaaattatgtgtcaactgtatacattggtcagtattgaaaaaacagaaattcaaatatcttaaaatagtagattatagcaatgtaagaatctgagtagatatgaagaaatgtatgtgctgatgttttaaattaggcattcatgaggagctagtaaagtacaacagaaatagtcaatctggaaattgtggaatgtagttggaagctttagtaagacatgagttttacatttatgaagagtaaagtaagtatagcctgggtgtggtggctcatgcctttaatcccagcactttgggaggccaaggtgggtggatcacttgaagtcaggggtttgagaccagcctcgccaacatggtgaaatgctttctctactaatgcaaaaatatgccgggcatggtggtgcacacctgtaatcccagctactcaggacactgaggcaggagaatcacttgaacctcagaggtggagattgcagtgaactgagatcacaccactgcactccagcccaggacagaacaagactctctaaaaaaaaaaaaaaaaaaaaaaaagtaagtaagtcagtatagaaaatacatacaaatttattgacttatttttctgggctgaacattcccaatcaaaaggcaaaacaaagtaaatatgtgtaatgtccatgtcaaaattagagccttaaaaatacattgaaagttgaatgaggaaatttgatcacagcaacaatgaacaagtgtcttcagtcattgatatttgataagattataggtctataatctcattattaattccagagtccaaaaacttctgaaaaaccaaaacagttttataacttatttggaaacaagacctgatataaacagatgtgtggctatttacagcttttatcttactttatcaaacttagtatgatatattgttatatgtttccttacagagatagttattagtttgagtacagggcacttccctagaccctactgagaatttatataatttatggtgtatgtactctactaacattgtaatgtctgaaaattatgaatatcaaaacatatgtgtcagcaaagaatttataaaggaaactgttgacctgctcagaatattgatgtaaaataaactacaggaatcagtagtcatttttctacactgaaaagacctttgactcaggtttccctgagttggtgaaagaacccaattggcagatgaaggcacacttcagccatcatagggagtagttcatctgaactcaccaaaagagtgtacctaaataagcagttaacaacagaaatctggaaaatactgcttttccattcttaatggcactttggagctccaaaatactggaaaatactattgctgtatgaaaccagaaatatatgtaaattcagccctcaaaatattgtgacaacaaagtgaagaaaatacattacctgaaacatgaatatgatatattcattcattcaattagcaactattacaaaatgcttaaagtgtgtctggcactgcttcaggtgctgaaaatgcagtggtgacatggacatttgccttaatttttttactatgcggcatgttctgaagagcttccttatgtttaggagatggatttcctaggtcagagctgctcttctcaaattagaagtctgcaacttgctcttctagacgctcttcatctagggctcgtgtatgtcacttacaatttgctaaacagatgaactcacccaagacttttgtccagaaggaacaactagaggaagaaaacactgaaagggacatttttctaaatgttttagctgtggagtcattgccagtagctgagaagttggagttcccgaagcagcaagtgatcagtatataaactgtggttatctgactcccctggcaacagaggtgggatctttattagagcatccctactgtgaggttcctggtggcttagcctccaagtctaatgatcttgccctttggagagtccataagcaaagtttcagcttttaataaatttattactttctgtgatacctatgtgtttctgcaattaacaactctgaatcatataaaaagtgaaaaaaagtttctgacctcattggctggcattctaggagggcaaactgatgaattcttaaactgatcagtaccagacattttttcaaaaagaggatggatagtgaatgaggggataccattttaaaaggcaagggcagacctcccagagaagatagcatttaaaactaagtgagatgtgacagagaagagggagttagccacggagatagggagttagctatctagcagagaacacttaaatgcaaagttgctgaggtgggactttgcttagaatatctgaagaacagcaagaaagttaatgtggctggactaagtccagataaatttagataaaattaggtctgagggatagctaggggtcagaattatgtagatcattgtagaccatagcatagataggtgattggttgattgttagatagatagataggtaggtaggtaggtagatagatagataggtaggtaggtagatagatagatagatagatagatagatagatagatatggtgagtattcagcctgttttacaaaatccttagaatcaacctaataatataatgctcattaatcaaagtgacaagttagaacatttagttttgtggctttttattaacataatttaaaaatagttttatattaaaataaagagaaacatagtagaatgctgattttgcaggaatttgaaagttattacgtgagtccctaaggatagtttaaatttgtggacaatttagattaagtttcccaacctcttatttgtacggtatcttttgcaattaggtaaactaagttaaaaagtttaagaactatattgttaagcaacatacattcagaaaaatgagtcagttttttttagataaacatttcctcttttttagttttatacatttagtgaatagaagtgcagatttattacatgtgtacattgtgtagcagtgaagtctgggcttttcgtgtactcatcacctgaatagtgaacattgtccccaacaggtgatttttcaatcttcccccacatcctcccctcccaccttttgtagtctccaatgtctcttattccactctgtgtgtccatgtgtacccattgttaactcccatttataagtaacagcatgaagtatttgactttctatttctgagttattttacttaagaaactggcctctagttccgtccatcttactgcacaagacatgatttcattctctcctttggctgactagaataaaaatttaaattaatttataaagatgcacttgcctatttaaaataagtgtggtctagtgaaagagtacagaccttcaagtcactcagtcctggattcaaattttgttctgccccttattgctcatgtgatcatggtgaaagttacttaaatattcctcactctagtttcctatttgtaaaattagaaaaaataaaacttaacacacaaaattgttatatatatcaaattaaataaggcaactttttttttttttttttttttgagatggagtctttctctgtatcccaggctggagtgcaatggcacgatctcggctcactgcaacctctgcctcccaagttcaagcaattctcctgcctcagcctcccaagtagctaggattacaggcacccgccatcatgcccggctaatttttgtatttttgtagagacggagtttcaccatgttggccaggctggtctcgaactcctgacctcaggtgatacaccggataatgcagcatttctaaggcactaagaagctttccataagtcatgcaacaaatatgttaatttcctttctttattacatttaattttttatctttcgatatccagtttgtttcacagcatagctaaagagccagaagggaaaggagaaaaagatgcttggaataacatttatgctaactaactacagtgacaaaaataaaagactggtttaccaagaaacctctctgagagtctctatatcatatcctgaaagcttcatgtctcttgataaattcacaggttttgagtttgttgaatttagcatctcaccttctttagtgcttcctatctctccaaagcacctggagatataaaagccaacaagaataaaacaacctgcctcttttacctgacagtaggatggaaataaactcaagataattggcttttaagatagctagtaggtacgtttatgtaaacatcatagagttttagaaagtaccagtgactggaaaagctcagaagctaacatcaaggtcacaccactccagaacaaactaggaaatacatatttggagatgtgttggccatctagaactacagccagctagaaactgataaataaaggtaccaaaaatagggatcagaagggttacacaatgatgtgtgtagaaaagaggtcacaatcagaaatgtaagaaattaaaatttaatgccaaaagacaaatttgttgaatatttcagtgcagtaggaaatatgtgagagaggacaaatgaaaagaatcttcagtgaaatagtgtgattagtagattttttcacagttaataggcagcaaatggagaacattactagtgcaaggaggacttagtgaaggttatgtactactttaacagacaaaaaaaaagctcagaatacgaacacaattcctcagcaaaagaacagtagggaagtattggtgttgaacctagaggcctgtgtatatgagtatccaccgggaatggctgattcgtgtttcattttgctaacaaagcataaatcagtgagcttattttgcaatgcagtattttcagtgtactggaatcattacatgtactggttcaaattctgcctcctctgcttaactaccactatggccttgggccacagattcagtttcttcaacttcctttgtagaatggaaataataatccctatcatatagcatataagaggcaactgatatattatttacttcagtaattatgttattttagtactgataaaagtcaatatatgaacatctttttttctcacaaacctacatatcaaccacattcagatatccctgtatattattagctcttttatatctaactaaaacatgaacagcaagaacatcaaactagaaggcctaaggaaaggatatggtctttactcaaaacatttattgctagtgcttctgcatgaaatgattaagaccttgctttacatataggtctaaatgtattatcagttcaaataaatcccacttaaatttaaagtgttatttattttcttttctataagaaatatataagttatttgatcctccaattccctaccagtgccagacatttcagtagctattctgggcattaaatatcctcctaggtttaactgctctcagttaaaggaattatttcaaaggtgttgagttcagaaaagaggctccctctgaagtattcaaaggatagtggtgctaaaatatgcagtgtttataaggtttcaggccagcgaatttttcatcggccttctgagaacacagtaggattttatcatttcatatctctattttgagatctctcagcaatcagtattgtgggtcctatttttgatcaatcaacctccctattggtttgtgccaggaattgaggatagttgctaggctgacaaatgttcttggggtttaaatttggtgaatatttactctctaacaaaaagaacacagatactacattcagttcccactttttgctcttgattaggaaataattatagcttctgaatttatacagtgatttaaacattttcccaccagggtgctggcattctgggaaaaaagaacatataatgtttgatttcaggctatcctgtgagtctggattttaaaagtagagtcaccctctgcaccagtttattgagtatgcagtaactaacaacagctgctctgtgtgaaaactgaaggacaagcatgcagttggtcagcttgataccaccacccatggtcgtttaaataaatgaggggaacaaaattagttttgccacgacttaggcaaaaatggatactgtctaatgctctatgtgaaaatagagtcagtaatctgctatttgaaattttactgacatttagacatttattgaagacaattttactttatcatcaacagaaaaatttgtgtagagctgcaaatggcctgactagacaaagtcttctctcctaaagggttagtgccaaaaagtgaataaataactgtcatttcaaggattggtgccatgttagagttctcttgctggggaggaaattgagaacagtctcaggtgaaaagagaggaacaaccatggcaatattatatggctttgttgacccagctagcacaaagcaatggttttaaatgtgttttctaaacaaattcaactaatcatttccattcatccattttgtaggatggatagatttcaaaacaaattgccacttggatagcttagctcacaggaagagtatgctctggaccctgaggaatgagtgaggagccaattgttaagattattcctttgcctacatttttcaggatgtgtgtcactatccactctgcatttagacagctctcaaactgggcaatagtcacagtgtatactgcatgggttttaaattaggataaaatgttagaagcttcctcagcttcatggccaggagaaaataaatttgcccatgccagacagagatggccacagtttgattaagggactttaaaaagttaagagaagtatccgaaatttgcaaagcacccactcaagggaattacatggcagtgctcatgaaaataatatgaaacaccctgcaaagcttttcactaagctttgaccttatcacttgctctttaacttacttctggaaactaatgctgtggaaaaaaataggagaaggtacttgaacaaacagcttaaattatattgtccaaaagttccttacacagtccaaacaccttcaaaacctagagtttcttggctttagcattgagcaataatcttgcctgataaacggatatatactgatattacctaatagctgaaaatgtttttactcagttaccaaataatcattagtgcagaatagatgtgaggcctattttcggtgtcagccagaagcactgtttactcctccacacttccaaaaattcctctgttctatcttcccgcttgagcttgcgttttatttaaatgtttgtaatacatgctgacacacaaaaaaatgttgtttacttcaacttactctaattgtggctgtccaccaagaacaaatcaaatttctcagtttctgtgaaataagcctcttgctctttctcatcttatttttaacttttgacaataaaaatgcatgcatatgaacttgatcaaagcaataactaggaaaaatgaactagcaaccctggatctaaacctgactcctactcacatttctagccctcaatatcttttatataaaataaaatgatctatattagaatggtatctaaagtccttttcagctatgaaatttcacaagtctttcattagactttcatcatctgtgtatacacagaaaacaataatatcttgccttttgcaagttctatagtttttttattttaataatcatccaattcatctttcttaaaaaccagcctccttgaaattaaactgacatggattaatatctcacttatactctaatgacagaaaaaactttaaaatttttggaaagaaatcattaagaaaaatttacatgtaagagaacatatatattctatatcagtaaatatataggtgtgatacagatctgtgtctataattatatagacaactatatcaggatatataccttatcagaaaacagactgaaaatatatcaatacaataaaacttaaaatgtactaactagataaagccaagaactgatgactactgagaaataaataaaatggtattatgaatgaatttgcattgttctaactacatcacatatttccaatgacagcttcacattgatttaatattggccaggccaagactggaagaagaatgtgttgtcctggaccctagaaaaccacatctgattgttattgtgaattgtatttcatatggctgtaattattctgaattgtgttcactaatttcttgtcacaaaaaaatgcttaaaatacagtaagaaatgggcttaagcagattttaaatggattagtaaaagcactagagtattacttctatttttaaagaaataccatgtattttggaatcgtgaagaactgtgtcagcacatttttaaaccactaggcttttgttgttgttgttgcttttctttccaattccagctttttattatttttttaaattttattttaagttcagggttacaagtgtgggtttgttacataggtaaatttgtgtcatagggctttgttgtacaaattatttaatcacccaggtattaagcctagtatccattagttatgtttcctgatctctccctcctctcaccctccaccctccgaaaggccacggtatgtgttgttcccctctacatgtccacgtgttctcatgatttagttctcacttgtaagtgagaatatgcagtattttgttttctgttcttgtgttagtttgcacttgtaagtgagaacatgcagtatttggttctctgttcctgtgttagtttgcacttgtaagtgagaacatgcagtatttggttctctgttcctgtgttagtttgctaagggtaatggcctgcaaaggatgtgatcccactcttttttatggctgcatattattccatgatgtgtatggaccacattttctttatccagtctttattttctttatccagtctatcatttagtttgattccatgtctttgctatcgtgaatagtgatgcagtaaacgtacatgtgcatgtgactttatgatagtatgatttatattcctttgggcatatacccagtaataggattgctaggtcaaatggtatttctatctttaggtctttgaggaatcaccacactgtcttccacaatgactgaactaatttacactcccaccaacagtgaataagtggtcttttttcctccacaaccttgccagcatctgttattttttgacttttatatgatagtctttctgactggtgttagatggtacctcactggggtttggatttgtatttctctacagatcagtgatgttgagctttttcatacgtttttgtttaaaaataaaattagaaatcgaagacaaaaataaatgtggtgaacggtgtaagtcagtttattctgtaattatagggggatgtttcagtatgctgtaattcctatcctatagaacagcagtccatggtccccaaactttttggctcataaggagcacacaacctagatcccaggcatgcacagttcataatagggtttgtgcttctatgagaatctaatgccacagctgatctgacaggaagtagagctcaggcagtaatgctcccttgcccacccctcatctcttgctgtgtgacccggtttctaacaagccacggaccattttcagtcttgcagcctaagggttggggacccttgctatagaaggcaattagtatggggttaataccagatgaacaagaaagataacatcaggcaaataaaacacacagtaaaacaatgtatataacagcacaatggttttattgacggcagaagaaaaaaaatttcctttgacttgtaaaaagaatttgttttatttaactcagtatttttcccattctttgtgtgagttgaatcttcttttttcactctaaaatatgttttttctttctacaagtaatactatccaccatagctgctacttattctgaagagaaagtagagaggtctatcaacaggttttgaccagaatgtttcagtcaatggctcctttcttcacataaactctattttaactagaaaggaagaaaatgaagttgaaccctcaaattaactttttcatactgtgtcaagatacatttctgctgaaacttatctgcaaacgtgaagtgtttgcataaatataaataaatctctgatagaataaattttggacactgctgtcaaaagcaagcaagaaggaacgaaggaagggaggaagggagggagggacggagggaagggagggtgggggaaaggggagagagggagggagggggaaggggagagagggaagggggaggggagggacggagggaaggaaagaaggaaaagtttctgaggcaaaaacttataacctgaaggtttaatagggtagatgagaaaacaatccctggaagtaaacatcaatgataaaagaaagagagactataatggaaggagagaaaatacccattggtttgctaccattcagaccacagcttcaagaggcagtacagttgatagctgtaagttgtgagttgtttccagagaaactgtgaaagtccattgcattgatctattggatgctgaagtaagtagggaaggaaggctagtgaattactggttcttttttgtccatttttcctactggtaaaaggcaagctcataggttaactgtcctgtagctgcaggttgtgtttcctgggttccctaggcagctgtggaagaaatgagggttccagtggtccagtgaagtcagtatgtggttctgtggactcctccaagtatgtgtgtaaatgtgtgtgtatgctggttgggggatatttcatctgttttgatggtggtggtgatgacagcagtggcaataacctaagctttatggttgaagtaatttcatcagtcattcctaatgccattcgggccaggaaggaaagcaatctgccaagtcctgagggtcaggggaagtcaggtagaatcagagggcagaaactcattttcgctctcactctttagtgatcttcagatctcacataagaacactttgcattcaattcttgcctaggaggggaggtgcaaatctaattcttcaaggtgataattagttgcaatctcctaaaaaaaactaaagaggactagaaaccaagccatgttcaaactattgcaggtggtacagaatagatgtttctcatcattcttcttcactcagactccctagattcccctcactccctctcagcccttcagcaggtcaggagatgacgtatctttctttcttttttgtttattatactttaagttctagggtacatgtgcacaacgtgcaggtttgttacatatgtatacatgtgccatgttggtgtgctgcacccattaactcgtcatttacattaggtatatctcctaatgctatccctccccctgccccccactccctgacaggccctggtgtgtgatgttccctttcctgtgtccgagtgttctcattgttcaattcccacctatgagtgagaacatgcagtgtttggttttctgtccttgcgatagtttgctgagaatgatggtttccagcttcatccatgtccgtacaaaggacatgaactcatcattttttatggctgcacagtattccatggtgtatatgtgccacattttcttaatccagtctatcattggtggacatttgggttggttccaagtctttgctattgtgaatagtgccacaataaacatatgtgtgcatatgtctttatagcagcatgatttataattctttgggtatatacccagtaatgggatggctgggtcaaatggtatttctagttctatatccctgaggaatggccacactgtcttccacaatggttgaactagtttacagtcccaccaacagtgaaaaagtgatcctatttctccacatcctctccagcacctgttgttgcctgactttttaatgatcgccattctaactggtgtgagatggtatctcattgtggttttgatttgcatttctctgatggccagtgatggtgagcattttttcatgtgtcttttggctgcataaatgtcttcttttgagaagtgtctgttcatatcctttgcccacttcttgatggggttgtttgtttttttcttgtaaatttgttggagttcattgtagattctgaatattagctttttgtcagatgagtagattgcaaaaattttctcccattctgtaggttgcctgttcactctgatggtagtttcttttgctgtgcagaagctctttcatttaattagatcccatttgtcaattttggcttttgttgccattgcttttggtgtttaagacatgaagtccttgcccatgcctatgtcttcaatggtattgcctaggttttcttctagggtttgtatggtattaggtctaacgtttaagtctttaatccatcttgaattaatttttgtataaggtgtaaggaagggatccagtttcagctttctacacatggctagccagttttcccagcaccatttgttaggtagggaatcctttccccatttcttgtttctgtcaggtttgtcaaagatcagatagttgtaggtgtgtggtattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctctttgttggttccgtatgaactttaaagtagttttttccaattctctgaagaaagtcattggtaacttgatggggatggcattgaatctataaatcaccttgagcagtatggccattttcatgatattgattcttcctatccatgagcatggaatgttcttcaatttgtttgtatcctcttttatttcattgagcagtggtttgtagttctccttgaagagctccttcacatcccttgtaagttggattcctaggtatttttattctctctgaagcaattgtgaatgggaattcactcatgatttggctctctgtttgtctgttattggtgtataagaatgcttgtgatttttgcactttgattttgtatcctgagactttgctgaagttgcttatcagcttaaggagattttgggcttacacaatggggttttctagatatacaatcatgtcatctgcaaacagggacaatttgacttcctcttttcctaatgaatacctttatttctttctcctgcctgattgccctggccagaacttccaacattatgttgaataggagtggtgagagagggcatccctgtcttgtgccagttttcagagggaatgtttccagtttttgcccattcagtatgatattggctgtgggtttgtcatagatagctcttattattttgagatacgtcccatcaatccctaatttattgagagtttttagcatgaagggctgttgaattttgtgaaaggccttttctgcatcttttgagataatcatgtggtttttgtctttggttctctttatatgctggattacatttactgatttgcatatgttgaaccagccctgcatcccagggatgaagcccacttgatcatgtggataagcttttttatgtgttgctggattcagtttgccagtattttattgaggatttttgcattgatgttcatcagggatattggtctaaaattctctttttttgttgtgtctctgcccagctttggtatcaggatgatgctggcctcataaaataagttagggaggattccttctttttctattgattggaatggtttcagaaggaatggtaccagctcctccttgtacctctggtagaattcagctgtgaatccgtctggtcctggactttttttggttggtaagctatcaattatttcctgaatttcagagcctgtttttggtctattcagagattcaacttcttttttcttaatgtatttgaggccttccttgccttgcctttgttgggctgtggctgctgaaatatttcactcacaattatcaatggtcatagaagaaccaaaagacacattggtgaataccctaggataagaacatactctactatccctccattgtgtaataacaaacttatccagccttacattcctgcttcataaccttcagttagatccatttcctcacatgtttccctggttactgctgccatatactaatcaggcatttcatttctttgctgtttaagttttttctccccaaagcaaagtctattcttctctttttggattgtgaggagatttgatcattggcccctcatttggtcctggggccaatgagggatattggggactgattattttgagaacaaacattatctttttacactcctacttaggtcaattcggtagacagtccctagaaaacggcaagctgttctcctatgacaagttgttttagggctgtctctactgaccaagaagattaaagaaaatttagtaagttgatattcccaggttcatttatctaaacacaactaccccaggttttagggtctcactctttctctatcaaggccctagtttgatgtaggaaacttactaagaggacacctttcatctcctctacaattttcccattctatgttcagatctgagacttgatctttagcacaatctaccagaggaacaatatataaacaaacaactccttgaaagctcccataaagactctttggttttcatagaaaacagctgttgttagactgtcatttttatctttctcaaagtttccaacattactaaaagctcagttattattgtccccataatgatcaatgtagcagctgcttgtattccagcactttacttacctgtactccattccaattaaccccagctcaaggtgtgaataattatgatatctctgaacaccaaaaattattatcctccccgacttaccatgagctttgtgattgcttttgccttcaaacaggcagggaatccaattccaaaataccctcctgaaggatgtgtgctgtctagaactagtctaggatttcctcaaacacagagcctgaggaaaagaataagagcaaagagggaagtgaaacaaagaggaagagtaaatacaaaaggtgtctaatggagttgacagcatcaccagaaaaacagctggttggttcagatgtgaacagctgatatgttcacagggaacatatccagagacacagcataaaacccccatgtagtagtctgcttaggctgccaaaagaaaataccactgactagatggcttcaacaacagaagtttattttgtcacagctctgaaggctggaagtccaagatcaagatgtcagcaggtttgatttctcccgaggctctctccttggcttgcagatggccaccttctcactgtgttctcacatggcctttcctctgagtgtgtgcatccctagtgtctttttctttctatgaggacaccaatcatatgggactaaagccccacctttgtgacctcatttagccttcattgcctccttaaagtccctgtctccaaatacagtcatattggaggttagagcttcataatatgaatttgtgggggagggattcaattcagtctagaacctccacttctcaaaacagtctgttttgtatatgtgagggagtagtggtgaggttgagaggacacatcaagagaaagttcaagcaattcaactattgcatattccttatttcctgtgtctcattgagcaatgtcggccacataagcattaactccccacactttgaggcctatctgggcagactttgaagaggacagaaactttatgggtctattcatcaagtcctcatttgtaacaataattgttttcaattaatgctgtttatcaggctctatggtctctagcagtgctaaggctgtaattaattaggaagaaagccaagaaggcctggaggaggaaactggtagaaaagggaactggaagggtgaaaatatatagtattggagagctaatagtatattttttctggattgataagttttatcattacatcagataatatgtttgacttttaatgatttgagatattagacatttcattctaaatgaagccaaactagcaacttgtaatggagaactcatatgacatagtctatgctgatgatacaaatctctgaaataatgtttctgtgggatatgggaaaattagctgttagactgccaatttgtgcaacttgggaatatttggctacaggagagcttgtaaagcggtagtccttggtattgtccttcaaagctaggggtgaaggggtatgaggaaagctcttatttttacaaagtattatgtacttttcttgtcccttttcgaaaattatctgaacttacaattttagagatagaacaaatgattactgggttaaagactggatatccttagaagcatgcataatgacatataataaagtgaatatagatcttttttgttttcattgcagatttttggccctggactcttatactttcaaggatagtcataagggttttagtcattttttaaccaggatcagctgagacagtgatagcagagcattacaccaagtgcgaggccttctaagttcagggacttgtgcaattgcaaaggacatgcaatcatgaagctggccttgtctacaacatcatttattgcaaaataaagaacaagaaacaagtatttttactatttcacacagaaaatatgtatttgtacaaagaaagtagaaaatatattattttgaacaaagtaaaaattaatataaacaatctttccccatatatcaaaatttaaacagtcaatatttaaactttaattcagaaaatgacaacataatttattaatattttaatactatatcatatttagttgttttcttcatacacgattgcagtttaggaacatatatacatatcatacatatcattaagtaaaactggaatatctaacatgttctgatataatttttatgatagatataatagagtacttctcatatatcccacacccagctttccctattatgaatatcttacaatattatgctacattggttaaaattagttaactgaaagatggaatgaaggaaaattagcttacattgatacataagtattaactaaagcccatactctattcagatagccttagtttttacccaatgtcctttttctgttccaggattctatctaggataccctatgacacatagttgccaagtctctttatgttcatcttaactgtgacagtttttcagactttttttttttggttttgataaccttgacgattttgaggagtacttatcagatattttgaaggatgcccctctactgcaatttttctgatgtttttactcatgattagactggagttagggtttggggaagaatatcatagacataaagtgccaccgtcatcatatcatatctaagatagatgctaaagggatgatttacaactgttaatgttgaccttaatcactgatgtgccataatgttttttaggtttctccactgtaaggtcatttttcctcccctttccatgtagtactctttgaaaggaagtcactatgcataacccacgcttgagaggagaggagtcacgttccacctccttaaggcagaataatacctaggtagatttattctgtcactttcccctatttatctatttatgtattagtaatctatgcttctattaatccattttttatttctgtcagtatggcttcattccagcagagagaaatctgactcccagtgtccaccatccatttgttctcctcaattccagtgtgcacaggagcaatacaaaaatcattaacccatacccccataggaacaactttatcaacaaaattataatgtctatgtacagttacttctgcctttagtttcacagcctctactcatttacaaaattacttaggttgccacgttttcttccaatccccttaagtaaggctgcattatacttttgtactaggcatattattttatcacattttacatctcatcctgggattcccccatacctcctgaaaatagtgtttttttaaattgtcatatattaaagctcactctttgcattttaaattctatgggtttttataaattcatagtttcatgtatttgccgtaagaacataacacagaataaattcagtttccataaaatttagttttttatcttttcaaccatcttaactcccatctgaacctctggcaacaactgactggatataatttatttagttttgccttctctacagtgccatataattggtcccatctagtatgcagctttttcagactagctctttcacttagcaacatgtacttaacatgcatccatgtcttttcataacttgagaactcatttacttttgtctctaaataatatttcattttatggccaaccatattttattaattagttgatgattatttggattatatccactttttgcctgttataaataatgttgctatggacattcatgtaaaagtatttgtgaggacatacatttatatttcttatggatatgtaactaggagtagaatatataactggatcatatggtaactctatgttgaaccatttgaggaactgccagattgtttcccaaagtggccacatcattttatattctacctatctacaaatatgaaatatatctcaaatatttaggtcttcttggatttattttgtcagtgttttatagctttctgcatatagaaagctatatatattttaattttatacgacaagatttcaaagttttggtgctatttaaattttcttccttttagtttcaagttctcatattttgctgctggtgtataggcaagcaattgaatcttatatgttgacctttcactaggtcagtttaccacacgcactcattagttccagaagtttttgtagatgcatagacaattatgtcatatgccaacaaagataattttatattttcctttctaaatgttatgtcttttatttcttttttcttgtcttacttcagtagataggacttccactatgacattgggtaggagtcgtaagggaatgcatccttgccttattactgatcttaggtgaaaagagaatattttctcaccattaagcctgttgatatggaaaattacattgagtttttttcagtattaaacctggaataaactccatttagttgtggagtaaaattatttttgtatctttttggatgtgatttgttgataatattttgtatatgttcataagacatactgttctataattttcctttcttgtaatgtctttattagcttttattaggataatgttgcccttataacaaggagttagaaagtgttccctttgcttctatttactgccaaaaattgtgaagaattggtagcatgtcttattcaagtatttggtagaattaaccaccaaagccatatgagtatgctgattttgtttttaactgttattttaagttcaggggtacaagtgcaggtttgttacataggtaaagttgtgtcatgacagtttgttgtacagaatatttcatcacccaggtattaagcctagtaccattagttatttttcctgatcctccccctcctcccaccttccacctcaccatcaaaaggccccagtgtgtgttgttctttccactctatgtgtccatgtgttctcaccatttagctcccacttataggtgagaacttgtggtatttggttttctgttcctatgttagtttgctaaggataatggcctccagctccacccatgtccttgcaaaggacgtgatcctgttcttttttaatggctgcatagtattccattgtgtaaacgtaccatactttaaaaactgaatgaataattaacaacttcccaaaagaaaaatcaccataaagcccacaaagatgagacagtatggtgatttttcttttagaaagttattaattattgattcagttttctaagtagatataagcccatttatattttctcattctctttctataaaccttggtggtttgtatcttccaaagaataagtccatttcatctaatataaaaattgtgagttttcaagatatgaaatcagcctaagtgtccatcagtggatgaatggagaaagaaaaagtggtacatttagacaatgtaatactacttagacataaaaaataatgaaaccctgtaatttgctggcacatggatggaactggaggacattgtgttaaatgaaataaaccaagcacagaaagacaaatattacatgttctcactcatatgtgagagccaaaaaaaactgaactcatggagatagagagtagaatgatggttaccagcagctgggaagggtagtagggcatggggaatatagaggggaaggttgatgagcacaaagatacagttaggtagaagcaactaaatctaatgtttgatagcacaacaggacaactaaagttaacaatagcacattgtatatttcaaaataactaaaaaagtagaattggaaagtttctaacacaaagaagtgataaacgcttgaggtgatagatattccaattaccctggttaccttagctagacatttattgatttttaaaaatattttcatagaggcaccttttggttaacttgattgtccctagtgttttactgtttaaaatgttatggatttctgctctaacttttatttcttctctttgttttgggcttaaattgaccttctttctatagttttctatgtgaaatatggattaaaattactgatttagatatttcttactttcttatatatgcatttagtattaaaaatttctgtcatacccctgctttaactatatcccatacattttggtaagttgtatttgtattttactcagttcaaaatatttctaaatttttgttgaatctacttttttgacttataggttacttggatatatgatgttaaacttgtaaacatttgcagtgttactatttttttatttctagttcaactctactgtagtgtgagatactttctattatttctattctttttcagttttaatatgtattttatggcccagaacatagtatatcctggtaaattattcatataatctttcaaactatgtgtattttgctattgttacatggaatattctaaaattgtcgattagattaaattaattgatggggctattcaattcatctatattctcaatgattttctatctgctggatctattgtctactgaaagaagagtattgaatctccaactctaataggagacatgcctaattctctttgcagtttttgccttatatattttgctgctctgttattaggtgcctacacatttgggactattatattgtcctagagaattcacccctttaacatatatcatatctatgttattgtggatgattttcttgttctgaaatctgctttgtttgaaattaatataactacttcagatacttttgattagtgttataaatttcttcctcagtttacctttaagctattggaatccttatattaaactgtttcttgtagacaacatattttttgtctgtttttctttaaatccatactgaaaatctttatttaaaactggcatatttagatcatcgacatttaaagtgactcttgatatagttggctcaatattctccatatatgtagctgttttctcttttttggcagttgttctttcccctccaccacttttctgctttctctagctttaattcagcattttatataattccactttatctcctctattagcatgtcaatgatacttccttttaaattttacattgattgttctagagtttcaatatacattttttaaccagtaaagtgtattttcaaatgacactatatgacttaatgtgtaatgcctatgtttatttatatatgtatatgtgtgtatatatgtgtatatctatataaaattctttctacatatacatatacaaatatgtatacatatgcaaattatctacatatacacatatatgtatgtatagattattttgtcatatatacatatgccacatatacatcatacagacatatatgtatgcatatatgtatttatgcatatgtcttatatgtatgcttatatatacataggtatgtatacatatgtcttacataggtatgtttatgtatacagatgtatacatatatatgacatatacatgacatattatatatgacagaaaattctaattcctcccattgctgatgatatttctgttactcattcactgatttgtatactataatcacccaacacattattactgttactttaaaaaaggttatcttttagattaagaagaaaaataaatgattttatttaatcattatttattccttttctgatattcttttctttttaatggagatccaagttcctgatggatataattttccttttccctgaagaacctcttttaaaatttttttgccgacaggtcttttgatggtgtattttctcagtttttgtttgtctgaaagtctttatttctgcttcactgttgaaggagaaggttaagtttgctggatacagaatttctgtttgggaggttttttaaaattttaaatattcactattctctcttcctgcttgaatggaatcaccatgctgtgtttctcactgtaactccttgttctttgctaggtacagtggttattttccctgtctaatttatttcaagattttcttattatcttagttttctgaagtgagaatatgttatccttaggtgtaatatttttggaatttatcctgcttggttttccttgagcttcctggatctatggttttgtgtatgtcattaattttgaatgctcttgaccattattacttcaactattttgtctgcttttgcctctctttcttctcccccctggcattccaattacattttcatttaccttttgtaattatccccacagttcttgggtgttcagttttattctcttctttgcattcagaagtttctattgatatatcttcaagttcactgtttcttcccttggttgtatccagtggactgattcactgagatggagttttactcttgttgcccaggttggagtgcaatggtgtgatctcggctcactgcaacctccacctcctaggttccagtgattctcctgcctcagcctcccaagtagctgggattaccagtgcatgccaccacgcctggctaattttgtattttttttttttttagtagagacaggttttcaccatgttgatcaggctggtctcgaacttctgacctcaagtgatccacccgcctcggcctcccaaagtgctgggattataggccatgagccaccacacccagcccaaagtcgttcttaaatcactgtaatgtttttgatttttaaaatttattttgaaccctttgtattaagaattctgactctattttttttttttttttttttttttttttttttttttttttttttttttttttttagtgtttgacttctgataacttctaagtcttactcctctgtatgtcttttgttccacatctgagcaagctaataagaaagcctgggtgctttctgctttggtgcttacaggagatccaaaccatacaaccctctgcttgcacacaggaactctcacctcaatctcactttctaaccacaagcaaaacccaaaggcagtctcctttcctttctcccataaaccattgcggacctacttgggaggcctgcaccccattgtccacaaaaacttgaattctgtaagtaataattttttaagctcttttggagtgggtttcacatcctcagtctcaacatctgaattaaatattgactgagagtgaatcctgcaccttcagaatggctacaaaatgctctcttagagtttgtgtgtgtctctgcttacataactatctgttattgaatgttgactacttttttccatgagttcttaacatcttaattattttaaaaaaatcctctgatgattccaacatctgtctctttcctcagatgactgtttctgctgcttactgtggctttaaatactttttttggccctttaaaatgtcttataatttttggtttaaagtccaacttgtatcagttaacagaactgaggtatatcagcctttaatgtcaggatttatattaatctgggtaggagttgggctgtgttcaatgtttgttatagttttagatgccatagtcctttatattcctgcagtactcttatttgtgtttatttttttgactttgggattccctaagtcttcttcagacagattctgcatgttgtaataatttcagatgtaatccccttcagttattaactgaagccctgacctaataatggtcaggtatggggtaggaaaagcacattataatctcacatgaaatctcattcttttagtgggcctgtgtctctgagctgtgaccttcacaagtatttttctcatgatatatctttccctcctctgtgccatttatgtaagacaagactgctagaaggtgctagcatgaaaagaatgtcatttccaagtttagacaaggctctggtaaagtctttctcccggaggatagacctttgttacagataatgcactgggcatattttacaatgattgctattcctctgttcttgccagagacaggaggaaacctttttttttttcttcatcatgggaacaaggtgaggttctctgaggtaacattccctaagacaggaaccccaggactttccaactctaaggatttcccacattcaggatccagaagttttcaaaattacctcttaagttttcctactagtttatggccccagaggcttctactccaggtaagcagttctctgcaactctgaatttgcttgtatttctagattttaaggtgacagtttgccctgtaatatcagttctctgacgggtccaagacaagccatcaattttaagtttctttaactatttcttattgtaaggatgggaattggaaatgctaagctctttaaagatttgggctaaaactggaggtaatgctcatattctgtttttatcaaattcactgttaaatatatatcatctatccttcacactcagacaaaatcaaaacaatattcagtgatcagtcactcatttttagatatttgggttaactgacgaaggctttcatttccttctcctatataatccttgtacaatggaacaaggagataagcagtgaaaggccaagggaatgtctggagttaggacttcaggtgattcacaacttggctgccactcacccgagactgcccaagcccagatttcttccttctataagaatattgattcttgcaaataagatgaacctaaatgtggtccaggagtcagcatcttctacatggtactcagatcttcaaaaagaaaaaaaggaaaaaaatacaaccccattaaataagacagttatagctgctgctttttctttttcatcatccttgtctctgttttccttttcttacccctcttcttcatgtaaggctttccttataacccaatataattagacagaaacataatagtaacatattaccaagagtgcaattatttctactttaaagtataaaactggtcaaacaaaattgataatattaatctcaagttagttattttaatacagacagatgaaaaaaggactcatcacttcagtaagtttcacataccacctcttctaaccagaaaggagtattctctcaagtaaaatagttcctcattctttcaaaaatttaaagtgctttatctataatgctttggtatcctaatttccctttatctggattacataggccattgacattcaagcatagtaaaagaaaatgctaaaattttatcttgaatgttaaagcacaaggacttctgtgaatgatgagagatttctcgagtgtcactggtcaacactcattccaacatattgacagaacgaaaatactaacacctaactccctagtaaaatatatactttcagtacagaaaataaaataaccctgtcttctacttgttgagaaaaagtaggtaaaatattaaagtggaaaaatatggcattagagagagaagtacctgaatttgaatcctgaacttgctatgcagcttcaatgagttatacaacctctctaatccttggtttccttaaccttaaaatggatacactaatatttaactggaagaattgttgaaatgtttaatttggctcatcaaaataactaatgcagaatgatagatattcaataagtgataactataattattgttaatgtgtaaaagttttcttgcaaagatatatttcattaaaaaccatcacaacttgcatttgaaatgaatagagaaagatctgctactctatttctactcatacctccagatagcatgatgcttcttcctgaaataaaaataggaggaagggctgggcgcggtggctcacgcctgtaatcccagcactttgggaggccgaggcgggcggatcacgaggtcagaagatggagaccatcctggctaacacggtgaaacctcatctctactaaaactacacaaaaattagccgggcttggtggcgggcacctgtagtcccagctactcgggaggctgggacaggaggatggcatgaagccaggaggcggagcttgcagtgagccaagatggcgccactgcactccagcctgggcgacagagcgagactctgtctcaaaaaaataaaatagaggaggaggaaggggaagaggaggaggagaaagaaaggaggaggcagagatggctccactcctgaatacgttttaggtagtgtggtatttaagcacttcatcttggccaaatttgataacaattaaagtttgtttccaggttccttgggactctattttagtgttcgtttccactccagattagacctttccaaatactctcagaaactttagatgtcctccaatcaaactctgctctcttgaaaagactgccagcagtcttttatacctctctatattgccattccagaaatactggtatttggggtcatgtttctaactagggaattgagagttacagatagcataaggagtagtataaggatattgcaacaaggattttgtaaaggatccctgagtaagggatctcaagccttagatggaagaaatatatcatgtttgcatgtgtgttagtgtgttagtgtgtgtgtgtgtgtgtgtgtgtgtgtctcatccagcttgtggccctatgagccctgtacagaaaatggtagaggctgagaacatagacattcccacatttaataatgcaagagggtattcctttagttgaatacttcttttcagaaatccacacaaaatcagatataaagaaattcaacagaaaagaaaaatcaggctaggcacgatggctcactcctgtaatctaagcattttgggagactgaggcaggaggatggcttgagctcaggagttcaagaccagcctggccaacatggcaaaactctgtatctacaaaatatacaaaaattaggtgggcgtggttgtgcatgcctatagttaagctgcttggagactgagacagaaggatcacttgaacgcaggaagctgaggttacagtgagctgccatcacactactgcactccagcctgggtgacaaagtgaaactctgtctcaaaaaaaacaaaaaaattacctaagcatggtggtgcatgcctgtggtcccaggtatctgggaggctgaggtgggaggatggcttcagcctgagaggtgaaggttgcagtgagctgagatggtgccattgcactccagcctgggtgacagaacgagactttgtctccaagtaaaaaagaaaaaagaaaaaagatcacttttctagtttgtttatttcataaattggcaacaatttgttaattttttcaaaagagttttaaaatgtgttatttattccgaagaaacccataaaacattgagaaaggaagaaaaacaatagtttttcttcatactaacacatagcaaatattgaatgaacaattcaattccatcagctttcaaaacccaaggtatttggttcttgtttgtgatggtgctggtagtggcaatatatatgtaagtgtgtatattttaaattataaagcattttgaaatccttgtacattaattattgaaactgcagtcatttaatatggagtttcaccagtctatgtgtgaaagactaatgaaagggttaaagaattcacaatttcccaaaagaaaaaagaaatcatgaaataaatccactattagagtctaaatggtaatgcagcctcatttaaataacaaggaaattataactttccaaataataaaaagcttaaagcagcttaaaaatagctctgggtgaacacacgacaactaaaaacaaaatggaagaatggaagctcagttcctaccttaccactgaggaattttaagttatcattcctgtaaacatttctccagtggctccacggaatttaaaaatgccttccaaattgccttcagttttcacaggccatctaaaagaaacatgattttcctttcttagcaaacatgataaagaccttgaggagatataagcaatttattgatgaggacaagaatggcttttaatttgccatgggggatttgagccagaagttactggaacaccaaatctgtgaagctgacatctgtaggtcaaaaataaaaacaaaagagcaaataaaacacaatccatgaacaaacacattttttaaaaattagattaaattgtatagttccagttggaagaaattttcaaaggaaatagtatcatcttttggttcattgtaatatgcaaaaaaaaaaagcatttgaaaagattatatcagagaagcggagaaaatgcataacatctagtttatggtacaattttttctctctgctatgaatgttaggaagagttgggtatacctctttgtgtggacatatgttttcatttatttgggattgtttctgtggtgacttatttattttgtgaccttgccaaacattcggggattttccagttgtccttctattttttgatgtatagttcaattccattacattcgtataacatactttgtattatttccatttgtaacgttttgggggcttcttttgtggtacaggagatggcctatccctttgctccatgtacacttggaaagactatcttttctctcatttgatagagttctttataaatatcaatttgaataatttggttgatattgatgttcaaggcttctatatcgttagagattttctatttactttttctgtcttatcaattactgcaaaaggagtacaatatatatttggtttgtccattttttccttttagttctatcagtctttaaagttctataagtacttcaatgttttgttattggttccatgcatatttgatatttttatgtcttctccagatagaccctttatcactataaaattaaaatttttctttatccccttttttttttttttgacagagtcttgctctttctctgtcacccaggctgaagtgcaatggcaagatcttgcctcattgcaacctctacctctgggactcaagtgattccatgcctcagcctcccaagtggctgggactacagacatgggccaccatacccagctaatttttgtatttttagtagagatagagtttcactgtgttggtcaggctcatcttgaactcctgagctcaggcgatctgcccgcctcagcctcccaacgtgctgggattacaggcatgagccactgtgcctggccatctctttatcccttataaaagtcattttgaaatatgctttgtgtgatattaatatagtcttccagctctcttttcaatagtatttgcatatgttatttttaatttttaaactttctatatttttatgcttaaaggggattgttctatagacagaatacttttggtcttgcttttttttttaaagccaatatgacaatctctgcattttaattggaatatttagaccatataaatgtaaggtaaagtgataatatttgtggttggccaaataatgccatacccaaagatatccacagcctaatccacaggatctgagaacgtacatgataaaggggattacattatgttgcagatgaagttgaggttaataatgagttgacctgaaaatagggagattatcttatttaattaattacagggtccttaatactggaatagggaagtggaagggagagactgtggcataaaaagggcttggcccaattttgatatacaaaagtgatcaataggcaaggaatatgggcaacctctataaactgaaaaagaaaaagctgtttggattctttcacagaagaaaagcagtcctactgataacttcattttagttaattgagacccatttcagaaatccaatgctgggaagtaatacagaatagtgaaggtaaagttacaaagatgaaatttttcatctcatcaattggcattcgtgtgtatgtatacgtacataaactcatagtatatatatacatatacacacaaacacaaaacccacatatatctacttaattaaatcaattaaaattcagtcacatttttagtaacttcaatatgtaatttagcagttacagtggcatctatccctaaatagtttttatttatggggtatgatatgtaataactgaagtggtgataatacaaagtactatgatatttgacaaaagtaaagtgcaaatcgaatccaaatgctaaataaggaataaaattagtactcgagtgtaacaaatcatgactgcagaagtgtttaatgaaaagtttacatatgaaatggatattgcaaagagctcttaaatgcctttactaagatgtttagactttagtcaagagttagtggggaagatgaaaatgttttctcttttcttttctttccttttttttttttaagtagtgaaatcatctaaaccagaatcctcttttagaaagatcatattgatggtagtaaagaaatggaaatggcaagaacatacgagaagggtgtctaggttaaaaactaatgaaataattcatccatgagaaataaaagaataaactctgtactggaaggatataaaaaggaaacatatatgaatactacagaagtagaatgaacagaatttgaagacagaaaacctataaaatggtttttatataaattatttaaattatatataatttataagttggatctcctgggttttgtactcagtggttaaactccttgtaattccatgtatgaactattatttactttgctagtatttatatcttacggccagcctcttaataatttgaataatattattatgtccatcagatagaaagagaaagggtagtaaaatggaatccaattagttgtctttcctacttgccagtaatattctgggaaaaaaaaaaacagttaatatggtataagcttatacgtttttactttatatactgccttaatatataattagaagatgaatgtaagtaaaagtcctactatatttgatctttggatgacttcacaaccaataattgttttttcacctgaacttcacatttaaaactttcaagcaagagaacttagagaatgcacaattgctcactccaagtacttgtaacagtagaatatttatatatgtaaaaatgtgaaattattatttataatctatcccttttgtatatataagtctcatctggtaattatgccacaaactcagaagaaagtgtaatcacaggcatataaatatataatatatatatttttatgtcatattcattatcacaatataattttatttgataaataaattaagcctagttaatactatagaaaaggactatgactttatttctcttaatggattatttgtagcaaaaataatataattttgtttgaaaaacagttatttacaggtataatatatagaggaaattggttggaaataaagcaattatttgctatgaaactttttagatgtcacccctacctaacttgtagaattcttggtcttttggaatgtatggcatagagacctttatgaaagataattccattacctctctgtttcagatgtattgtttcaggacaggcaagccccaaaattggggtttagcccaaaagagttcttggcttcacccaggaaggaattcaagggcaagctgctggcggagttagacagcaatcttttttgaatggtactgctctttgcagagcagggctaactcataggcaatgcacccagatttgctaatgtatgggctcttggcaactgtacttaactcctgtaaatccactttcaattatgtgcaaattaatgggtgggtcaatgcaaattggggaacgggttacttaaaactttctaagaaaggagcagtcatttctgggttgttgccttggaaaatggtagtaacttttgggccattgccatggcatttgtaaactgtcatggcactggtgggtgtgtcttatgccattgagcaatgagggcagctaaaggtcgttttctttgccatctgcttgttactgtcagtttcttcattttatcctggctggacaagattttgttttggtcatcggggttgtgaacggaataaaaagttctgccagtctctcaccttgtatagctgagttcataagttgttccttcatggaattttttttttttttttttttttttttgaggcagagtttcgcttttgttgcccaggctaaagtgcaatggcgcgatctcagctcactgcaacctccgcctccctggttcaagggattctcctgcctcagcctcccaagtagctgggattacaggcatgtgccaccacgcccagctaattttgtatttttagtagagacagggtttctccgtgttggccagggtggtcttgaactcctgtcctcaggtgatctacccacctcagcctcccaaagtgctgggattacaggcatgagccaccatgcccggccccttcatggattttaatcattgcctcacaaaccaccacttattaaattaaaggtctttactacttcagtaagtacatatttgtacttagcaaagggagatataaaatagtccagtgaaaacaagaaattcagctgaggatcttaatgtatttcttattacacatagcaagatcttattcttaaaatctttaaaattttttaaatcatatatatctggggcagggaggaaggagttcactgtgttcgtaagcttggcttcaaatatcaatagatgtaggcaagtaggtaattcttagatgacaaaataagaatgtgtattgttatgaaagctggcttttctgctccaagaacaataaagttggctggttggcaagataagagacagctggaagctgaagattaagtgtgtaagagtattatattttgaaatttgagaaatgacctcagcgctacttgctcctaccactctatctgcagcaaaactgtttataacattatgttccaggaaagtataggaaacagatctaccgacattgcacatgatgaaaactcataaattcaaaaaaaaatgctttctaataacatacagaaacaaggctaaaagttagaactacagttcaggcatctatgctggtaaagtccctaagccttattaatcaaattattagtaaatttgcaaaataaagaaatgacttacaattgacaacttcatgggcaaaagaactgaaattgtgggagaaaactgaaaatcacttctcaactatttctgtaatgtatgtcaatagcaaaacccagaattttcaaaccttattttccaaagggaaaactagaaaaagagctgcatgctgcacatttgttattaaggggactgattcgaaatcagtcgaaatgtaaagatgaagtttttcaccattgaaaattatttccagatatgtggattttttggctacagcaagataataaacagtttaggaacaaaaacagagctgtaaatcaccaccactcatgatccaggacttcaagtaatggtgaaaaatagaacaataattattgcccccgaccctcctaaaaacacgcagtcttctgcttggggaagaaaggagagagaagagaaagaaatcacagaaatagccaaagggaaaaacgaaagaggaaaaggtgcaaagcaagaaagcaggagagtgaagctgagttttatggctccttctgttccctggttgcgtgcacccatatcttccctggtctaaagagttctaaagatgatgtataagggagcaatgcaaaaatagcagagaataatttgggtaatttattaggtctgtaacaactctcattttcattatcatcacattaccttttacgttcactcttcccagcttgaagtgcaaaatgcagatggcaagttcctttgagaaagcacattgttttgttgcttaatgtttcaaaaggaagatgtataatgaattgagcataacacataattacagcttgttcactgtatttagcatcgaaaagttcatagccagatggaaacatctgacgaaaactaggagtgtctcttactaagcatgtgccaaaatatgtctaggacctaaatttatgaatcctgggcataagcacttttaaatagaaatgctaatagatatttgactatagtgtcaagaaaatccctgctctaatgaaaatgttcagatgtttcaataggctaaagcttgacaagaataagggatacagaattttgtagaccctgctgggtttttttttttttttttttccattagaaaaagaaggagaaaccgtggtatccaggcacagggaatacatttctggaagctgttttagaagaacacaccagcaaaagaaccaatacattctagttacattgtaaaatattagatgcttttattttattcaactattactcaatataaaatattgttcacagtcaaaagaaaagtcatccttaagccttttattagaatttttcataatgttatttagatagactcccagcatgcctgtttaagattgccttacaaagcagaggcaaaagtctaggctgtcttggaaaaagggttaaaagtaatttaggttttattccaataatatatacttcatagaaatggacttccgagtctcgactatatgtttataaaacctgaacataagaataattccatccctttcatccacctcacatttataagaaaaatagcaaatgtttccaattacttggtgtttgggatgagtgtacaatggaccctttcattttatgaatgtgacatttgagtaagttaagtttgtagatacggcatttcagcaagtttgttgtacgtaaagacattattgaaatgaggttcagaacatttgcattgcaatgtatctacttaaaaatacctttgtatcctcattaaaatcttagactccatccctccaaaacatacgcacacacacagacacacacacacacacacacacacaactaacttttcatagtgttagcaacgggagaaaagaaaaggacagataatacctcatcatttatttcattttatggtaggaacaatacagagatacaaaactattcgtgaaaacttccttgttgtccggtgtcaactgaacaagttagattgcatttactgtggcctttaatcacattctcctgagttccaactatgtgtaattcctactcaggatacctactgggatgtgtaatgggcatatcgaacttgaacatgcctcagacagaatttttgatacattctacctgtccggagctactgttctttgattccctaccaaattttcagttcatgagacctttatcaacacttttgcagcccaaaaatgtagtggatagctttgactcttttcttctctactaccttcatgctgccagcactccctctcccatatagttagtttattggattgtattattctacctcccttatcattgtttgtatgatttactacatttgtctcctaaacgaactccttgttttcattcttgacctgttaaagcatattccctaaaggccagctaaagggatctgtttggaacatatatgtttatgttctaggccactgccactttcttgatctaatttgtctcacattttgctttgttcactgactttcaaacaaactagtattctttctagtccatcagaagccaagctccttcttccctcagagtatttgtacatttcttctttgcataaatgctctaaatttacatttttcattcaggtattgtattagtctgttcccacactgctaataaagacatatccaaggctgggtaatttataaaggaaagaagtttagttgactcaaagttccacatggctggggaggccccacaattatggctgaaggcaaatgaggagcaaaatcacctcttacacagcagcaggcaagagagcttgtgcagggaaactcccaattataaaaccatcagatctcatgagatttattcactaccatgagaacagtgtggagaagcctcccccatgattcagttgtctccacctggcctcacccttgacttgtggggattattacaattcaaggtgaaatttgggtggggacacagccaaaccatatcaggtatcaagtcaaactttattttctcttgaaggatccccctactgactctcagctttgtcagtaaccagtatatcactatttcttctcagtaattgaacataactgtctgatactagaatgccatatttatctgttctaatattaatagaatgttatatttatttgatttacttatggcccatctttctctccatttgaatgttagttctctgagagcaaggaactcatttgttctgttcactgtatatccaacatcaggcactgagtaaatattcaaaatttattcttccaaaaagtcagcaaatttctgagatcaccccagtcatgacctgtgataaactttaatggcagatatccataagattaaacggcaggttcattgtttccagtcaaatacatgcagcatttacttttgcctaaagtattctattgttttttgctgtgcttgtccaaaattttattttttagtaaataagtgactctttgttgaagcatgaccaggacaaacttaatgtcttcagctggaccatgctttagacaggcttcttccttctctagctaggcccacccagcctctctttccttatagcatttactttagaaaactttcaatggaaaatcctttctcttccctttgagatgtaaatttaagaggctttttagcctcttatccaggactgtctttttcgaagaagtgggagccatccctttgaaatgtgattatcaagaatgatagtgcccctatcttccagtgtctatgaaagctaactagagggagccgtgttccaatttgtaaaactacttcctgtctgaagatacaagtttacacaaatggcctgaaatatcctccttcacctcggctactaataatcctgctgttggtttcagctgaattgagttcagactcagttctggtttcactccccttcaacaatagtgttcaataaactcttcgttgcctctttacctttctccagagccatttttgcttcagcaggttgaattaactaacagtaaaatgcagggatcttaagtggcatttcaagaagtttcaacaaatgtgtgagtccatgcaatccctatccctctctagttgtagaatattctcatcatcctaggaagttccttctcatgtgctttcttccaaactccagcttcatagaaacaactgctgatttatttccaccattatgactaattccatttattccagaaatgcatatgcatagatttatacaggatgtgtgtgctcttttctttctgggttaatttacacagcttgatgtttttgagatttattcgtgatgctatttataccagtattttatgcctttgtattagtgagtagtatgccacagtgtgactatatctgttggttgatagatagctgtggtttctccagttgggggttattatgcatgaggctgctaggaacattcgtgtataacgcttttgttttataaacttacatttttatgtttgggagatgaatcctcaggaacagaattgggtcataagagaaaatgtaagtttaaactgttaagaaactgcctaagagtttcccaaattgcattgctttacattttcatcaacaaagtatgagttctggctgtttcacatcctctccaacatctaatgtcaggctttttaactggaatcattttagtaagtgtgcttagtggctcagtatagttttaatttgcctttctctgattgctaatgatgttaagcactcttccgtgtggttattgaccatttacgtaacttcttttgtaaaatatctacttaaatttttcccatttatttagtggcttcttggtctatatattacctcttttatagtagtttttagtactctgaataaaaattatttgtcacatattttcataaaatatgcttctagaaccttcctccaatacatcaataaccaacccttctctgtagcccctcccttaatctatctatccaacacccattcaacttctaaactttcaacatactcatggatattaggtctcacctacaaaagctcaggtggcctaaacccaggtcacctacattggactcatcctaacccctgtagatccagaaaatctgagacaggtctcagttaatttaggaagtttattttgccaaggttgaggacacatgccactgacacagtctcaggaagtcctgacgacatgtgcccaaggtggttggggtgtagcttggttttatgcattttagggagacatgagacatcaatcaagtacatttaataaatacattgatttggtacagaaaggcgggacaactcaaagcaggggcttccaggctataggtatatttaaacattttctggttgacaattggttgagtttgtctaaagacctgggatcagtagaaaggaatgtttgggttgcaataagaggttgtggagaccaaagtcttatcttacagatgaagcttttagctagcaggcttcagagagaacaggctgtaagatgtttcttatcagacttaaagtctgtgttgatgttaatgccagagaagtataatgaggcatgtctgaaccccacttcccttcatggcttgaaccagtctttcaggttaaagtttaagagtcttgactgaagaggaagtccatttagatggttggggggccttagaattttatttttggtttacacccctcaatctcaggccataccaacctgacaaaaagctaatttgggatatgtcccttcctcatacaaagaaaaacctcttctccttcttaggcctcgtgggatccgtccagctgtgaattcccatcttcagcttactgaccaagccactctacatggcatcatgtgggtccatcctaaaaaccctggacccagcttgccccattaactcccatttcaaaaaaactgaaaaaatgctcttttaatggccccagcactgggactactcaaccccaccaagccctttactctgtatgcttattccaaccaagggcttgctcttgggctactctgtcagacatatggcaatgtcctgcaagccactacatacctctcaacataaccggactctgtcatccaaggttggccatcctgtttaaggattttggatgtggccatgctgctggcctcagaagcacaaaaactaaacatctactaacaccttactgttgcatcctctcataacctacaggaactcatgagccatcactccctcctttccctactgccatcctgcctacagcaaatacatgccttactcataatcaatctttagtcgccttccaaagatgcaaatctctcaacctggccaccctccttcctatgagtacctccaactctgaactgtctcactcttgcttggaccttttagattccctttctttccctttccaacacgtagaagaaacccctaacctgggacacctacatggcttattaatggaagtgcttttaaggaaccacatcctgagtagactacaccatcactgacaaaaaaaatggactcttggagtccaatctcctcccatcccataccacctcccaacaagtagaactagttgccctaaccagggctctcaccctagcaaaaggaaagagggttaatatatacaccgactctaagtatgcatactacatgctacattcccatgtcctaatctggcaggaaagaggttttctgaccaccaaaggaaccccaatagtaaatggcaggctaataggtaagctgctggaggcagctaaactaccactagagattgccattatccattacaaagaacatcaacgggctacaaacaccattgctaagaggaacaccttggtggattcgtagcctagcaggcagctcttaaaatcccctgactactatccatttttttcccagcatacaccctgtatatacccaggaggaacaaacctcactctcccaggctggcgccattcaggaaggagaattctatctcaataacaaaattctcctgcccaagtcccaggaaccctctgttctctcatatgtacacgagcattccatgccacttagtgccccctactccagctcttaaaaacttacatacattgtcccaccatggctgccaatctcaaaggtattactaaggtctgttccatttgcactcaaacttccccctcagggaaccatgaggcccctcctttccccacacaccaggcccaagtacacctgccagaacaggactgacaaatcaacttcacccacatgccccctgtaaaactggtccagtatcttctgacaatagtaaatacatccactggataaacaaaatgttttcctactaccaccaaaaaggcacacactatcagttctattctcttcactcatattattccccagtttgaactcccctcttccacccagccagacaacaggtcagcatttgtttcataggttaaccaacagctggtagaggctctaaacatcaaatgagtcttccatatcccctaccacctccaatcttcaggtaaagttgcaccggccaatgcccttttaaagcagcaactgaccaaactctccctagaggttaagatggcctggacttcacttctcccattggccctcatgtatttacaagccattccctgcaagcccctcagcctaagcccatttgaactcatgtacagacacccctttatcctccagaatctctctctattccccttctgtctatatgggatacttggccagcattacacttcattaaacatctaataaaacactacgctaacacttacttgcccaagcctgaaggctgatcctctgaatactcctccccctccctgcaaccaggggactgagtctggattgcagactcctcctcccttctccaaactaagtaaatgggtcctcaccaagttatcctaggtatttccatggtggcaaatctagcatcttttccacaatggatacaccattccaaactaaaaagagcaccagacccacatccaaaaatttccttaacccaaagatattcttcctccctcaaatcactgcacttaacaagaattccagaggttgtcagccctaaaggccctggcccataacactttccatctccaattttaaatctttcatttgataacttgtttcagatctttcctggtacccctttcccatgtcctgaaacagtccacttcaatttctcacactaatccagaagctatggttgcaaatcaccttccaaaatttcactcctactcaaatctccctttgctccctttgtcttctttgtttgtgagatgctctaagtccccacccacaacctttgacagttgagcaccctttgccaacctaatgcactacctcctcagccaagcccagtctcccctctcctctagttgctgaatatgcttatccacacaaacccaacagttttcctgccatccccacagacttacacacctggactcagtctagcatgaccctgcacctcatatataaggctgttccattttctgaaactttttataccctcggccatctaaacaccttccccccacagacatttttttcttttcaaaactctaaactcagggccgttaccctcctatgactccttactcctggtctatccctaatacaggcaaattccctcagaccacccactggaagtttcatttccacccagacatcactcacagttcaggtccccctctgcttttgcagatctttctccaaccccaaccatgggactctggtgggcagtctacctccatccctgtacaactttaccctcactttcaacccatgtcaggatcatcaaaatcaccaaataaatcactgaacaggatcttcctcagccttcaaaaatccactgcgattttctgcaacccccccttccatcttggcacccacttcttccatctcctccccacctctctctgtaggcgagactcacatgtactcaggttgaggaaatccactggagggaatgcaataactcctctctctcatgcttcctcctgcctagcccttcttccaactcacaatggctgttaatggacaaaacccattatttcctttttacaaaatcacacttccttcactccttcccccactaacatactttatcagtcactcaccagagctgtccttgaaggtaacttttcaatatgggagaataagaaaaatgtccaagagggtataaggaaaatggttgtgcttcagtcaggagtaggctgaggcagatatctggtacagcatgacacagcaggtttcgagtgcaggtgcataaacccctgctctatgtaatcagatttatgtagccatttaatgtaacctgtttgtgtgagctcatatctggctttgagtctcttttgtctgtgagaaatataactgcactgctgactctgtaggagagagacagaataaagccatgtcccaactgcctacagtccctcgagtgtactttcagctacctgccacctgtccaccagctcctctcaggccccagctcggattggaacctgacaattgatgtagtcatcaggatacagagccatgctgctaggatgggctctggtgaaaacatgggtggtggtggatgggtcccctgtgagtatagagaaggcactgaagcacctggaagcatagagcactgagaaggagcacgcctttgccagcagagttggatgggcatttttgactgtgatacaggaagtgcatgctcagtccctgtgggatgcagtacaggtaagggatttccagacacaagcaggacacctggaggcccggatacacagcttggaatgtgaattaggggctgctgtcctcactccatatgtggggcgtcacatacatgaggtgactactgccatggcagccctcagggaagcagagggccattggcaggactgggggtatgtgccataaaaaaggggaaagcaccacttctgcaggggaccacctcatggaacaagaaggggcgccagcaggttacccacatgcagatatgggttgatttaattttggctggggttgccagagagaaaattgataggcaacccaatgaagtgctgttaactttgtggaggcaattgtccccaaagcagcaattccagaaaatgggggcaggatgatgctgcttgacccagtctcacccagctgttccagctcaaggactacttgcagacaggtggtggtatagagctttttggtttgattagggagctggccaaggtgcctgccttgagggggacaccggatgactgaaggccacatgtggaattggcaatccactggtgagccctagacctactagccgctgagaaaggggacacatgtatatatctccaagaagaatgctgcttttatgttaatgaatctgccattgttcatgacgcagcccgcaggctccttgatagggccacagaaatccaacgtcaagtcagagacttctagtggcaagggtaatcccttctaaaatggatgatgtgggttgcccttttctttgggcccctaatctttttccttctgtgactaacaattggccagtgcatacttaatgttatatctcacttcatctcccaaagactgaactctcttatccaggcaatcacccagaaatgtattgatactgtcctcctcctccaccaagtccattgtcagagcctccaggaaagcgactctgaaatcaaacacctaccactttaaaacctgaaccctgattacaatgcccctattcagcaggaagcagccatgtccccttccttttatactaaagtaaaggacaggaatgttagcccaacctgtgccatcttgtagaccccgccattttacacaccctggacagagtgaaaaattccactgggtctgggccatgagaaacatcctgttgggcaggtcccaggactaagtgcctgaccatgggaaatttctctcttagcagcagctacccacaccaccccgtcccattttgcaacactcccctacccatccagacctataactgccctcgtctataagtggggcttgggctttggcactcgctgttgtccccctctgcaagcatcttcctccaataaacctgtgttgctgtggagccatgcctcccacccccttgtctctgtctctttttcatcccaacaattatgagcctatatcctgtcttcattcctgtggctttattgtaataataaaattcagatatagtaagtactcgaactcagttcctccatttcaagattgttttggctattctagtctttttatatttctgtatgttttacagaccatcttgtccatttttacaaaaaacaagcaagctaggattttgatatggattgtactaaatctctaccccaacttgaggagttagatttaattgtgtcttccaatacatgagtgtgatatgtatctgtatttgtttaggtcttctgtaatttctctcaacaatgtttcccacttttcagtataaaagtagagagacatttggtagacaagtagacatttggtaaatgtctaatcacgttatggttttagaaagtattttcatattgtaattttattacatttcccaattattcattgttactatatagaaaaacaatatatttttatatttatttggtattttaagactgctaaattcacctagtaattatgattattttttggtaaattatttaggatattctatacagacaattatatcatctacattttcttgttatctattgcaacttaattctctttcaggtaaccagccaagcatgaaagccatcctgtgtccattcttttatagagtagagatagtcatttttggtatttagttcattcttttttttttttttttgcaaactctgctctctgatgaccttagaagaaaaaacaagtattttttttttagttggcttattctcattagtaggggaggagaaattctcatttgaaaacttctccagcctaagaggaagcagaaatcctctttttattgtggttctttgtaattataaaatcaatattatgtttattattttaaaagtttgtacaaatacaaagaataattaatgttatactaatggtcccaccaccaaaaattaaaaaaaaaatccttataatgccattagttaatttttgtaagattaaagcattttaaataaaatcaaagaaccacaaacctgtcctcactccaccctccccttgtcctcttattcccagagatttcactgctataaatttactgtgtattcacctcacactttaaccacaggcataaagcaataaagctaatattacttctaaaaaattctgctaaacagtatcatagtgtgcaaataactctgttttcaaaaatgatacttttcaagatttatttatgttcatatacagatctaattaattgattttaacatatacgctattataaatacatcttaatttatctattatatatgataaacagttagataatttcctttctttcctttcttgttttttgttttgtgttatttatttgtttgttttggtaatcacaaccagagccacaatatgcaacattttattaattttctgaaacacatgtattagagtttcttcaaggtccataccagtctaataggaattttctgtgataatgggactgttctatgatctgtgctgttcaatatggtttccattaggcacaggtggcttcctgagctcttgaaatatgggtagtgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaagaaatatgggtagtgagactgaataactacatttttaattttattattatttttcattatactctaagttctaggttacatgtgcacaacatgcaggttgttacatatgtatacatgtgccatgttggtgtgctgcacccattaactcatcatttaacattaggtatatctcctaaagttatccctcccccctccccccaccccacgacaggcccgggtgtgtgatgttcccctcctgtgtccaggtgttctcattgttcaattcccacctatgagtgagaacatggggtgtttggttttttgtccttgcgacagtttgctgagaatgatggtttccagcttcatccatgttcctacaaaggacatgaactcatcattttttatggctgtatagtattccatggtgtatatgtgccacattttcttgatcccgtctatcattgttggacatttgggttggttccaagtctttgctattgtgaatagtgctgcaataaacataatgtgtgcaagtgtctttatagcagcatgatttataatcctttgggtatatacccagtaatgggatggctgggtcaaatggtatttctagttctagatccttgaggaattgccacactgtcttccacaatggttaaaccagtttacagtcccaccaacactgtaaaagtgttcctatttctccacatcctccccagcacctgttgtttcctgactttttaatgatcgccattctaactggtgtgagatggtatctcattgtggttttgatttgcatttctctgatggccagtgatgatgagcattttttcatgtgtcttttggctgcataaatgtctccttttgagaagtgtctgttcatatccttcgcccactttttgatggggttgtttgtttttttcttgtaaatttgtttgagttctttatagtttctggatattagccctttgtcagatgagtagattgcaaaaattttctcccattctgtaggttgcctgttcactctgatgaagcaggtttctttcgctgtgcagaagctctttagtttaattagatcccatttgtcaattttggcttttattcaattaggaaaagaggaagtcaaattgtccctgtttgcagatgacatgattgtatatctagaaaaccccatcgtctcagcccaaaatctccttaagctgataagcaacttcagcagagtctcacgatacaaaatcaatgtgcaaaaatcacaagcattcttatacactaataacagacaaacagccaaatcatgagtgaactcccattcacaactgcttcaaagagaataaaatacctacgaatccaacttacaagggatgtgaaggacctcttcagggagaactataaaccactgctcaatgaaataaaagaggacacaaacaaatggaagaacattccatgctcatgggtaggaagaatcaatattgtgaaaatggccataccgccaaaggtaatttgtagattcaatgccatccccatcaagctaccaaagtctttcttcacagaattggaaaaaaactactttaaagttcatatggaaccaaaaaagagcccacattgccaagacaatcctaagccaaaagaacaaagctggaggcatcatgctacctgacttcaaactatactacaaggctacagtaaccaaaaaaagcatggtactggtaccaaaacagagatatagaccaatggaacagaacagagccctcagaaataataccacacatctacaaccatctgatctttgacaaacctgacaaaaacaagaatggggaaaggaatccctatttaataaatggtactgggaaaactggctagccatgtgtagaaagctgaaactggatcccttccttacaccttatacaaaaattaattcaagatggattaaagacttaaatgttagacctaaaaccataaaaaccctagaagaaaacctaggaataccattcaggacataggcatgggcaaggacttcatgtctaaaacaccaaattttataaattttaaataaacataatttaaatagctacatgtggctggtgtctaccatatttagagagtacaggtctattccaaggaacagaattattagataatcaggtatgcatatttaagcattactagctaatgtagaattgctctccagaatagactccaatgtttgttttcaactgcctgtaatatgcaatgatctatttccccatctccttggctatatacttagttttattagtttatacattttttagataatttgatgagtataaaattgtatctcattaacggttgatttgtaattccctttgtggtgctgtaatactcatacatctatcaaggactcttttttcctccctttaaaattatctacttattttttctttgtaagcgtcatctttttttcattgtgggagttcttcataaacttgtcattttacttgataaaaggtcatacttaaaagtctgaggcttctcattcacttgaatctgtagtcttttgttacatagttgtttaaatttttgatacatatctatattttccctcattgtttcaagtgttagtgcctttcctaaggaaccttttcttattatgatgtcacaaatgtattctgctatgtctactgggagaatacactagtggggatagttctgtgtatacagtgattaagcacataggttctggagccagtctgtttctttcaaaatcacctcattgcttttgaagaatcaggtaagttagtcaacttggtgtttcagtgcctttgtctgtaatgacaaaaaagatagaaatgacgatattaataatacttacctcacagaattgttctgaggtttacacgtgttaacaaaatggaagagttagtacaacattcagcatgctatgttagctattatcattctaaatgtttagctgtgttttctttttttggttggttactgtacatatattatatgatgaatctgttctatcatctttcacatgcatatccaaataactaaacattcttcagatgaataatgtatattattttcatcttgaagtttttgtctatataattttagatattcttttctgttccattgctttctctatttttgtgccaaaactgttattttatttagcataaactttatagcaagccttgaagttctgttcagcaaatttttctgtgctcttattttttttttgtcttaaaattttttttggctacttaatccttataattctgcctattagcattgcatcagtttgagttttgtaatgacattaaaaaggtatttatgatatcagtattcctcaccataggatatttattcatctttagttcatttttatgaccttcaaaaagttgtttaatttttcccataaaagctttgtagatatatatatatttaaaaatactctctttggtggttttttgctatttaaagtaggtttatactgaaattataattttaattgtctgcaatatatgtagaaaattattacttatagttgtatgttaaccttttctacaggcattaatggttatagctaggataaacatcccattgggttgcagcagcatctggttgtacttaagctttattactggcacctgaaaattttcattttttttctttctagctcagcaatgtatttaattttttaaagatatggtttatactatattcttcccagaaaagaagagaagtctgttggtttgggtccattctttcataatgtttgaacttaaattctctatataaattttaaaattattgattcatgttccataaataactgaagatttccttcttctttcataaatatgtaaataatttgtagctaattatcttttcaatattgaatgttcttctcattaaaaataatatgtcccaaatcatacagatatttatgttcataaataacattttgttctagttatttcccagttaatattttttaattattgtatattttccatctactatagtataacttggttatttctgatggacaagaatgaggttttttttagatgtaaatcttcaatccaatgtatttggtcatagaactgtgagttaacaaatactgttttaagctattaagtttgtaataatttgttatgcagcaatagaaaactaatacaattgacttgcttctaactttaataagttaaatgctctacaattatgtcagatgttttctttaggatcctagtaaatatattttatcaaattaagaaactttgtttctgtttctcatttatgattgtttaaattaaaaatcaatgtaaaattatgtttaatgcttttctgcatctgtaatataatcatatcatatttctcttttgatatgttactctggatattagtagtgtttcattttctaatactgaatctgccctgcatttctggatcatgattacatttctattattctatattaagctaataatatgtacttgtcacttatctctagaatctacctatgatgagtgttttctcttagttttatatcttactggacattatttgaatcatcttaaggcactgggtagaagtacttagacaggtatgctcaggttgatatcccatccagaagttgtaataattttcttgtcaaagttcatctttgcccaagggccttgaagtgaataaaaactatggcaagatactgccataggttggggttttttttgagcaagcagatttgaaaacagttgagcacacagttgagcatccactaacacttgtggaagggaagggaagaaagcaggattgggcagagtaggaagtgaagctacctgcagtcccaatatcagtgtcagcctgggcagttcttgagttagaatggccatccagagttgtctagactgcacgtgagccatcccaggaaggacataacctcgcggaaagtggctttctgaagctgagacaattccctgaagtgctgacatctgaaagctgtctactgtcagcactcccagcaactgggacaccaagtctttccttgaaatgagagttgggttatacccagagtatccactacagacatgtatgaagagacaataaaacaaaacttctgcagacttgaatgatccattcaggcaaggacaatgctgatgttggctgtcctaaatgggatggcctggcactcttgaaaaatctcaaatacattaaaaggaaccttgtgtattaccatagatataaacatattatgcattgctttgtataatgcacctcttgcagaatgactatcagatattttcagtgtttagagtttcttccttctctgaaatgtggaaggcttatcatggcctaagtaaccttccagccaatgagaggtaggaaattattacatatcctgagccataattattccaactgcaaattttataaaacaaaagtaaatatcttctggtatgtgaggttttagctgcaacaaggctctcctccagtgccgtgccacctggatggtatagcttaggatctgtgcagacaagagaatgtcaagtttctctccagcccagctcaaatggacaaagaggtcattttatattttatcacctaagaatttgatttgaaaagaggatcagaaaccacaggaaatttgatttatgccagccctgcatccaaggtacccacagaagaataatatacttgtttttatgagatagtactgatccaaatgggggcacaatataaaaatggcttatggtttggccacagggtcagtccaaaggtcaaagcctcaagtacagttcatttgttagcagatttcagaacaactaatttcacctgtattggatttatttttccagcctcttcaaaaccattttgtttagatttatatcacaacttccctctctttttttccatttattaaatttgaaaagctttccaaatactgtttcaccaacttgtaccactatacaagtgacaaaacttttattaaaaccatttttttttagagtaaatctggaaaataaggaagtaaaacaattactttgggtctgagttttgatggataatatagtctagtttgaaaacctaactacacacatttgccacactaatatttttgtatactttggcaaatggttaatatctttaataaatggttaaattccaagaaaaattttggctcacaagctttatttcatttcttatgttggacctttacagttatcagtccaaactgttgatgattcagtgtctgatatattctgccttccagaaaactttaatccttcttgtttacctcaaagttcaatataaacacattcagtgcaaagtcttatctaaaattcacgttgttgaaaaagacattttccttattcatgtaaagttactcatgtaaaaatatgaaacatcaagagtagtgtctcataaattttgtgtttcaaatggaaagactttacatgacttagacttaatatggcttagattgtgtggctaaaaacataaataggtaataagtcaaaacaggctaagtggttattgatatccattgcttaatttagaatatgacaacaatgatttatcttatatttctttttgaggagaaataataggatgcagaagagattcagtatttttagaggtaaccagaatgcccttggaaagttttctttttttttttttttccagagatggggttttgacatattgcccaggctggtctcaaacttctgagctcaagtgatttgcctgcctcggcctccccagttgctgggtttacaggcatgagccagcatgcccggccccttggataagatttttttttttaatactttaagttttagggtacatttgcacaatgtgcaggtttgttacatatgtatacatgggccatgttggtgtgctgcaccaattaactcgtcatttagcattaggtatatctcctaatgctatccctcccccctccccccaccccacaacagtccccggtgtgtgatgtttcccttcctgtgtccatgtgttctcattgttcaattcccgcctatgagtgagaacatgtggtgtttggttttttgtccttgcaatagtttgctgaggatgatggtttccagcttcatccatgtccctacagaggacatgaactcatcattttttatggctgcatagtattccatggtgtatatatgccacattttcttaatccagcctatcgttgttggacatttgggttggttccaagtctttgctgtagtgaataatgccgcaagaaacatacatgtgcatgtgtctttatagcagcatgatttatagtcctttggtatatacccagtaatgggatggctgggtcaaatggcatttctagttctagatccctgaggaatcaccacactgacttccacaatgattcaactagtttacagtcccaccaacagtgtaagagtgttcctatttctccacatcctctgcatcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcacccactttttgatggggttgtttgtttttttcttgtaaatttgtttgagtgagctcattgtagattctgaatattagccctttgtcagatgagtaggttgcaaaaattttctcccattctgtatgttgcctgttcactctgatggtggtttattttgctgtgcagaagctctttagtttaattagatcccatttgtcaattttggcttttgttgccattgcttttggtgttttagacatgaagtccttgcccatgcctatgtcctgaatggtattgcctaggttttcttctagggtttctatggttttaggtctaacatgtaagtcttgaaaccatcttgaatcaatttttgtataaggtgtaaggaagggatccagtttcagctttccacatatggctagccagttttcccagcaccatttattaaatagaaaatcctttccccattgcttgtttttgtcagatttgtcaaagatcagatagttgtagatatggggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctctttgttggttccatatgaactttaaagtagtttttgccaattctgtgaagaaagtcattggtagcttgatagggatggcattaaatctataaattaccttcagcagtatggccattttcacgatagtgattcttcctacccatgagtatggaatgttcttccatttgtttgtatcctcttttatttcattgagcagtggtttgtagttctccttgaagaggtccttcacatcccttgtaagttggattcctagctgttttattctctttgaagcaattgtcaatgggagttcactcatgatttggctttctgtttgtctgttattggtgtagaagaatgcttgtgatttttgcacattgattttgtatcctgagactttgctgaagttgcttatcagtttaaggagattttgggctgagacaatggggttttctagatatacaatcatgtcatctgcaaacagggacaatttgacttcctcttttcctaaatgaatgccctttatttaagatttttttaaagataaaaataagactgtagtgggagatgaacgatgagaatacatggacacatggggcagaacaacacacactggggcctgttgtggggagcagggggagggagaataccgggaagaacagctaatgggtgtggggcttaatacctgggtgatgggttggtctgtgcagtaaataactgtggcacacgtttacctatgtaataaacgtgcacatcctgcacatgtaccctggaacttaaaagttgatgtgaaaaaagaaaacatacacacacacacccatacacacacacacacacacacacacactcacacacacactaaggatttccagaattaattcaatggataattagctggttatgaagccaaaaacatggccctgcccctggtttatagagatatagatggtatagatatagatacagatatagatatagatatccataatgtgaataaaaatagggctgtaagaccaccgatctagaaaactctcagaataagcagaaattaagtcatgttatttcccttcaggttagtgcactgaccatatattgagataggctgtgacataatgtgtattggagttgaaatactcacagttgccaggcgcggtggctcatgcctgtaattccagaactttgggaggccgaggcgggtggatcacgaggtcaggagatcgagaccatcctggctaacatggtgaaaccctgtctctactaaaaatacaaacaattagctgggcgtggtggcgggcgcctgtagtcccagctactcgggaggctgaggcaggagaatggcgtgaacccaggaggcggggcttgcagtgagcggagatcacgccactgcactccagcctgggcgacaaagggagattctgtctcaaaaaaaaaaaaaaaaaaaaaaaaaagctaaaaagaaatactcctagtccccattatttagaagagattagattcttagattttcttaaactaaaattaaagaagtatatctgaactccacagagtggaaaacatgtcttaatgagtactcagtggttgttaaagtaagggcaatgactagaacaaaaactaagaggaaaacatgccaatccatcttgctagaattttaagacaatatgccaccttcattctctctttctctctcttttcctctgtcccctaaactgtatgctgctcattacctgtcttgcctccctcccttcatctccccagcttgacacactttcccttattttattatatgatttattcccatttgtggaattttccaagtgacatggagaaaaggttatcctggggcttcatcaaaattcttctctaagactgtaagaataaattaaagcaggcgtgtggcatctctgctggtggggaatggctacccatgtttaacagtgtaacttaatattaacaaaattaattgctaggcttgagtactctccagctcacatcaaaagtcttcagcctactgttccaagtatatattttcagcatggttttctagtctatataatgtagatactaattaagtcctgtggtcatttttttccaataatagcttgtttccaatagtaggaatggtttttattggtttaacttatatttttctatgtttatcatcacatctcttatgtctgattccaatttaccaattattacggtttaacagccaagttttaaatattaattatatttatgttttaaatatatttgttatatatactatatataacatgatatatagtatatataacatgatatatagtatatataacatgatatatagtatatataacattatatataacatatatagtatatataacattatatatatatatatatattatatatatatatatatatatatctcccagaaatttgacaacattttttattccaaaaataaaagcatccagcaaagaagccaaaaacatggccctgctcaggtttaaaccatctgacttcagggacataattacaggcagaaactgacttaggtccaattatgtgcagggatctagctgggtgcctcctgtttcttcaaagatgagtagccagaattagaatttaaattgtcagctcaaagaaacacaggatgtatttagtttctgctagttaaagagtcatctgagaacccagaagggaagactcatgtcattgatatatttctctgagcttgatcctagtttttaggttagaaaggggtcctaggttcctgagaaactgtaaacttaacactcttttcaattactttgtactttatgaaataccttatggccagagcctgctattcaatgcaaatgaatgtaactctattctcccacattgcacataagggatggagtgtggaggggggagggaaatggaggggaaaatgaaaatctcttgaaataataatagtaattagtttctctatttgaaaactctaagtttcattaaacagcaataataaccagcagtaagtaaactgccacccccaggagagggaaaaatgtcaaatttcatcctaaaaagacttgtgaaaacacaggcacagtcaattccattttattctgaagatttatttcataccagtcaaaattaattcaaacctgtctccctgatgcaatgagtgtgaagaactaaacttactgtcattggattttgctacatctcaccatctctaaatattgaatatggatggcagaaaaaagctattgtttgaaatttgtgttaaggaagctttagttcaaaaaaaatgctgatacaatagtgtgtgagcatatgtgtgtgtgtgtgtgtgtgtgagagagagagagagagagagcgagagagaaccagagagaaagaaccagggaaagagagaaaaagagagagattttccttttgggggatctatttctgtatatacacctctcctttgtatcatataaatgtaataaaaccagggaaggggggaggggctcattttagccttcctgaaagaaaggctttagtgctaaatgttatgtaaaatgatttcactcaccactaaagaagtgacatatttgaaaaatgatacggcagttctttgaaattcactaaggagttccagaattaattcaatggataattagctggttatggagccaaatcacaacttgcatgttgcaattaaaatagtaaacaatcatttcacttactgtatgactgttttccttgtgaactgaaaaaatttattacaaaatatgaaatcagggaacctagaatgtacatatttacaggtatttatggaatctcaaattctattccaggtgaatttagaaaaaaatagtttaaacaatagtcaatattctttctttgacaaggcaggtaccctaattccgctacctgaagttggcataatatctattaacagctaatgccaaaatcaaaaaaattctataattcacataatataatagacaataatgttaatgataggtaaaatgtatgcctaattcatttaaacagattcccttctcttatcacccatcaatccaattacagcaaaacccaaattagtaagcttttaccagtatcatgcattgcatacattgtactaaatgagaacatagtatatacacataaagaaatgctttcaagtgagtttgaactacccttcttttggggctccagaacaaatcagcacccatttggccttttaaaatccattaaaaggttggtcagtatcttcttagtgattagtaaggcagccaacactctctcccatgctttgtcaaaggtcagacatattgcatgtcttgtctctcctaagaggggtttgtccatctttggaatctttaaacatgattcaggtttactagcctcagctctctgatgggctcaaaaaaagttatgattccaccaattatctagatttttcttgttgcaagtgaagaagacactattttaatagtttcctacatactatgcagaactagaggtgacctaataaacatttgtgtgtgtgtgtgtgcgcgtatatatatatatgtatatagtatatatacatatatacacatgtgtatatatacgtatatacacacgtatatacgtatatatgtatatatgtatatatacatatatacatatatacacgtgtatatatgtaaaaaaatacatacatacgtatatatgtatatatacatatatatacgtgtatatatacacacacatatatatataattttttttttttgagatgaagtctggctctgtagcccaggctggagtgcagtggcgctatctcggctcactgcaagctccgcctcgcgggtccacgccattctcctgcctctgcctccccagtagctgggactacaggcgcccgccaccacatctggcttatattttgtatttttagtagagacggggtttcactgtgttagtcaggatggtctcaatctcctgaccccctgatccatctgcctcggcctcccaaagtgctgggattacaggtgtgagccaccgtgcctggccacacttgtttatatttttaattgttgtaaacattgttcacaataggtacataatattccacagcaattatctaccataatttacttgactattgcactgttgttaaatgtttttttccacttttttaccattaagaaagaaattgcagtaagtatgtttatgcacatagcttattttttattcagtattacttccttaggacaggtccataaatacaaaatacttctttaaaaaagaatagggtcagactccaactgatgggtttgaatcaagttctaccattgattgtctgtattcttcaggtagttgggtaaccctccaagcattttttgtaaaatattttcattttgcaaaataataatagtagcatctgtctcttaaagttgctgtgacaagtaaatgaaatagcacaaatgcagtgcctgggagtggatcatcataagggaagcatgcaattattgttattataagataatctttttatagatttttacaaatgactttccataattattgagcatttcacaccatcctaaaatgtttaacaaaggcctgcctttagaaatcttttatatttattttcatccagaaaacataagttctcttatgtacattgttttattatcacatatgttgtatgatatagtcaaaacgccagggctatgtatgaaggcaaatatacttgggatcaaatcctggtttcgtatttaaccatttacaaacttggaatttatttttaacttctcgattttcaagtccctcatgatattaataattactcctagtcattaaaaggattagaaataatataggtaaattacttagacatattgcatactcaaaataggcttctcatcctaaatgcacattagaattacctagagatctgatgtccagctgcatcccaagccattcccatctaaatttggaggctggccccaagtcagtatgttgttacccctccctaggtgagacaaatagtcagctggtcaaaccactgcctccttaccatattataggcttaataacaaccaaaatgcataaatgactttataatttacatatcacttccataaacataatgggatttgattactacaaaatatttgaagcattattttcattgaaaattcttatatttttacaaatgtaagtggattatgaactatgataatgagtaatgttggcacaattccctttgctctatctcaaattcatggtatttcatgttagctcataaaattgacaccagatctgtttacaaatctcttgtcacatttatatcatatatcataacacctcaagcacaaagtttttatttaaaaaagccagtcaaatccttcacaaaatctctgattttcttctgcctcttattcagtgacctgatcatagatacatagacagatggataaatagatagaataccaaaagttgcaaataacttcatcttatatgtaacctgccaccccccaccctttctttgctatgaacaccaagaacctaggtctataggcattaaaaacactgttgaaacttgaaaagagtaaaataattggttgggatttcagaaacactgatcttcatacagaatccaacagaaaggccctactgatgaatgaagaagtggctttctagattattgtaaaacaatgattttgtaaaacagcatcatgtgttactcccttccactactaaaaaaggtacaacatgctttttctggcccctctgtgtatgactacttgacttagataactcatattgtcctgtaagtttttacagctcagttcttactggattttgtattagaaccttataatttaagaaaataaaaaaggtattttcttggactattgaaaaagtacctgtttggggctatttcaaagatacatggagtcccaacatattaatacttgttaaaataagagtatcggtgacataatggtatagcttgaaaagcaaacaatatatctttaaaataaattatacaggtttaatagaaaatgatacctcaatatcactggccaatgtgatataaaaagtctagctgcatttagccaatagatgcgactattttggcctctaaaatttctactcctgcttctaagtgtccttgttgcctgtttttagatatcacaatattatgaaacattccaaaagatgcatacaaaataaaactcttctgctgactcagcttctgttgtatctcaacccaataatgatatgttgagaattaagactctgtctactatagcatatattttaattatacttttataaacctgaataaaatataattaaaatgtacttactatagagctacaatagagctacaatatgagaagtctattattttaatgcacacattatagaaaatgtaattgacttcttaacaaaaccagaaactctgcctcataaccaggaaaattaatctctacgctgggtagatttattaggagttattattatcctaagctaaaaagttaaaacaagtaaatattttataaggggtcattattaacaaatgtacattgattccctcctcttcccagattttttccaccctattgttcacttaagggaaaagcaggttgatttacttatttcaatattttcttctcaatttgtgtctggaaagtaccttgtgagtatgatctctaatgtttcttgctgacatgtagcaggattattgctgtagatttaggaaaacagaatcccaacacagtgtacaagatggtgctccatgacatgccacttccaaagacataaatttttccttagcaggagcacaatgcttcttgttattgtaaccaaattctcattgattaaaacaaaaactcagcctgcataagtaaccagctgcaattagttatttaagctgtatctactacacaaggcaatttttatacagtagtgcaagcaaaaaaagatcactttatctttctttttctatctatcattataaatccagagaaaaattaatggttcttcagaaaaactactttttaataagtcagacattcttggttaaaacaaaaatgttgatgaaatgtttagtatggtttaataaaaataaaagctaaagtatatatggagttggggggttttattcaaataatttatgacaatcatttgatgaagaaaatcttattaactattttcaatttgggaataaagaggtagctaattacctcctcaaaataggttaaaacatgggattaggttgctcaagagagataatagttgtttacaagaaatacaatttctatgtctgtaaatattttagctgcttaagtgtagtaatccaatagacaagctgtctgtatttttaaaatataaacaggataatttacatttgacaatgtctagtcagtataaagccaaaatgttgctagtcagaagttgtcaggggtaattgacttcaaccttatatttttctttttaatacctgacaatttacaatatgagctttcccttggaaacctcctcattttctctggactgtctgcccggaggaacaccgagtggctaattcacagtttgccttcagtaaattccgtgaactggttgttactagaaaagcaatgtaatgcttgtgtgattgatttagtcaggtaaaataacaacgtgtgataattggtcacttgtggttggaatactagcacagacttccacatggatatcataatcccagtgactacttgcccatattaggagagtctggtcatctatgaaagctaacagccagcaagggaatggctaagatcccagcggtgagtgtataattaattcccaaggactccacaggacactttctcttctctccagaactttatagatgaaggcagagtattatttgtaaaagctctctgcttgtcctcagtcaaggtcatgagaatttcagaaataaattcacaaaatggatgcactgcactcaacatcttcatgtgttaaagatacaaataaaatttacctggaaaaaatagccactgatcatagacagagcagaagtactttcaagaagactgaatccatgctttgcacaattaagcagtgctacccacccagtgaggatgccttatagtagctcatattttcataacaaactgactggtaaatttaaatgaaaagtttagtgggtacaacagtgagtgacctgctaatgagttgttaaatcaaagaaataaggaaagtaagataaaaagaatagcttatttaagcaaaaatcacaagtctaataagacacagcggctacatagcagtttattctaatccaaagctatacttcgatttataaaaagggagaaaacctacataatatcctcaataaatgtcttccatgtctgttgggatagaatgttgcagtagttttgctatagcttcaaattcaaaatgcacaatattaagtttgttttttttaatttaatttaattttattattattatactttaagttttagggtacatgtgcacaatgtgcaggattcttacatatgtatacatgtgccatgttggtgtgctgcacccattaacacgtcatttagcattaggtatatctcctaatgctatccctcccccctccgcccaccccacaacagtccccggtgtgtgatgttccccttcctgtgtccatgtgttctcgttgttcaattcccacctatgagtgagaacatgtggtgtttggttttttgtctttgcgatagtttgctgagaatgatgatttccagtttcatccatgtccctacaaaggacataaactcatcattttttatggctgcatagtattccatggtgtatatatgccacattttcttaatccagcctatcgttgttggacatttgggttggttccaagtctttgctattgtgaatagtgccgcaagaaacatacatgtacatgtgtctttatagcagcatgatttatagtcctttggtatatacccagtaatgggatggctgggtcaaatggcatttctagttctagatccctgaggaatcaccacactgacttccacaatgattcaactagtttacagtcccaccaacagtgtaagagtgttcctatttctccacatcctctgcatcacctgttgtttcctgactttttaatgatcgccattctaactggtgtgagatggtatctcattgcggttttgatttgcatttctctgatggccagtgatgatgagcattttttcatgtgttttttggctgcataaatgtcttcttttgagaagtgtctgttcatatcctttgctcacttcttgatggggttgtttgtttttttctcgtaaatttgtttgagttcattgtagattctggatattagccctttgtcagatgagtaggttgcaaaaattttctcccattttataggttgcctgttcactctgatggtagtttcttttcttttgctgtgcagaagctctttagtttaattagatcccatttgtcaattttggcttttgttgccattgcttttggtgttttagagatgaagtccttgcccgtgcctatgtcctgaatggtattgcctaggtttccttctagggtttgtatggttttaggtctaacatgtaagtctttaatccgtcttgaattaatttttatataaggtgtaaggaagggatccagtttcagctttctacatatggctagccagttttcccagcaccatttattaaatagggattcctttccccattgcttgtttttgtcagatttgtcaaagatcagatagttgtagatatggggcattatttctgagggctctgttctgttccattggtctatatctctgttttggtaccagtaccatgctgttttggttaccgtacccttgtagtatagtttgaagtcaggtagcatgatgcctccagctttgttcttttggcttaggattgacttggcaatgtgggctctttcttggttccatatgaactttaaagtactttttccaattctgtgaagaaagtcattggtagcttgatggggatggcgttgaatctataaattaccttgggcagcatggccattttcatgatattgattcttccaacccatgagcatggaatgttcttccatttgtttgtatcctcttttattcctttgagcagtggtttgtagttctccttgaagagctccttcacatcccttgtaagttggattcctaggtattttattctctttgaagcaattgtgaatgggagttcactcatgatttggctttctgtttgtctgttattggtgtagaagaatgcttgtgatttttgcacattgattttgtatcctgagactttgctgaagttgcttatcagtttaaggagattttgggctgagaaaatggggttttctagacatacaatcatgtcatctgcaaacagggacaatttgacttcctctattcctaattgaataccctttatttccttctcctgcctaattaccctggccagaacttccaacattatgttgaataggagtggtgagagagggcatccctgtcttatgccagttttcaaagggaatgcttccagtttttgcccattcagtatgatattggctgggggtttgtcatagatagctcatattattttgagatacatcccatcaatacctaatttattgagagtttttagcatgaagggttgttgaattttgtcaaaggccttttctgcatctattgagatatcatgtggtttttgtctttggttctgtttatatgctggattacatttattgatttgcgtatgttgaaccagccttgcatcccagggatgaagcccacttgatcatggtggataagctttttgatgtgctgctggattcggtttgccattattttattgaggatttttgcatcaatgttcatcaaggatattggtctaaaattctcttttttggttgtgtctctgccaggctttggtatcaggatgatgctggcctcataaaaggaggttttttctattgattggaatagtttcagaaggaatggtaccagctcctccttgtacctctggtagaatgtggctgtgaatccatctggtcctggactctttttggttggtaagctattgattattgccacaatttcagagcctgttattggtctattcagagattcaacttcttcttggtttagtcttgggagggtgtatgtgtcaaggaatttatccatttcttctagattttctttttctttttatactttaagttttagggtacatgtgcacattgtgcaggttagttacatatgtatacatgtgccatgctggtgcgctgcacccactaactcgtcatctagcattaggtatatctcctgatgctatccctcccccctccccccaccccaccacagtccccagagtgtgatattccccttcctgtgtccatgtgatctcattgttcaattcccacctatgagtgagaatatgcggtgtttggttttttgttcttgagatagtttactgacaatgatgatttgcaatttcatccatgtccctacaaaggacatgaactcatcatttttttatggctgcatagtattccatggtgtatatgtgccacattttcttaatccagtctgtcattgttggacatttgggttggttccaagtctttgctattgtgaataatgctgcaataaacataagtgtgcctgtgtctttatagcagcatgatttgtagtcctttgggcatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttcatttgcatttctctgatggccagtgatgatgagcattttttcatgtgttttttggctgcataaatgtcttgtttggagaagtgtctgttcatatcctttgcccactttttgatggggttgtttgtttttttcttgtaaatttgtttgagttcattgtagattctggatattagccctttgtcagataagtaggttgtgaaaattttcttccattctgtaggttgcctgttcactctgatggtagtttcttttgctgtgcagaagctctttagtttaattagatcccatttgtcaatcttgtctttttttgccattgcttttggtgttttagacatgaagtccttgcccatgcctatgtcctgaatggtaatgcctaggttttcttccagggtttttatggttttaggtctaacgattaagtctttaatccatcttgaattgatttttgtataaggtgtaaggaagggatccagtttcagctttctacatatggctagccagttttcccagcaccatttattaaatagggaatcctttccctattgcttgtttttgtcaggtttgtcaaagatcagatagttgtagatatgcggcgttatttctgagggctttagattttctagtttatttgcgtagagatgtttgtagtattctctgatggtagtttgtatttctgtgggatcagtggtgatatggtgatatcccctttatcactttttattgtgtctatttgattcttctctcttttcttcattagtcttgctagcggtctatcaattttgttgatcttttcaaaaaaccagctcctggattcattaattttttgaagggttttttgtgtctctatttccttcagttctgctctgattttagttatttcttgccttctgctagcttttgaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttctgaatcctgagttctagtttgattgcactgtggtctgagagacagtttgttataatttctgttcttttacatttgctgaggagtgctttgctttacttccaactatttggtcaattttggaataggtgtggtgtggtgctgaaaaaaatgtatattctgttgatttggggtggagagttctgtagttgtctattaggtccgcttggtgcagagctgagttcaattcctgtgtatctttgttaactttctgtctcgttgatctgtctaatgttgacaatggggtgttaaagtctcccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatcttggttggtttaaagtctgttttatcagagactaggattgcaacccctgcctttttttgttttccatttgcttggtagatcttcctccatccctttattttgagcttatatgtgtctctgcccgtgagatgggtttcctgaatacagcacactgatgggtcttgactctatccaatttgccagtctttgtcttttaattggagcatttagcccatttacatttaaagttaatattgttatgtgtgaatttgatcctgtcattatgacgttagctggttattttgctcgttagttgatgcggtttcttcctagccttgatggtctttacaatttggcatgtttttgcagtggctggtgccatttgttcctttccacgtttagtgcttccttcaggagctcttgtagggcaggcctggtggtgacaaatctctcagcatttgcttgtctgtaaagtattttatttctccttcacttatgaagcctggtttggctggatatgaaattctggggtgaaaattcttttctttaagaatgttgaatattggccccccctctcttctcgcttgtagagtttctgccaagagatcagctgttagtctgatgagcctccctttgtgggtaacccgacctttctctctggctgcccttaacgttttttccttcatttcaactttggtgaatctgacaattctgtgtcttggagttgctcttcttgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgcagatttggtcttctcacatagtcccatatttctttgagagtttgttcgtttctttttattcttttttctctaaacttcccttctcgcttcgtttcattcatttcatcttccatcactgataccctttcttccagttgatcgcgtcggctcctgaggcttctgcatttttcacgtagttctctagccttggctttcagctccatcagctcctttaagtacttctctgcattggttattctagttatacatttgtctaattttttttcaaaggttttaaattctttgccattggtttgaatttcttcctgtagcttggagtagtttgatcgtctgaagccttcttctctcaactcgtgaaagtcattctccatccagctttgttccagtgctggtgaggaactgcattcctttggaggagaggcactctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactccagaccctgtttgcctgggtatctgcagcagtggctgtagaacagtggtggctgtagaacagcagtggctgtggaacagtggcttttcgtgaaccgcaattgctgctgcctgattggtcctttggaatttttgtctcagaggattaccgggccgtgtgaggtgttagtctgcccctactggggggtgcctcccagttaggctgctcgggggtcagagacccacttgaggaggcagtcttccggttctcagatctccacctgcatgctgggagagccactactctcttcaaagctgtcagacagggacatttaagtctgcagaggttactgctgtctttttgtttttctgtctgtgccctgcccccagaggtggagcctacagaggcaggcaggcctccttgagctgtggtgggttccacccatttcgagcttcccggccgctttgtttacctaagcaagcctgggcaatggcaggcgcccctccaccagcctcgctgctgccttgcagtttgatctcagactgctgtgctagcaatcatcgagactctgtgggcataggaccctccgagctaggtgcaggatataatctcctggtgcgccatttttttaaggctgttggaaaattgcagtattcgggtgggagtgacccgattttccaggtgccatctgtcacccctttgtttgactaggaaagggaactccctgaccccttgcgcttcccgagtgaggcaatgcctcgccctgcttcggctcgcccacggtgcgctgcacccactgtcctgcacccgctttctggcactccctagtaagatgaacccggtatgtcagatggaaatgcagaaatcaccagtcttctgtgtagctcactctgggagctgtagaccagagctgttcctatctggccatcttggctccctccctaatattaagtttttaacttattgctttaatagaattttagcaaaaaacaaattgaaaatattcagtcgcaatgactggaattgccatcatgaacccaaatttgaacaccttaggccaataatagcatagcctcacattataatatttattatgattatagtacctttattttacaaaaaaagagggggctttctgttgtgaatgcatttttcaaatcaaaaagtagaagagtatccactgtgtgcatttgtcctataaacttgtttttcctaaatttactgaattactatgaatggtactgctatcttgctgatcagtaaacataaatcaaacataaatatatgggttcatgaaaagtgcttaatgcaatacctacaaaaagttagctttctataattttttatgatgataatcatcatcatatttggattctcttttgcatccacgtagtgctacacttccctccataatttctacctgctatctctcttagcagttcctttctacagctcttgctgtgccttaactcaagcttctgttgcctcctgacttgacttgattgtcataataaagtacaaagtgatttctcacctctagttttgcctgttttgttttttccaaaaccatttatatccttaatattagtgacaccatgatttttctaaaatgaaatatatgttacattactgtttcgggtccctcgatgattcctaacaggaaagtacagaccctttcatggtataaatggtcctatgcaatgtgccctcccttttcctattaaatgttatatcttacccctcccatttctcaacaggagaactaaaacttttacatgctatgaatggttctgtgcagtctatcaatctgccttatgtttacctactaaacatcatcactcaccactcatattcagtcatattctagaccccaaaggtccaactttgagttgctcaaatcttccataaggtttcatggttgcacacctcacatgatagttgttacacttttttttaagtttccatatgcactatacttaaatgtttttttttttccctgctgttctgttgtagaagtaactaatttattctctgtgcgccctctaaattcccagtttacctgtgttagaaactatgctattctatcttatacacacacccccgacacacacacaaacacacgtttgtttatagacgttttggatggcaagctttgtttcgtcagaacatagcatgtactacagcacctggcatactacctggattattttccaatctccatgacaataattggaaacatttcaggattacttagtagtactaggacctcataaatattaacacattgattaagacaaggtattttctgtcatttaagaagtccagaattgtccaaagtgttgtcacttcgcagagtaatttaattctgatcattctctttgttactagacttgtgaattattcaagaattgtgtttttccttctttatgctggcttccagaatgtagacctccaatatttatatggaaaatacatatgtattttgtttcataaattcaatatccttattttacatttcctattttacttcatactaattttgttactatattttactttttgcccagcgttagcttggaaaatagaacatgaggaaaagcttatatgcaaagggtttattgagaggtaaaattccaggccagaggagttagttaggaaggaaaaggaagtgaggttagaagacgggaaagtaaaagtatttgggagtgtgatacaaacctggccatggagttagaaaacacagctggctgtttgccaaaagcagtgtcttccagaaaagacacgtagaatcacgttgcttcagtatagtccatcaggaggaggatggaaaagacattcactttccagattcttaaagtctccggtccctcgtttttattctccccatgggcgttaaagttcttgctttcctggattttcttcctttccctgtccaggcaattgctggaaaagctgtatgtcactccctaaggctggatgtcttcctctaggtcagaaagctttggacaggaacagaacttgtgtgtgttcctctgggtgagacttcggtgttagagttgcggtggcccactatggtgataccaagagggactctggttggtacattccacttcttacctccaaacaagctttagcagtaaatagtgtcagaagggaaaataaaggcagtggcatgctatattctccaataagcaaaaggcagaggcttaaagaggcagataaactgaggctggtacagttcatcccttgtgcctttctgcttgcatcctcttatgatatctggatcttatataagaacaggatggtatcatatcttccataaaagggaacatgcaggttcaacctctttaaaaatcttaacaaactttagcaaactgaaactatagtctgcaatgcagcagctagccatggtgtcaagatttccttcatccttagccatcatcttccctcatatggtttgcttgctttctggagtgacctagatattaaattcaaactcagagaagtatgatttgttgttgtgccaatatctattcacaattttcattggtcatggaaataccataagacagtctagttaatcacttaggctccaggtctattcttgtcttcccccatggtgcagttgtaactgtaggtatccctggtcaaagtcactttcccaactcagtaaaataagtttgctcttgggctgctagtctcctggcctactttcctttaatgtatcagattttttttcagatgcctgattaaatatccaagatattatttcctaggaataagtgcatatctttatctatgactgtttctcttttcatataaagtggatgttgaagtgcacccctcatagatctagtcactggaaggatttttctttacccttattcttaaaaatcaccctttagtggaactataatgaataacagattaactccagttagtatcatcatatcatgcttacatttctgtaaaccaggcctgagcatttttcttcactttaattatgttgtagggaaacccccatgagactacaggtgtgaagcaagatagaagcatcagtgcaaaagaggtaagtgtcaaaggaatgtagaacacctgttcataacttacaagttagcaagtctgttacccacaggatgacaactttagttgcgtaattacttgatgttccatagtcaggtacatagtttcatctaaggcatagtagctgcagattaatatattcatttaataaacatcattttagctaaacaacacacttctaagtaattcataaagactatgtttcaggtcagatataaaaatgcattgtactgcatataaaagaaaatatatcaatatttgtggaacacatctcaagtagtgttgagtgaaaaatctacagcattaaatgcatgaaatagaaaaaggaaatattctaagttcgtacttcaagtatctagaaaaagaaaagcaaaataaatccaaaccaagtagaattggagaaataataaagatacgagcagaaataaatgaaatagaaaacagaaaaacaatagagaaaaccaatacaacaaagatctggttctttgcaaaacatcaataaaactgacaaatatgtagcacaacagagaaagaaaaagagaaacagagaaaacaaagtacaaatatcatgaatgaaacaggaatatcactataattcctgcaaacatcaagaagatatgaaaaactctatgcacataaattggacaaaatagatgaaatgggcccttttttgaaatacacacaaagtactaaaactattagcacatacaatttaacaatataaaaatgttatacaccatagccaagtgaagttcattccagggatgcaaaacaaggtcaatatttgataatcaatatagtccaccacattaattagctaattttaaaaaacatatcaattgatgtagaaaaatcttcagtttgataagcagcacctacagaaatcctacatctaacattttccttcaatggtgaaagtttgaaacatttcctcctaagatctgtaacaaggcaagtatatatgctctcagaatttttattcaataagcactagaaattgtagctagtggattaaggcaagaaaataaaaattaagggcatgcagatcagaaagggaaaatgaaagtgttttatttgcagatgacatgattgtcaatgtaaaaatttaaattcaatctaaaaattctagaattaatcagtttagcaaggtcacatgacacgagataaaattcaaaaatcaattatattcctatctactagcaacaaacgtggataccaaaattgaaaatacaatatcttttataacttctaaaaaaatgacttacaagtatatttaacaataatttatagtaactgtatcctgaaaactaaaaatactttattaaaaaaatcaaaaaagaaagagctaagtaaatgaagaggagacataccatatttatgggctagaaggctcaacatagcaagcatgaatttttgccgagttaatatacaggtataaaaaacttcttaccaaaattctatattttttgtagatatagacaagatatatagaatagctaaatcaattttgaaaaagaataataaaatggaaggaatctgtttctctggtttcaagatttaacatataggtatagtaatcagtactatgtgactgtggtagaagaatagttatatagatcaacggaacagaatagagaaccaagaaacagacacccacaaatctacccaactgatttttgacaaaggtgcaaaagcgattcaatgaggaaggataactctttcaacaaataatagtgaagcaattggacacacaactccatagaccaaaataatcaaatcttacactgtacacaaaaattaacacataatagatcacaaacttaagtgtaaaaagcgaaattaagactcttagaagaattggataaagaacgtcttcagaatgtagagttaggcaaagaactcttagattttaaaccaaaagcatgatagtaacaggaaaaactgatacgttggaattcattgaaatgaaaaattttggtctgcaaaaagctgccaagaggatgaaaagacaagctacagaccaggagaaagtatttgaaaacaatatatctaacaacaagtatctagaatttataaaaactctcaaactgaacaataaagaaataaacaatctgattagaaaacgagcaatcacaggcagaggcatttcaccaaaaggcatttacaaatggaaaataagcacatgaaaagctattcaacatcattagccttcagggaaatgcaaatgtaaatcacagtaggtatcactatacatctatcagaatggctaagagaaaaaagtgacaacaccaaatgctggtgaggacacagagaaactaggtcactcctaaattacttgtaagaatataaatggttcaattactctaagaagcattttgaaatttttttaaaaaacctcacatagaactaccatataacccagcaattgtactcttgagcaattttccatagaaaaaaaaaaaactgacattcatacaaaaacatgtacatgaacgtttattagttttattcaaaatagttaaaaactagaaaggacccagatgatcttcaaagagtgaattgttaaggaaacttggatatctttatcatgaaatactgcttagcaccaaaaagaacaaactattgatacacacaatgagctcaatgaacctccagagaattatggtgagtgaaaaacagttaatccccaaaggtttcatactaaatgattccatttaaaaactgttatggacttaatatgtttcttcaaattttgtatgcttaaatcttaattctagtacctcagaatgtgactatatttggacacaaggtctttaaagagattagtaaggtaataggtcattaaggtgggtcctaagctaatatgcctggtgtctttaaaataagaggtgattaggacacacacacacacagtggcaagactatgtgaagacaccaggagaagataggcatctaacagtcaaagagaaggcttcagggaaaaaaaaattcctgccaacaccttgaacttggacttctaggctctagaactatgagggcataaatttctcttgtttaagccaccaagtctgtggtactttgttatggaagccctagccaatgaatacaataaccatcctgcaatgaaaaaattatagaaatatggaacatattagtggttgtcaggggttaagaaacagagtgtaaggggattgggtgtaattataaaaaagcaaaatgagggatctttgtgatgatgtaaatgtcctgtatcttgactgtttcaatattaatatcccagttgagatattgtactataatttgcaagatattaccatggttggggggactgtttaaagggtacaaaggcttgctttgtattatttcttaccattccatgtgtctacaattatcccaacataggaagaagttaaactaaatatgagatattatgtcaatattcaggcagaagggatttaatagagactgtacagaatatttgggaaagcaaaattgtagaatcttaaataactgatttgactattgatttctaggctatgtccaatagagctacaaatctgaggtcagaaaattgccacccccaattactcatcaggccctggatcaaaccagtcactatagttatcccgaaatttcccgatccctacatttgtgctagccagcaaccatatcaccaagagaccaagagaatgggctccatcacatttgtgaccttttaatctcaaaccagtataactaatttgtgaaagttaatttatatacaacggtccagattaaggaaatcttgaaagttagtttttaaatttccaaattctccacctagaaggcagttggaatggaaatttttagaggaaatacatattaccaactacactaatacttttcttttagggccgtagtaagaattaaataaaataatatttgtggaagtgtttccttaactgctagtcaaatgttagtttcacttctaatcttcaggtctatgtagcttgaaaaattgcttcttctcctttactcttaggtttcattaatgggaaaactgatgaaggttggatgagaagccctctgtcaaatccatacatctgtagtcagtaaaatatagacttttcagcccttggcagttttcccttctctttctatgctatcagttgcatacccacattacaacttgtaactcttaaattcatacttttcactccgaccttaagctttgaaatttcatcttatatatcaggtatcttcaactaagatgttctaaatttacttcataattaattttctccaaattcaagacatcttggggatgggaattagggagatattggtcaaaggacacaaaatttaagttagacaggaggaataaattaatgaaatctattgtacaatatggtgactatggttaatatcaatgtattgtagtcttgaaaattgctaagagagtaggttttaagtgttctcagcataaaaaaataagttgtggatagttcatatgttaattagctcaaaaaactcctacaaatgcaagacactttgaattcgggttatatgtccagtttcattaaaacatgattcaatgatttgcagaaatatagacagtaaaagaggttaaaaatgaaagtaaggagatttcaaaaatagataatgaactgaagcaagtttatatgcctctcaagatatctcagttttgcctgtctccaaaatcttggaccaaccaagtgaccttgttactactttcttcactttttctcctaacatctctttctcagtctcttccagggtaaaggatggactttggtgtgttctcttttgtacatgcctcagtgagatgcacaaagcacaacttggtcagattcacagaggctcttgtctcctctaactcttcctgactcaggtgaaaaatcacctcacgcaatctggtttacccaagtaaaggcctgggtaacagaacctagaagcctgggaaagataatacactgtagtgaaccagagatagacaaaagaatgaacaattaatccctttcattttcgctgcctgtgaaactgttcaagatggggtgggcttatacatcctgtccgaaaaatgagccttatgaccttgaaactggctgtgttatatttttgaagctgtggccagttggataatgtatcaatttgtattttctcttctgctctgccttgcctcactttttcctttcctttcatttcatttcctttttcccagtactgcatttccaaataaagccactcacaatctttaatcaggctgtaaattttaagaaatctggaccaagacagtttgctccaagagtatcccacaaatgcagatcttcagagtgagattttattattggattgctcacctgtctgttggtaagtgagatgacaataacaaagtgaagatgataataacttgacatgcagtggtaccacaattgttaaacactggcctatggttaattgtgaacaaggcttggggaaatcaaatgggtacatcatttgatcactgtggagacaatgatacttatgaagattgtaatttcagatgcctattttaatgacatcagagatctagcaaaataaaataataggatcgatgcagctgcataaaagatgctgtgaaagccagagatcttctgcagtttaaacgagattctaatatgctgcagctgcatagcagaaaatgcttaaacttaactccagattataagcataagggtgtcatatcctcagtagatatgaaatcggaagcatctctgatgtcaatgccaggatcataataggaaaattgattagaatggaaatatttgagtagaagagccaaagactatggaatctccaagttcctcttacccctcctggctggcagaggcagttccttaccacttatcggagcctcctttttgccagtagaccacacaaagacctcatttgaggtagatatcaaataaaatgttgctcttcttctcactccaccaacacttattgtctccaggctaaccagaatcaggtttcagcacatcccatgtaggctgaaagacaattctctaaatgtcaaagaaagaggaagcctggaaaatatgaactagcacacacagattgaaatgaatgctcatggatcctgaaggtgttataacaagagatgaaaatgtggaaattaaatagaaaaaaattcatcgacaagaaggtattcacctatgacttaggattgaaatgttggcaaaaatatctgtaactggacataattttctggaatcgcttcttgaagcctgggtataacaatctagagcaaatgacatagagatgatataaattctttgacattgtattgaagaaagtctcagattttagtagatgagtaaattcagaatgaatctactctgtaataactaagaagaatcaatctttctatctgtaggtccagtaggtccagaagatacttaaaaaaaaaattaaggtggtagggaatgccttgacgagggaagcatctgaactttgagaatttcagtgatgactgacctctgcagtccagaggcaggaggagggactgccacggaattagggtatttaatatcaatagggataatgggattccaggaaagcatagcccgaagagcagaacatagctgtgagaagcaaggaaggcgtaattacttcaggcaataatgtttttttcctacaggagataagatgatggttaatcaatcatgatgttcctaggagtttgacagatagacatctggcaaggatatccttccatttgtgtaacaaaatggtcaaggtctggcaagaagaaagttaacagtcctgcagtgaaaaattataggctcccactcttttgaatacttaagtcagtttagagaccaaggcccactgattgaaaggaagcctacaacacttgagggaggaccctactgtgccaccacaagtatttatgaaagaaatagtcctccagttttccccaaagtgagtacaggcatttcccagggtaaccaccaagtgggaagaatggattactgaagtttttaaggattgctagagactgtcatgcgccaagaaagatagaatggaaccaaacaaatcttcaaacaaaagccaatcaatcaatccaacagcaaacaaaaatccctctcagttctgttgctagaatggagtttatgaataacaggtgacaaatggagtttttcaagtcattctgacagttggtccagcaggtccatggaaaaccatggtgttactcctcttgtccttgaatgcataattggaatatatataccaccatctggaaggattctcatatcttgtattggttagctgacttgaatatggtaggaatagtcaaataaaagatcctaaaattacttcctatatattcactggtcacagagaataaattaggagcaatattgcatactttgagtagttgcagaaattagcatcactattaaaagaattgaaggcagctttgcacaatgtctcatacttgtaatcccaacaatttgggaggccaagagggaaggattgcttgaggggaggagttcgagaccagcctgggcaacacagtgagaccccatctctacaaaaatttttttaaaatacctggcatggtgtcatgtgcctgtagtcccagctacctgggaggctgaggtggaaggatcacttgaacctgaaagttgaggctgcagtgagccatgatcttgtcacttcactccagcctgggtgatagaatgagaccctgtctcaaaatgtaaaaagcattaaaagatgcaaggtagttggtctctaccatgtctctattcaaattaccgatttaatatttgcaaaattcagatggcagtaatctactatatattacctaggtcatgccccaatcgtagctactgtactagatgtgataactttactacagcaaatcaacacatatcctagtacttgatattgtgttggcaattttgtccttctctgtccctatcaatagggaggatcaaactatttatttttatatgacatgggcattatgtattcaattagcctcataattatattaactccataggtctcctaactgtcagatcaggatagaagtccaggttccctacttgggaaatatttttagcactcattttaatatcaaaataaatatttgtcttttctgactattacttatctgactattaccattgaatttgggtcttggtgttgaattatcagtttattaattctccaaatcacattaaactataaaagtatgttgtgaacaattggttattatctaattggttattacaaatatacagaataaagattaacttcataattgatatttcataaatttggatgaccttagtaatgcccacgaatatatcccaaaacaaataagaaaatacttgtacatttctcacttgttttgtgtttgtatgttgcctatgttgttctttttctgaaagctggattgtcagttgtaaacgtggcacctccataaaccccttctaaggctgggaactacatttcccagaatcacctcccctgtatggttttgggttggtttgccaatcagagaaattcacaacatttagaagatagcagtgaaaaaaaaaggcccttgttcctgtggcagtcaaatgcatgacttgacttaacagacttctctatgagctctcaccgtatggtcatggcaggcaggcataatgccttcttgggcttcatcaccaaatctggcttctggttgacatcagtgattgagtgattgcttctccagttctgtggtgctggcttacagacctttgttttcccaccttttcccacttcataagttctggttcctacattaaataacctattatcataattctggtagtggctatattttccttagtaaatgatgactgataatagggaagaaaaataaacattaaaattttgggatccatagagaaagtttaaatttaaagaatagaaaaattactaaaataaaagaaaaatcatttaaaaatgtacaaaatggagtggtttaatgaaaaataatattttacctggactgcgaaacccagaataaagactgtcttaaacttaagtaataatgtagatacaaatattattaataaataccaccaggtggatgtataccaatgatttcaataaaagatatcattaaaccagagataaattgtttgtgaaaatgaataaagtttagaacataccctgagaatataacatgataatcatgaaaaaagaataaccctaaaagactgagagtctaaaggtaactagaagaacccaagtgtataaccccttgtattttttgtatataaattacatgggagaaattccactatttaccgtagtcctagatactttttttgccctggcccttatcatttctttttaaagttatttcctcaaagaggaaaagttgaaggcagcccttaaagagggaatcaagaaaataacaattgattctgaagtcaaggaactgaagatgtataggttcacagattggttggtcacatatcaattaattatactttttatttaaagtaagttttataccaaatgtaggactaaagacaaactatatatgcagattataaaactctgagagtacatgaaatgttaaaagtgctgtaaatttgctaagcattactagtatcatctttggaacaactctttagaagaaaaaagtggcattattataagcaaaaagtggattttttatggctattatatatattaaaatttttctcaaattgtttctttttataatggtctatgttaaggcctcataatttattgaaaagttcaactgacataacctcaaaagtgctttaaaatgaattaagaaaaatgaaattaatgcacattatttgcatgtaatggatttagaaaagccacgctcatatagttttttatccattataagtcaatacagaccatcaatattttgaccagtgagctacaccatacagcaattccaggctcatttaccctggcacccaacatagttcaaattccactttccatggaaacatatttcaagttttactctccaagggaaaaccaacacatttgaatgttaacttcaaccaagccaaaccagaaaataaatttgctttagaaaattcagtattcttcaagtcaaacctgtatgacacaggaatatccctgatgttatagattatctctgtcatcactctacttacttaactaggaacaggaagagagggttgactgaaatcacatttttacccatagaacagtacagcattttaaatcatatttctcaagggcctttgcaaagttatcatctttagaagttggcagtcaagttaacttgaactcactcaaatgtgaaatgtattgaataattaagtatctattcattgctgacaagaacactgagtttgtatgtacaaaataagtgaaaaaatagaccagtagtagaaaaatagccaactgtagcagagttcacttaatgtgtctctactcttgctgcgctagttatatttgtatgttaacctcttggggattacatcttaatagagatgttaacctctactaaagaatgttaaatgtattgactcttttattcattattttgtctcccctcagatacaatttataaaaagttgatcatttcaagacggtgaagttggtattgaaataggaaatagaaatccggtattcactggatgcatgaaatcaccatagaaatatgctcagaatactataaaatattctggtcagaaagactgtagccaaagagacatcaaaagcaacagcatctagtgcaattagtataaaacggtactgaaaatctatcaataaaaattaatgtatcagctgtgtaattaataagcaaagaggtagacattatccacctactgctcttataaattaattttgcaaattgaaacaaaaccaacaatttgtactgggaaatttatttgttactaacaacatgccactagttcaagagttgctatatcatgcaaaaaatccctataactaatccgtctcttgttcaactctagcctgaaaatggatgaatgtgtcatgagcttcaaaacccttctctaagaactaggagcatcccaagaaattatacagtctcatttggaacaaaatgaaaactcagtccacctaagagtttctcagacatttgacctttgtgtctgcaggaaataaaaaaattgaaacagcatttgtactctgtaattggtccaaccttaatggaaggtattcactgagcagaacactaagacaagcttttggtaaatggcacattactttataaagagctctgctcaaggcaatttatttgaaacagggaggcttatttaaagctaccacttggaattgtgtaaaatcaaatcaatttcatagtttctttaattttattgactttcttcagcttttatattttgtacatttgaaataacgaaaacatttgtgagacatatcaattttaactccactttaaacttaactttatcctttgagtttctttgtaaatgacgagttaatgggtgcagcacaccaacatggcacatgtatacagatgtaacaaaattgcacgttgtgcacatgtaccctagaacttaaagtattatatatatatatatatatatatgaaaaggtttgttttcatatatatatatatatatatgaaaaggtttgttttcatatatatatatatgaaaaggtttgttttcatatatatatatatgaaaaggtttgttttcatatatatatatatatgaaaaggtttgttttcatatatatatatatgaaaaggtttgttttcatatatatatatatatgaaaaggtttgttttcatatatatatatgaaaaggtttgttttcactctgaatatagcaatagaaatcattgtaccagagagtactctgacaaattttcagcatttaatgagaatgtgggcaggaagtcaaataacttgttcttcctgtaggaaggtaaagattattatattattgggcacttgtgtttacaatggaaagtccagaataaaggaggcctcaatatgctctgtggaacacactgtgctagaaagaatggcagcaaattttatggcagattttgccacaagacctcaatgtgtattacgccttggaactagatcagctttggaattcaaacacttcctcatttccatctctcaacattggattatcattgccctgcaacgaatattccatttgccttcatttgtagttgcaggatatttcctggtaatcattacatttcttgtaaccataaaataagtaccaaataatatctgataagaactttgcttcatttttttcctgctagaatcaaaatttagagaagcaaagcatcagaatccatttccaaaatttgattggtaccactcagtacaaagacccatattccattgtaatgttgatattttcatctgtttttgtatcatgtgtatctgctttataatttccctgcattctcaagtattaattttcaaatgatttttaacttattacttctgaattgaaacacaattgttttcattttgtctacatggatttatagcttcatatagttgcaatcacaaaattttatacttttagtaagattatattcatccaacaagggactatatccggaatatacaaggaactcaatgcaacaccaaaaaaagtaaataatcccattaaaaagcgggcaaagggttgcaataagcattgttcaaaagaagacatacaaatggccaacaagtacatgaaaaaatgatcagcatcactagtcatcagggaaatgcaaatcaaaaccacagtgagatagaattacaccacagttagaatggctattatcagaaaaaaaaataacagattccggcaagaatacagagaaatgggaactcttatgcactgttgatgggaatgtaaattaacacaactattatggaaaacagtacatagatttctcaaaaaactacaaataaaactaccatatgattcaacaatcccactactggatgtttatccaaaggaaatgaagtcagtgcatcaaagagctacaggcactcccatgtttcttgcagcactattcataacagcaaagatatggaatctacttaagtgtccatcatctgatgaatgaataaagaaaatgtggcatatatttacaatggaatactatttggccataaaaagaatgaaatccagtgatttgcagtaataggaatagaactggaggtcattgtgtttagtgaaacatgccaggcacagaagacaaatattgcttgttctcactcatatgtgagatctaaaaaagtttgttctcatggaggtagagtgtagaatgacatttacctgtggatagaaagggtgtggtgatggggggatgaaaaaaggtaggaaaatggatgccgacatacagttaaatagaaggaataagttctaatgttcaatagtacaacaggataactataattacaacatattacacatttcaaaatagctagaagagattttaaatgttcccaacacataaaagtgctaagtgctcagggtgactgatatcctaaataccctgacttgatcattatacattatatgcatgtaacaaaatatcacatgtaccccataaacatgtacaagtatcatgtatccatagaaaaaagtaaaattcaagctaaaaggattatgtgttaaatattttctattttcacattgctttaacaaaaaagagtgcacaatgatccattgtatttatatacctgtatcataatttagttaactgtttctcttctgtggaacaaataggtggcttaaaatttatgctgctacatttagactttcaagaaatacatatatattctcttcatgctttgcttcttttttctgataaatatttttagaatataggtcaccaagaatgagactgaatagtagtatgaaaattttgaaaatttagatacgtattttatcattaattctgattttttatcataaactaatatttaatattttaaactataaaatatatacaatatgaaaataataaaactaacatctaattaaataccactgagagttaattgaataaattataacactgccatatttgattcatatctctgtttttcttttaaaataaaatcttagaaatgctagggtcagctttccaacccttcatatgattgccttcaacttaagttccactctgaaaatggtactatcattcccaggcatgcttttgtgttttaccagatttgtatgtatccataaataatataaagtactgtttaaagagtttaaatatgcatatattttaacatattagtatcatgttctttcttcttttttatttttacataaatttttttgagttctattcatgtttttttcagtagttataattcatctattttaactatttagtagtttattgcatgtttatttgtccgttttcatagagtatttcatagcatgtttacccattttcatgcatatgtctttttgatttttattctattacaaactaatttggtaatgatcttgtttctgtttgtaagcttgtgcatttgtacaagaggttcttcatgattcatacttaatgtaattgcttggttcctttttacccatgatctcccttggtgttattggatctagtacacttgccaattgagataatatgaaattgtattccattttagttttaattacatttccatgattactgctgaggtttagcatctttttgagtattacggaatttagtttactcctacgtgcattacattttcataattttgcccagtttttccttgggttgtttttattttcttactgattccaaaggtatctgtaaattattgaaatgaattattttagtattgtgcttttcagcttttcttttcactttaattgtgcattacatcatataaaagttttcattttaatgtaatcttagttgtaaatctttttaaatttggtttgtttttcctgttatttttttaaaaattatttctctcccctaacatctaacaaatatttttcacttctgttttttctataaattttcaattttgcttttcacacttatgaaattacttggtaattattcagttactaattaaccttgttacttggtcaattttgccaacattttgagttattttaaaataaaatattttggtgtctttaatctctattttaaagtttctatttaattacctcttgctctttaactttgttttatttgtttatcttctttaccttctctattttcttctaatttcttgagttggaaaacttcaagaaatattcaatatttatttttttctgatgtaagcatttcatgccagttttgtgaaactattgctttatacacatttaacaaatttggacacattgtattttcattgttattagttcaaaatgtattttaatctttattattaatataactccttatctggtctgtgaattttttggaagattatacctgattatattttaacccaaatacattgggaagtgtgtgttaactttctattaatttctaacttttaaatataactaaactttgattacttctttgtgacccaagagagtgatgtcaccaaaatggtggagttgggtcttgtgtggtggctcacacctgtaatgccagccctttgggaggctgaggctggcagatcacttgaggccaggagttcgagaccaccctggccaacatggcaaaactctgtctctactaaaaattaaaaaaaaaaaaaattagctggcccatcgtggtgcacgcctgtaatcccatctacttgagaagctgaggcacgagaatcgcttgatcatgggaagcagaggttaaagtgagctaagatcgcaccactgcactccagccagagtgacagagcgagactgtgtctcaaaccaacaatgacaacaacaacaacaacaacaaaatggtgaagtagaagtaatctgctttcaccctccccacagaaaacaaaacaaaacaaaatcctgtccagtgccaaaattatcaccaccagtactccagaactcaaaactgaggctgtgataatccttgagccacagggaagtaaactgcatggggagggtagaagaaatggacttttccatgtgctacatgcttcctccaaactatcaggcacttcacagaaaagttctcctggagtcactatctctggaaaatgcgatgttgcagcagacagctggtttccccatcatcttgggttcctacacagaaaagctgttttttcttcaacccacttaaagcaacttgagtgcctttagggagaggaacccctaaaaggctgctggaaatagacagtggaggtggggttagcagtcccagtgcacaaaacatgggcactgctctccagctcagacaaaggagatgccaaatcaaagaggtagtgcaacacttggcatgaacccctaaccagcctctctacacagccagggaatcccctttgggttcctacccccgaccccaattcaggacaaatggcacatcaaacttttgtaaaagctgaggcaaacttgaaattagggcaccatgtagtgccaagaaggaggcagcaaattaggaataagggaaatcaacagtcaaactgcatagatactctaaacatacatagactagaaaggccaaactaacccagacaggaaagctgggaatacataactaatccttcagtgcaaagacataaacaacatgtgtccattagaaacaggtgtccattagaaacaacagcaaacaaggaattatgaccttcccaaatggacaaagccaggagccagtgaccaacccaatgagacagcaatataagaactcttagatcaataattcaaaataacagttttgaggaaactcagcaaactccaagataaagcacaaaagcaatttatcagaaaaatttaacaaagaggttgaaataattaaaacaaacaaacagaatcttggaaatgaggaaaacattggctgaaatgaaaaactcatcaaaaggtctcaacagcagaattgatcaaaaataatcagtgagattgaagataggctatttgacaacatacagaggagaaaaaaaaaagaaagaaaaggaaggaagaatgcctatgagatacagaaaataatcccagaagagcaaatctgagtcattgtctttcaagagtgaggtgagaaagaacaaggagtagaaagcttattcaaagaaatagtaacaaaaatctttctaaacctacagaatgatatacatatccaggtacaggcaggtcagagatcaccaaacagatgcaacccaaacaaaactaccccaggcatataattctatgtgatccagtttcttgaatatttcttacgatatgtcatgtaacctgttacttgggaaagttttccaagtgttacacatacatagtagtcagcaatgctatttaacaagtgtttctagatcttctcagttgtgatgaagcttatattgcctgtatcccttgtctctataacgactgtgacacaatgcttaattgcattggcatgtggcagtagcatgaaatatattttcactaacccagtgagagtttgggtgtttttgtaactgcaggattatcagccaatgctaatgtggtggatgtggggtaatattagagtcctagtggtgagaaaggtgacaatccatgttacacatgagcaacacttatgaagctgttatgtgctataacttgcttaaacatgtatctaataaacttgtagcactacaagaagtatttgaaaataaaaacaatattggcacatattgattggtattggctgtgcttacctagctattatgaaagagacccaaagaagatctgcttttaaaaagtatgttttatctcatcatttggtatagggttctatactactgagtcagatgaacttattacttgtttttgagattttctgtatccttactaacttctgtctagtggatcatttaaaactccatcactacagagtaaatatttcttgaaaagaatgtgaaaagtatccagcataaacatggaacacatggaatgtaattaaaattacaaacttcggtcaatcaaaagacaccattaaaagagtgaaaaggcaagtcagagagtgagagaagatatttgcagtacaaagaaaaaacacacaaatattctcgcaaatcaatcagaaacaaaagtcaagccaaagaaaaaaatgtaaatgatcttttacatccccaatgatatccaaataatcaatgcacatttaaaaaggtccttaaagatattagtcattagggaaatgcaaatcaaaaccatggtagcatacctactataccctaaaaatgttaaaatgaaaaagatgaaaaatagtctcacatactgctgcttgcagtgtgaatttgtacttctttgcaagactgtttttgctggatcaactaaagctcaaaatatgtgtaatcctatgaactttgtgctaaactagggaattattaaacagccatggaaatttatagtgactcacatagaaactcatttaaaaattcacttttttttttcaaattttacccctttattttttgctgtgattggcaaaatgattgatttagtagtagaagttaatttttggtccactgttattgatttcaactcttcctcctcacttttacctttgagatggctagtgctgcatgtgcctctctttaatgtgttccattaaagctttatgtacaaaaataggcaatgggttatgtttggcttgtgggccataattttctgaacattagtttaaaaggttatccttcccaaagctgtatgctgggattttaacacatgactcagggaaacactataactcaatgtcaaaggtgcactttaatggcgacaatttcaggttcattggccgaactgttgttagtaatatatttttaagccattcagcatccagcaaattggattattaaacagatacagatgccaatgaaaatacggcatgaaaaaacagtttatatttactataagcactatataaaagtctaacactgactgaagttcaaaaaaagcaactcaaaaagaataataatttatattaatctttccaaatattgtcaactgatgattgtggtagttgggaaactttaaaaataacagaaagtatgtagtgatcagatattagagtttgctaaattatttggattcccatttttaaaaggtctcattaattttgcaaaatgattgtccaagttgtatgagtggagaaattatcttccctaaaatatccacatggaaatcaatatataagccataagtctcagttagatagaggaacacaaaaataagtttctgttaactaactttaatgaataattgcaattttctttctaacaaaggagcaattctttcttggttaatgtttttgtatctgtggttatatgtagactgtaaaattacatttatttttgcaattctagcttgaatagatgttttatctttggaacttgtcagaaaaccatgggttttcaaataagactaaagctattttattaaaaagttgtatgataaatttgaagacttctgcaaaggacaatccatggtttcagatcatttttggaaaaaaaaaatcagttaaccagtattttctgctgtactgtcatttgtaattctttaagtttctttgtgcatgtagcattgtagctgagatatatttggccattgtagcaatattcttctcttcactaaacccaggtaacttaataagtttcttgaaactacatagaagaattgaaagtattattacaacaacatttagaacatctaaaaaaaggcatattcaaagatttcagtggtcacttagcaggaaattttcatttattttgccagtatgattctatgagcttttataataccaggcaggtcaggatatcaggtaatgtttcaagtcatttcacaatacttttaaagatgtacgtttagtcttgaaattactataatccttttatttttccttaataattcataccttcatttattcaacaaacacattctcaacctactacatgataatatttgggaaatcagggatgaacaagttagatgaattttctgctcttataaaatgagcattctagttgtcagaaacaaacattaaacaagcatagaaataaacctgataagtttagaatatgataaataccataagaaaaatgggcacatgacattaaagaatgtgacagttactgaacccagtagtacctaacaaatgagggacccaaagattcatttgcaaaggaaaagtgcaaacatgaagtagtatgtcaaaatttcctaaaatataagaattttctaaggaattatggctattttatgacaacaataatctgatggagaatataaaatatttcaagaatttaaactcacaataaaataatttacactttcctttattttttaaagttcctctaatctgatgggacactcccgcaatgatgcttcagctgtattttaacctcaagaaaccctaagatccctcactcctatgctgctgtcaacgggaggctaagaagcacagagaaataggccatacaaagtctacctctctgaacactctggtttgttgagatgacagatggttaagtctctctctgacatcaagagttagagccaaagttatcatggaattgtttcttttggaatgtcaagtttatgtgcaccgtatcactcttctgaaatggactcaagattcagggtctcatctcacttttgatttaactacactcatattcatccatgtgtgaaaaatggtgatcacactagaaagcttgttcttactgtttccttgcatatctgaatacctgcatcacattcaaatctaactcactgccttaatttaatagctgaaagaaacactgaacaagtcacactcctgcaagggcatggaacacagaatggcaagtatatccactaggattgtatttttctacaagaaatagcctggcaaatggtggcctaaattactaatcagtttattttattcttctacagaagttagcaaaccatgattggtcttaaggagccatcaaaatccaatttccttcaagctttctgcctagccttccttcacatatagcttccattctccagtttccccctgtgaacctggtaaaaagagatttcaaagttcaaacccgaaatataaataattattcaggaatatcttaaccaatttattgcatgtatagtttgtagttttataaatgcacagctttgggaggccgaggcgggtggatcacgaggtcaggagatcgagaccatcctggctaacacggtgaaaccccatctctactaaaaatacaaaaaattaattacccatgcgtggtggcgggtgcctgtagtcccagctactcaggaggctgaggcaggagaatggcatgaacccgggaggcggagcttgcagtgagtcgagatcgcgccactgcactccagcctgggcgacagagcgagactctgtctcaaaaaaaaataaaataaaagcacagaagtattatgcgatgaaattccatgaaaatgtatctttcagtaattataaagtaaaatacctgtgataagaaagcatgtaccatggttgaattggcagtgtatcttttattcatacttcttaataatgggcattttctttggtgtgtgtatgtgtatgtatatatctcctatcttgtgcttatgtagtcttgattaattattcaaggcatcacagaaaacagtagatacttttgtttggaattgaagaattgctttgcaattcatataaagcatgtaggtaccaggagtttaagtaacaaatataaaaagattatctggagcaattctcaaagcctttactatgtgaatgcacatgcagaatttccaagacgatattacagtattcagcattttccatgatccatatttcaccatgaacattttttctgacagattctcttactgagataccttggaacatggtttgaataatattgctctaacttctttcatgtcaggaagctctgaggtaatttttaatattttatacactgtactatttaacaaaggaaaatatattatttgttttaccaatgtcattttcctcgacaactgctacaaattggaacttaagttagatagctactttataatatatttgtattaatctagaaggcttaactatacctagattatacagtagttgctcaataaatgcccattgaatagaatcataaactaacttcatttccagactgcacaaaagagtcaatctagtaatgactggtggaggtggggcaggatagggtcattgctagggctcttacacacacatcatactatgtatcacttttctatatttatcactccattaagtctgttcaaaatcaaccttcctatctaaaattaccaagaattcaaattgaattccttagatgcatagtgatccaattgcttgttctatttgattcacacacaggcagcaatctgttttctttccaaattgtatttgttgtcattattttaatctagcatttgtttcatgttattggaatactctgaattatataggaggtttatacaataacaaacagttaaagaaacaagtcaaagtatcactctccccaggtgaacatccattttagctatgtgtctatttcttttgaacccaaattttagacagtgaaatctgtggtttattcttttaacagttgccatagacttgcggaaatgcctgctacatacatgcgtgttgaacaatgaacttcataactgacatatttatcagagaatcaggatgagagaaggtgatcacttaaaaagaaaagcctagtttgtataagatggatgttgatcacgtgctctccagcatcataattacatttgttctgttcaattagggttgggtactagacagaaaatattttgtaaaaggaaatacccaccttctttgaagcactgttatacataaattctttccaaaagtattttttaaaattacagagaaaatacaaaattgtaagtgattcattttttattattataaaaagacacacttaggccagtagtaaaattgttgagtttctttctcctaatagttaattcaccatataaaatatttagtttattcacagcagcttgttatgggattctaattgcctatttttccagaaatggtgaacaatctttcatttaaaacagggaacagaatagattaaacatgaagggaaaatatacaggcagtgaggccctcaacttcttcagcactgttttgttctgtcctctttttctctccctctccctccttctgtgtatttctattccttctatcccacacttttcattcagaactgctcatttttcattttataaatgacaagggccattccagccttattaagtggaaacttgaccgatagcattgaaaaggtcacctgtaattcaggctacaagtgataaaaatttaggcgttaagatcaacatagactgggagtaaaattttaaaaatagagataaagatttataggcatgaggctattcaagaagacctagtgctgccagtcactgagaaatcaacttgatgaccagaaaataagatcagattaagaaatatgaggttggtagggcctcctgaggcacagtcaggggacactgaaatgtatttttagtggattatgaagggtctgggaatggataactctgaaatccttttacagtacatcacaatgtgtcacatattccttgagaaactcaattaccaaacatcccagacaacatgattggctctagttgaagtgagaaaaactttaaaagtgacatgaaatgttaaattggctttagggttcagaaaagtattttatgtaggtatacaccctgattttcttcagcatagaaagcttatatttatagaaaagtacatattacctgtggaaaaaaattaagtagactttaaaggaatatttaaggattattctgagcctttaacatgaccagacatacatttttatttataattatttaaagtctctctattttattcttcctcagctttaattcacctgggagaggtgcttaggagctaattgaaagtaaacaattacaaaaagtgtatgttttgaagaattgttttatgaagtggggagcggggagagtttttcttaagggaaagaacaagatagaattattgaaataaatattagaagaaagaaatgaatttattgtatgtgcaataatgtactggaataaatgcatcaaacactttttcttcaagcataattgcctgggaataatagtagatttaaattcaaattttattttgtgaaggataacatttaaattaaatttttttttgtgaaagcaactatcttaactatctgtgctaacgacagctctatgatagaaggaactttgtttattatgcttactatgcagatgcagaaacacagaaaggaagaggattagcaactttcccagatctgagttgagctgagatttgagtcaaggcaatattgcttctggggctgtaacaactacattttattgtctcctgaacagatacttccttttcttacttaataagaatagaccttggaggtctggacctggacatgaacgtacacttttctaaagaagatatacacatggccaacaagcatgtgaaaaaaagctcaatatcactgatcattagagaaatgcaaatgaaaatcacaatgagagaccatctcacaccagtcagaatggctattattaaaaactcaaaaaataacagatgctggcgaggttgcagagaaaagggaacacttatacactgttggtgggagtgtaaattagttcaactattgtgtaaagcaatatgtcaattcctcaaagagctaaaaaagaactaccattggactcagcaatcccattactgggtatatactcagaggaatataagtcactctactataaacacacacgcatgcaaattttcattgtagcactatttacaatagcaaagacatggaatcaacctaaatgctcatcaatgacagatcggataaagaaaatatggtacgtatacaccatgcaatactgtgcagccataaaaaagaatgagatattttgtgggaacatggatggagctggagaccatcatcctttgcaaactaacaaaggaacagaaaagcaaatagtgcatgttttcacttataagtgggaactaaatgatgagaatttatgaacacaaagtaacaacagacactgtggcctacttgagggtggaaggtaggaggagggaaaggatcagaaaaaataactgttgggtaattggcttatgtattagtcccttctcatactgctataaagacatgcctgagactgggtaatttacagagaaaagaggtttaattgactcacacttctgcaggctgtacatgtacaggaggcatggctggggagacctcaggaatcttaaaatcatggcagaagggctaggggaagcaagcaagtcttcacgtggcagcaggagaaagagagagcaaaacaaaggggaaagtgctacacactttcaaacaaccagatctcatgagaactcactatcacaaaaacaacaaggggaaactgtccgcatgatccaatcacgtcccaccagatccttcccccaacactgaggattacaattcaacatgaaatttaccggggggacaaagagtcaaacggtatcagcttagtacctgggtgaggaaataatctgtacaacaaaacctcatgacaaacatttacctatataacaaacctgcacatgtacctaaaatctaaagtaagagttaaaaaaaattatacaggagtatacttagaaggcatagtttctgaattctaaatcattattcataaaaattttacccaatatttttcattgcatatttcctataaaaaataatagatcaaagactactaattgtaaaaagaaaaaaaaagcaagctgctaatatttattgtgcctttactctttgccaggccttattaaacgctttacctttgttacactgtttaactctccaaataactctaaaatgtagttacagttattgtttctgagaaaggatggaactgaggctctataagttcaagtcactatagactactggtctaggccagtagttctatttttaacacgtttatgaaacaccttgaaaagttattaaaagagttccctggtttcaacaccagaagatctaattcagcccaaaaatttgctgatgcttctggtcagaggaccacactttgaaaactactgctctcctaatggtgttagcaattgtctgaatcctgagactttaaccaacatatgaacacacaaaacgtgatgttcattccgtagatattgattgatgctgaatccaaacctcatcaaactaaattattcatgtaccatgacagacaggaatcctaaaggcatttttataaaagacatttgcctctaatccttaaggacagacacttaagtagcacattttggtacatagaaattagatttcagtactaaactctactcacttttctcaaagctattaaatcagcaaatagttggtatcaagcatcattgtaaatgaatgaaaattgttgttttaaataataaactttaaaagtgagagattaatagattcccaaattgataaagccagttagtgccagattctaccacaccctattttcagtttccttgaatgagtagtatgtcaacagctccccttggtcctccagtataatttctccccagatttcatttaggtacatgactactgataattagcaatggaatttaaattcctcaggagctcttgcatctaggcatgggaccaaggctaagttctagtcaatgggatgtaagcagaaatgatgtgcgtaacatcaagaatcagtttttcagagagataatttgcttttcttttctccttcttgtctttgatagcatcttcaacctttctggactacagcacctgccaactgacccccacatcatggctccaacgctggcttcatcacatatcttctctctcagtccctttggctctcagggtgcaatagcttaacaaaattgctgatctaggtgcctcagcattgtttctttgtcatagtctctgtattatcttattttgagccattcttttcctgcaaagatcctaactgaatgagataactacttcataagctatttgtaaggtttaaataaattaatgcatatttaatacatgaagctgtgcctagtttatagtaattactcaaaaatgttacttatttctccatccaaaacatacaaacaatagtatatccttcatgaggacttcttgtggactaaaaaggcagtatctttaaagtgttttgcagtctctgacaaaaccacactattacccttactcaaggttttaattgattgtatgtacacaaggttagtctatatgagctttggaaagatgggaaattcaaagtagaacagttaaggaaggaaagtgtatgttccactaataaaatatatattagttcctgtaatcagattgtgagtgacaatggaatccagtggacccattttgccctcagacagatggctgagaaattgctggtgtggcaagcaagcaactctgactgcaaaatggcagactcatttgcttgggggacaggaatgagggatggttcacatgggaagcacaaagtcacccttgatgaaagttcagagaagaaagagatcatcaaacttactctaattaccaaaaggtgatgacattagcagaagaattagagtttgaaatagtacttttggtagagaggactgatttctaagaaagcccatactcatgatacaaaggcagttggtgggccccaaagcagaatagctgcctcaggtgggcaagtagctaaagttcaccaagcactgtgtcccaaaactcacatacacgctatacctacctgcatcccatgatgccaggagagccacatttctgtggcaagggacagtgaacagagaggagccaacatgggaatgagaaacagagttataaacaaaaagcaagagaggaaccctcagggtaacagaatcagtcactcttgaatatgtgacagagtagaaggtaattacctcttatatccggatattgaaattccaattctagtctctggaccatacttctttgaaggttagaaatatcagtagctcagttggatctcagattggagctgctatgtgttgaattgcacccctccaaaattcacatgttgaagtcctaactcccagtatctcaaaatgtgaccttattcagaggcagggtatttacagagataagcaagttaaaatgagaccattggggtgggctttaaaccaataaaaaggggaaatttggagacagattcacacaaagagacaatgcatgtgaagagagaggcagagattgaagtgatgctcctactagcccaggaacacaaagattgccaggaaacctccagaagctagatgagaggcacggaacagattcttcctcacgatgttccaaaggacccaatcctgctgacaccttgattgcttaattctagcctccagaactgtgagacaataaatttatgttgtatgccacccagtttgtggcacattgtttcagcaaccctagaaaactaatacagaagttgacaagatccctgtattagttaagatttttaaaaaaataaatgatgaaaacaaaacaaaatcccttttatgaacttaactctaaatgtgaaatgtgtaggatcagtaaatgaaactctcaggagtgtacatgttctgagcatatgttgattcaggtagttaaatgatactatcaggagtttaactctaactctggctctcgttgctacttcttgcttcgggttggttttttaccctggcgagctctcttcaaatgaaaataagatgggacttaacaattccagctttaagaaagctgcaaccagcaattaaagaaagttaaactacctcttctttctcaggatcatagcaacataggttttacctcccgtattaccagcgttacttaattattgccagttatttcaaacagctggaaacaacttggaaagctgcttaactagagaggtaagtgggtaagaatagttgaagaattgataatttattcagtgcgatttctctcttttctatattgttctctgttatggtggagacaaatatggatatttttatttgagcatgaaaatcaagaagaaaaagaaataaagaaataacaggtaagatataaattatgaatttttttcttaaccttttttaaggtgtaatggtatttccaaaagtatctcttcctgaaaagaggaagattttattgtttaaaacattttgtagagaggttagaaatcctagatttcaccactaaaacaacagaaaaataatttaacattttgggaacccaactattcgtgtgttaaaaaaaatagttgcattgtctgagcagggacatggatggagctagagggcattatccttagcaaactaacaaaggaacagaaaaccaaataccgcatgttctgtcttataaaaaggagctaaatgatgagaactcatggacacatagaggggtacaacacacactgggagcctatctgagcatggagggtgcagaagggaggggatcaggaaaaataattgatgggtactaggcttaatccctgggtgatgaaacaatctgtataaaaaaccaccatgacagaagtttatccatgtaacaaacctgcacttgtacccctgaacttaaaatgaaagtaaaacaaaattaaaaaatagacacgctatgatttctgtgatttttgtagttggaggcaccagggattttatgcagccatgtttttttggttgcatttatgtaagcttttgttttcaaataattttttattgaaaatttaaatttaagaaagcattaatttttaaaactattatcttgatcataaaagtcttcagtacttgttgctgagtatttttaatgtagaatttatggagaagaaaattagaattatcaacataactatggtacagaaataactattgttaatgttatcatgtattctctttaagctatttttctataacacacctatgcaccttaggaagaggacatgctattggcttattatttaacgcttgttttaatgtctctttgattttgtgtcctttgttttaacttgcaacggatatatttgtgaggaagtagggaattaataatagagaaataaattaatttggcaaatgtattttgcaacttctttatcagattcaattaaatgtacaagtcactttcccttagagagttgcttatctaatgtattccaataagaaattcattgatgtgaattaaatcatttatttctaatgttattagggataaaaatgtaacagaccttatcagtcacacaaagataataggaaacaggtaaggagagtagacttacaaaggaaatgtataaccttcgaacaaaattgaccaccagagaggcacaactatatgcatgagctctgcatgcagacaagcaaatggaactgataggcattttaaagacatctgataaaataaatggctgacaacattgcacaataacttccccttgtgaccactgcttcctttcttggatgtataataactgagacttttgaatgtgacacatttatccatttgtgaaaataatataactctaatataaattattttagctgaaaataatatcacattcctgttcctgttttgatggcagagactaaacaataatatttcaaagggcgcctacatacacatacacacacccataccccaccttagtaatgctgaaacataagaaacaattgaaaaataacgtaagttaatttggaaaattatatagtgcaattaaagagtcttatcgaaaatcatttatatgcaaatatatttataaatgtggacaatctataacaggaaaaccttattctgattagtcttaaatatatgagtttatttatatattctattcagtcttctactgaattctgcattacatttgtatagtagatatccaaggaaaaatgttcagttgcccctcattactactataatgaaattaagttctgatgacagagtaatatattgaataaaaaagaatctatctgaaactttcatcaactcataatgaaaaagccataggaatgtatgttgaaaaacacatagtgtttgttccctgaagtgaataaaaatagaaaatgtggagaaaagagcagtttataggataatacttagaggaactgggttaacattttcaatgaaaggaatacaagcatcattgggtccttagagactagaaactataaaaagagaaattgaccatcaggcttgagtaaggaaggctgaggaactaggatatttcaagcttttaaaacaaggaaaagcatttcaccattcactaaacaacttaacctggatcactttctgaatccagtatgtgctctaaattgcccctggaataatttagaaagatgcttcatagaaaaagagagcattcaagttatcttagcgcctggaattattccagtactcaagaattagatctctactcactcaatttaccaaatccattgcaaagagactggggactaccgatgtaaaagtaagctgataacagtggaagttaaccattttcacttaaattgttatacaaaaatcaaacttttttactagtacagaatatagataattaacaccatttcaaaacactttcctttccctcctaagtaccatagctcccagtcttagaggcatcagaagacctaacatctaaaaatcaaaatttcaaaagaaatgttacaccccaatatactgataaaatattgaaacttatttttatatagtgcttagcattataaaaagcatttgcagccaggcacagtggctcacgcctgtaatcccagcactttgggaggccgaggcgggcggatcacaaggtcaggagatcgcgaccatcctggctaacacagtgaaacaccgtctctactaaaaatacaaaaaattagccgggcgcggtggcgggcgcctgtagtaccagctattcgggaggctgaggcaggagaatggcatgaacctgggaggcggagcttgcagtgagccgagatagcaccactgaactcgggcccgggcgaaagagcaagactccgtctcaaaaaaaaaaaaaaaagcatttgcaaacaaattaagtcatcctcataactacattttgagctggtagaacaggcattatcaccattttaaacacaaggggattaagaccatgaagttaaataaaataatcaagactaatttttattttattttatttatttattttttattcaagcaccaacgtgaaccagataatttttttaaaatgataatactgttacaaccaagactcagtactctagtgtttatattgtgtattttatataaaattacacaaaatagccataaaataatcaaatccagatacactgttttgacttctgctacaactacacgtgtctccataaaacagaaaaggcagttaagaaaaatgggatgctccctcctcagactgggtttcgggagcaaacaaacaaacaaaaaaacataaaatataagcaccccacccatgcttctgatcctgtcttccctttctggtatggtagtaccggaagaaaggaaatcaggaactggcttgtttctgcagcactggagaggactgtggtttgttggggaattacgcaccttagcgcactctaagaaaaggaagtaggaagcttgtctctgaaggcacagcttgccccattaagttggttcatggagacccatccctatcccttacaacttctcactcaagaataagctactcagtcaaaacagtggccagaatctgactaaccatagtccaggaggaatgactattaattttatttcccaaagcattcatactgagataaaaattctcaagaaaagctcttaccttgagagtaaggatgaagattcaatgtgacatttggggcattttatttttatctttatgttcaaaacaccaaaataaataagacttgtttcaattttaaatcatttgtgcaaagatggcttaacttggttttttgaaaaagcagaagaggtaggaaaggattgagataaactgtcgttgatttctcaagccaacccagaaaccaataatcaatttcctttgaaggctgtgtacataccaacaatatgtcaaattatattctccttcattcaaataccacgactgtttttttgtcccctgtgtgatcgaattatcttatttctatgaaagaagaagcatttatcttctaatcacatcaccaaaatttttcgggttgaatagattttatctcaatcttgttaaaggctttctttttttttcagaaccactgactgcctacagacacagaaaccaaattgtctgggcttgaattcagtgccacgacttgggaaagtcattgaattatgcgtgtgtcttgatttccccattgtacaatggtaataatagtaatcctactgttgggactgatgagagggattcagtttatatgagtatacttagaacagtgacttctaatgtacttagatcagtgacttccacaaaatatgctgtaattagtgttatatattatttttacttgttgttgttattcatgtctctttcattctaggcccattccagagccatcattcttgaatacttttcttggcattcctagaacaactgcactattgcacatgttcctcttagtttctcccatcatgtttgctggagtacagccacaaataaatttcttagaaagaatgactcagataacatttctattttcttgtctgaaaaatgactgtattgtgctgtgaaactttaatgctgagtggctggaaatactggtatacaattattttctattaaaacttagaagacactgcttctttgtcctcactcatactacattagtgatcaaagtctagtgctacttgaatagttgtacatttattagtgacatgtcatttttctctggaaacatttttacaatctcttggaattttttaaaactttttccactgaaagtttagaaggtttatcaatatatgggcctttcttcattttttttctataggcccttggagggctatgcaatctaatgattttttactttcttcaacaatgagaaattaattcaaatatttattatgaaatatttttatccatttttctgatatttttattaatgtattttcttcttttaaaaatttatttatgaaggaaagaggtttaattggttcatagttccacatggctggggagtcctcacaatcatggcagaaggcaaagaaggagaaaagtcatgtcttacatggtgtacagaagaagtgcaggggagctcccctttataaaaccatcagatattgtgagacttattcactatcatgagaacagcatgggaaaaaccaacccccatgattcaattaccttccaccaggtctctcccacacatgtgggaattattggagctaaaagtcaggatgagatttgggtagggacacagccaaaccatatcattccgcccctggcccctcccaaatctcacgtcctcacatttcaaaagatggcttcctaacagtcccctaaagtcataactcatttcagcattaacgcaaaaacccacagtctaaagtctcatctaagacaaggcaattcccttccacctatgagtctgtaaaatcaaaaacaacctcctggattaattttctatgaatttttatctcttttctctcagtttttgaattttgcattctgccagacttatatttgggtatatgtgttatgtgtgtgtatttcttttatttcaaagggctttttcctggtctctaaatgttgcctgtttatagcatttgattcttactttataaatttgtctttacatatcaatcataatttttaaattctcttctaattcctgagttacctttgtaatttttggtcttttgaattagctattctgttagtttttcaccttattgctgttaattttcttcatttgctgaattatccttaaccatttatttctattttaacaattagaaattgggttaatctaaatattatgtatgaatttcctccaccgttgtacatgtaagtccttttccctaatcagttgcctctttttttaaaattttattattattatactttaagttttagggtacatgtgcacaatgtgcaggtttgttacatatgtatacatgtgccatgttggtatgctgcacccattaactcgtcatttagcattaggtatatctcctaatgctatccctccccctccccccaccccacaacagtccccggagtgtgatgttccccttcctgtgtccaagtgttctcattgttcaattcccacctatgagtgagaacatgcagtgtctggttttttgtctttgcgatagtttgctgagaatgatggtttccggtttcatccatgtccctacaaaggacatgaactcatcattttttatggctgcatagtattccatggtgtatatgtgccacattttcttaatccagtctatcgttgttggacatttgggttggttccaagtctttgctattgtacatggatgcaaaaatcctcaatgaaatactggcaaaccgaatccagcagcacatcaaaaagcttatccaccatgatcaagtgggcttcatccctgggatgcaaggctggttcaacatacgcaaatcagtaaatgtaatccagcatataaacagaaccaaagacaaaaaccacatgattatctcaatagatgcagaaaaggcctttgacaaaattcaacaatgcttcatgctaaaaactctcaataaattaggtattgatgggatgtatctcaaaataatatgagctatctatgacaaacccacagccaatatcatactgaataggcaaaaactggaagcattccctttgaaaactggcataagacagggatgccctctctcaccactcctattcaacacagtgttggaagttctggccagggcaattaggcaggagaaggaaataaagggtattcaattaggaaaagaggaagtcaaattgtccctgtttgcagatgacatgattgtatatctagaaaaccctaatgtctcagcccaaaatatccttaaactgataagcaacttcagcagtctcaggatataaaatcaatgtacaaaaatcacaagcattcttatacaccaacaacagacaaacagagagccaaatcatgagtgaactcccattcacaattgcttcaaagagaataaaatatctaggaatcgaacttaaaagggatgtgaaggacctcttcaaggagaactacaaaccactgctcaaggaaataaaagaggatacaaacaaatagaagaacattccatgctcatgggtaggaagaatcaatatcgtgaaaatggccatactgcccaaggtaatttatagattcaatgccatccccatcaagctaccaatgactttcttcacagaatcggaaaaaactactttaaagttcatatggaaccaacaaagagcccgcatcgccaagtcaatcctaagccaaaagaacaaagctggaggcatcacactacctgacttcaaactatactacaaggttacagtaaccaaaacagcatggtactggtaccgaaacagagatatagatcaatggaacagaacagagccctcagaaataatgccccatatctacaactatctgatctttgacaaatctgacaaaaacaagcaatggggaaaggattttctatttaataaatggtgctgggaaaactggctagccatatgtggaaagctgaaactggatcccttccttacaccttatacaaaaattgattcaagatggtttcaagacttacatgttagacctaaaaccatagaaaccctagaagaaaacctaggcaataccatttcagagacctagacatttaaagataatatggctaagaaagagcagaaattttatgtttccatatgtgggaaaacattcttcttctgttttgaaaagcaaaatttcatctcacttgaatgatggtaattgcaacaacaaacatattaataaaattatgctcattttctttaattttcatcctgtccaatatgattttaccactttccatatacaacttgtttatttttaagtacagttactactccaacttgctcaattgcatctaaactttaaaaaataagcaaaaccccatattattttggtattaatatcaaatatttatataatattttactttattataatctttcacaggtaccatgttatttgaacctcatatagatgatatagagtacctaaaggaaaagattattatcctaatcttacacacatgggaataaatattcagagagattcagtcactttcccaagctagtaagtgaaatcgcacaatctgatggtttccagacctaaagctagagatctctgagcagtgtgttccaataattttatctcctcaggttttaggctgccaggcagagtttatgtgccattaatcatctagccagttgtctttatctgcgagaaacctcattctttagacctgtgggccatatacatatcgtcatttttacatgtatcccttaatagaaacatagttggaaagtattgctacaggccaccagtgtctcctagagacatttacctaaataagtgttctctattctaaacacatcctgatattaagttattaaatcttatcatgtggccttacctaaagtgcatttctctctttagatcatataccaattcttgaccacatatctcttactatatttcaacaagaaacagctaaagaaatatctctgtatatacttcaggaagatagagaaataaatggattaatggatgaatagatatatgatagatagatagatagatagacagatgatagatacttgtagatacagactatgcttgatgctctaaatccaaataagtgtccaattaattagctattttcttctcaagttgaagttcaacatgcctttggatgctatggcaataattaaggttctaatacactcaataaaagtaacaaaaatgtaacttttgaatattgctttactattcacaatctgctgggtacttttatatgtgttttctcttttaagttttcacaataattttgtgaattatccattattccatgattatccctaagtttcaaatgagaaagtgtttatttgttagatatagttccttttacaattactttaagttcattatcagcctagaacttcctaaatgttctgaggaatgatcctgactagccatctcatttctgctaaacaaatccttccactaatgtttattatttggtctccttgtaataactaacaaaattcttagaatgtaatgttttctctttcttgactaacatatcctgagactaaatgagttattcagctatcctgagctagggttattagttccacctacatcctcaaactttcagaatcctcatctccacctaaagtaaaggatttaaaaatagaccacagttttcaatataaaattttcttaaaaacacagaactattaaaagacataattcctaccaaggagaaaagatggtcatttcatcacacaaatcctttataattggtatctctccattggcagtgcatttgctagtaatccccttaagattagagggtgacaaactcacagcagtgcagaaggagcacacagtaacaaatgggaatcgtgaggacagaaaatcacatgactagaacagattcagaatcctgggctgctttatctaccacccgacattctgcctttcagcaaaaatagtgccataatgtgctccacaggcccaaagtcaaactcaatccccattctcacataaatatttcatattaaagaaactgtttcagagcctcagagcccacacaagcttgtttcaaaatgacagatgaccctctgccctacggagaccgatttcactgactacctcagtgtaagttttggaaagagtatcctgtgatgaatttcagcaacaacagttattctgctgttcacaagcctaacagccaggcagcaatgaagagccttgacaccaaattcctagccttaggttcagcagtcaggacagcaatctccttgaatgtctggtagacacttccccgccttagtgcttgatatgtggcagattattaacttcagaattgtcagaatgacaaacaaggggaaagcacactctgaagagtgcttgatattaggaatgccttgtttttaatgttagtcagggactttaaaaagcttatattctaactgaccattatattaaagttaacaatgctgacctaaaaacaccaatagtctcgtcagttctttaccaaaatgtctgtattcttggacagacaccaaaagcctttcatctttataaacttccagcattcctagatccaacagcagacatatttccactctttattctaccaggtccaaaataacagaaaagtagtggaaagagagatggcaatgggttggtatttacaaagcattttcctgttttatccatccattcatttattcagttaatcatcagtatttattgggcatccattatatgttagtcagtggtatggctatggagtggtaagataaaatcaagttctatgagcagatccaagtctagtggggttatagggagagggggagagagagagagagagagagagagtgtgtgtgtgtgtgtgtgtgtgtgtaaaatagtattaataggtaaccatgagccagatataatgtagaacttcatggccataaaataaaaaaaaatatattcatatacttttctaagtttgattagaagctaaagaaaacatctgagcaggaaaagaacatgatcagatttactctgtagacatatccctttggcttcactgtgaagaatgtgagaaaatacagaagtagagcaaccagttgggagttcaagacaagtgttggaacgaactgaaggtatttaagactagggtaagattgtcaagggggttaaaaatttaccaattttgaacaattttgaagttagatctaagaaaagtgaatgtggggcttgagaaaacaatccagaaaagctcttaaatttctctaaacagctggatggctggtgctacatgctgaaatcaggagaacttaagggatggcagcaactaagagttctatattaggtctagaattatgaatgccttgtagacatgcagtagaattattacattggcagttggatatacagatccgagagaggttcaggatgaagctgcaaattgaagattcatccatctaccatataggtgatatttaaatctatgagattaagtaaaatcagttatggggtgagagtagacagagaagtgaagtctaagggtttaactttggagcagttagtcagaaatgctaagtgaagaggctgattcatgaaaggagactaagtcatgagtaaaataagaggaaaatcaggatagtgtttttttgttcatattcactttggctgcaggaatcattttggggagtgtgaggtagtgttacctccaataagaagtgaccacagttcatctagtctaagatggcctttgttttccacatttacatcactgatatcagcatgcatcttgtaatactggtgtcttcagattgtgtcacaatttaattggcagagtttttaatgctggtacataaaataatagtgcattttgtaatttgtatacaaattttattggatctaattcttttggatctatttcttttagatctaattcttttagatccaatgaaatttaataagatgactatacaacacagcacaaacacaggttagagatatttctctctttctctgtttctcactgtctcttgtctctttctccattaccattaccatatttaattatttgaatacttaaggattcttgagaatttcttaagagaaaatttattttcctaatcgaaaataataagtaggcaacaaattaatgagttcctacatatgatatttgagaagaaggataaattcccatggtatattatctgtatgtttatcatcacatataatacttcataaagggaggataaatatacagatgttccttgaattacagtgggtttacatcccaataaacccattataagttgaaatattgtaaataaaaatgtatttaatacacctaaaccaccaaacacaatagcttagcctcacctactgtaaatgtgcccagaacacttagtagcctacagtcgagcaaaatcatctcatgacacagtacattgtacagtgtcagttgtttacgctcatgactgtagctgactgggagctgaggctcacaactgctgcgtagcatcttaagaatatcgtaccacatatccctagcctggggaaagatcaaaattcaaaatttgaaatacagtttctactgaataaataccacttttgcaccatcatgaaatagaacaattcaaagtcaatccattataaactggggattatctgtgttatgctctgattataaatccatcaaatgaaaacttactctgttatttatcaagcaatacatttaaactattcttataaatttcacaactaaaacatatcttgataaaatgttaatgattactttcaatttactagaaataaagaaaattatggcacatgctagaaaaaaacttttgttcatggtaattttgcaacaaaattgtatcttcaaatatttaataattgctcttataatgaaaattggccttggaagtgaatgtaaactatacagctatccaaaattgttatgtaactggaagtagtaaacaactcattattttatcaaaaagtagttagcagtatatagtcattgtacatttgtcatatacaggagttgttttgcattgtaacaagctgatattcctgcctaaattaaatattgaaaaattatcagcaaaatatgtgaagtatatggatatggagaataccaatatttgcaactcattcctgctaccagtaatttttaaatggagataaataaataggatactgctggattggggactgttttataattttcttgcagtttgttttcattaggttattaagttgttactctgtttcaaagttgaggatgaacaattaccctggtttaccattttgtaaacaagtattcatgtcagtgacactaaattgttcagctgcagtaatgagtcaaagatcaattaagcacaagacccataatggatcaaggcacaaagatttttttttcccccaatccatttgaatttagaaagagacagcctggcttaatctgtcttctgaaacgcaaggtcagcagactggaggatatcagctgccactctttttgacatctccaatcaatcaaccttgattagccatggaattggacttcagagttaagaaaattatgtttctcacctcctctactaatgcttgagatgaaagcaaaatgcatcttgattttaaattttaaacaaattgtgaagtccaatttttatgtattactcaagccttgtctgtaagacccataaattcacaaagttaaaatgtatttcaataaagagccagacagcttttttatttaaaaatggaattacatttctaaattataacataaatataactttaaattacatatctcacagaattatttttatccaaacatcacatttattgctacagagaaagtgatttctaattagatgaaataaaaaaaatagtctgcagggtatgtttccccaatgaccatgaaaacaatttgcatttcagggattagagtatatatttttattagaagaatgacaaggccaaatgaaacccagacaatctgactacaaagccaaagctaagcagaccaatggaagcaaaaccatctggaatatttggcgtcatgctcatagaatacccaaaattggaaatgggtcactttgttgaagttggtgtgtgtgtgtgtgtgtgtgtgtgtgtgtgtgtgtgtgtgtgtgtgtttgtctaacagggactctttgttttcttttctttggtgatgttttcctggtatgcccagatttgttctatgcaaaggctatgtaatttatctctgagtatgactgcatcatctccttcttctctctgccctctcatcccatttcagagatttttttctacaaccttggccttgtcctttgttttgcctaggccatgttaacgtaatccactaacatattttatttgagtaaatccattttgttttgcttaaaatattgggttatatgattcaactctccatttaacacttgtgaacaacttgtttttaccatattctccagctataaaatgtgtggtcttttggagtcagtatctgtattgagaaatttaatacgcttcatattactaaaaaaaagacacactttctttcatatttctgccaagaggtgagatctgttacctgtccacacatgtttcccatttgctacttaatactattagaggagttcctgcttcaagttttgggaaccttgcttgccatttcctatgacttctcaataggtgatttatgaaacacaaccatagtttgcatgtttacaaaatgtttatgcaggcgtttcttcatggcttctacatggcaaatgaagattcaaattttccttgtgaattggtttctagatttattgcctatgaagacctggggaaaccctagacaatcttacagttcctgctccctaggatgtctattgaaaagtgtactcctcatctccaatgttgcagacacaataaataaaataaagtggtaaaatgatgacaaagacacaagtaacctagtataagtcttgttgtggctgggaaaagaaaagataaatctttcacatccatatttttacagggtaattttcattaaaaaattacttctggctataatgctcagatgaattgactagtcaggctagtgtattataagtactaaaaaagatgaatggaaaacaatatggcattggttatcaacgagggtcaaaatacaataatctcactctggagtgaaaaagtaatccaaagatccaaatgaggatgacaagtcatagtgagaagcacagggaagtacagtcaaatctactaagcaaaagtcagcaagggtagctacagaggttgaataagttcaagagaaaggtaaaagtgttacaagttaagatgaaggtgcctgggaacactaacttcaatgacttgatgggtgcttctaactccacctgactgtagcttataagttaccttttggggatttaataacctatggcctcataaactacatgtatgactatctcacagagaagatagaggataataagagctgtccaatcattgcttgaagatatgttatcaaatgtccctttttcagattacagtcactaatgttaattattaaatcattaaacatatgaaaatttctttggcagaataaaccataggcttggacatataagcgatcttcaaaatgtttgtggaaaatgtgtattatgaaaaaagtatgtatggatttccattttttgcaccaaaataaactcctgctaacttattatgacatgtctgaatagaatatagtttgagatactaagaagaataacacatcaatttgaaaagagcccctataagagcaaccttaatatgctaaaattgaagcaagaacaaacatcaaatgtatggtgaagcttgagtggatgaatggtgaattcatggattctttacaaaaagtttatgggaacaatgccccatataaatcagcagtttatagaaacttattttaagatgggttgagatgatgttgaagatgaagcctacagtggcaaaccatccacatctatttgcaagaaaaaaatatttgtctgttctcaaattgaataggactggcaattcatggcagaaacaatagccaatatcatagacatctccattgttttagcttacacaattgtgactgaaaaattaaagctgagcaaaatttccactgaatgtgtaccaaaaccattgtacccagatcaactgtagacaagagcagagttttcaatggaaattttaaacaagtaggataaagatcctaaagtgtttctttcaagaattgtaacaggagataaaatatggctttaccagtatgatcctgaagacaaaacacaatcaaagcaatggctaccaagaggtggacatggtccagtcacagcaaaagtagcctggtcaggaacaaaggtcacagcactgtttattttgtgtgatactcaaggcattttcttgttgactttctgaaggaccaaagaatggtaacatctgcttattatgagggtgttttgagaaagttagccaaagctttagcagaaaaatgtccaggacagtctcgccagagagtctttgtccaccacagcaatgcttctgctaattcctctcagcaaacaagggtaattttgcaagagttcctacgggaaatcattaggcaaccacgtcaccattctgatttggctccttctgatttctttttggttcctgatgttaagcaatctttaaagggcatctgtctttctttagttaataatgtcaaaaagacagcattgacatagttaacttcccaggatcctcagttctttagagatgcactaaatggctggtatcatcacttataaatgtgtattactctgatggagtttatattgaaaaataaagtttacgttttatgcttatcttttattttggagtttatattgaaaaataaagtttatttttatacttatcttttacttttattttgtcatgagctttttgaagccctcttgtatatgcctgtaaaatagaaaattctatatattgttgtaaaaatgtattgcataactcttatatacgaacaggaatataccatcgaagtggggcacagaaatagaaagataaaatgcatagtacttttcaagagcttataatatatggtgggaggcagaaaaagctataaccattcaaatagttactaagttatttattgtgataactttggggatgcatgtgataagcacctactgtaggcagaataaaacatcacactagataatatcaaagaaataatgtgtgtgcaagaataatgcatggcaaaacacgttcaaagtcatgagagttgtgtctttggacagacataggaggaagaaatctcacttcattagagattaaggaaatctggtttataaaggctggatgaaatagagagaaaaccaaataagatgaacagtaggaggtataaagaagcagataagctgaataataccagatgtgtttagaggtggtagtatcttagtttaactggagcacagaatatgtgttcagaaagagaaggaggtgggtatagaattaaaagtggagaaaatcaatatttttgtgagccttcaacattctggccatgcggtatacaaatttacgtaaattacttcatttatcttcccaaccatactatcaagataggcataatcatcaccaacttaaagatgaggattttaaaagacccagagctactataacttaatttagatcacacagatgtttagtgggaaaactagaatttgaaatcatgtgtatttcgttcttttcatgacaacatattgcctcacgcaaaagtcagatgagactaaaacacaaaactatctgtttttaatcaggttcctgggtttgtgacaatttatgtaataaattttctttaatagtgatttaagaaactctaatcaaatttttttcacactattcgtctcattcatcatatgttctcatctctaataagaaagtgcaaataaaaattacttgtcttttttcctaccagaatcagaattaaaatgtagtaagttctgtttcaaagcttggaatagtgtgaggtagagatagacctataatctgtagtgttttgtcaaaatcagtggcaggcatgacgttaatcatttttcaataatatgttaattcatggaaattgcctaacagtattatattattgaaaggaaaatagcaattctacatgaatttgagctatttaccaagtttctttaccctagttttaaaaatttgcagaatttcttttgttttcaggaaactcgtttggagcccttcctcatgaagattaaataattaaagtatgagaaagtggagagcccaatgtgcgacatatgtatattattaaatgtatactaatttatttattcattcatgcatatgatttaattacattttattaatggaaacaaatcagctatgggagctaatttagatgccaaaatattgcccgtgatactcactgaatgaatttgtcacctcctcacaaaatgtaaatttgttttcagataacacattataatctaaagtggtgaaaggcaggataatttctttttaacttgccttataagaacaacaccaacagtgaatagacactaaatattcttggcaaagaaaactaattaagaccccttttcccattcaactctccaaatacatagcccattgccttaattttttattatatatatatattttgctatacataattttcatttggtgcattttatttactactgaccactctcaaaaccattgctgtgtctgagaatcaataggaatattgagactaaacaaaactctaaaatagtaaagtaattcttggagtagttgcagtaataagaacataattttggtaaaaatatgttacgtagcctgagttttctaaaatcagaaacagaagggtgtatgttgcacaggtaatttactaaggagaaacccaataggcagtagggaagcagtcctggatagggaaagcaacttggtgaagttggaagcagtactggatagaggaagcaacttggtgaggagtcagtgacagtctagccacaccctggtcccaggggatctctggagaatgaatagctccacagagtgccctgatttaaggcaaggtggcaagacttgtacagtcattgacccaggagggtgtaacccctcaagaatctccggggaaggtgatttctgtcaatctagaccagttgttattaatgtgtggtcccaagaccagcagggtcagcatcacctgagaatttgtaagacatgacacatactacatcagaaactctggaagtggggccaaccgatttgtgattgcataggctctccaggtgactctgatgtatcttgaagtttgagaaccactggcctagggcaatcttccagagaatgacaaagctgtgagctcctagcatccagtcctcacagcattaaatgctgacttaacaactctgtgaaggaagtccagatcagccaccaacagcacccactacatgttaaatgctttagttgtattatagtaaatcatccctctcttgtattaactatttgtagcttctgtaaacttgataatttaacatctgccctatgctagtgtccagaagactctttgttctggacaatccaatagtatgtctaaatcaccttgctttggcttcctacctcactcctcacccctcccttcctccttctgggagggcacttttcaaatacaaaccagctactccagagttcactctcgatcacctcatttattgtactctcacatctgctctaatcacccccacagcaagggaactggacaactagaaatacctcctttgttctagagcccactgaaattattttaaccagccaatcctaaatctatttatgctgtctcacctattctttcccaccaaaacaataataaagtcctctgccttaaagctccttcccatccctctgctgcatgaccaacctctgatgtattccccccatgacgtaacacacctcctgctttaagaaactgtgagtaataaactatcttttcaatggcaattgttttctgatctgttggacttaccgtatctcaaattttctattaattcactatattttcaaatctatctctaccacaatccactcccttgtggtgcacacaagattcatacccaggaggtatgaagagttataccagtgtgtgtgattccattacctccactggtttggagttaaaatttcaatttcgggcagttagaggaagagagattccaaagagaatataaaattatacctcatacgatttcttataatgtgaatcccccttttattttaaacaagcataatcaaagttcacacaaagatagggaaagtatttgcatttaccacataagagttggcctagagaagaaattcaactgtcctctgtgccagaatttacatagattttcctttgaagcatcacacttcagttgcaaactccctttgtgctcacatgcagaacacagttttaattttattataaagactgtaatatgtatactttttgtcaaaacaaacaattatgtgctctttgttttcacggtgtgaatggttatgccaaggctgacactttgggtgacaaataataataaatattaaacacaagtaccaatgtaaaaggagtgtaattatgtaatgaagctattttcccacaataactaacgtgacatgcatcctttggcattgatttgcattggatatttctacaaattgcccagagtcagcaacattgctttattatgtgctaatacttgttcatgaatatatgtttcaattttgagtaaagatttttttttatcaaagactttaaattcaaaagtgtgaacacagtcccagctctagtgaccttgtctttcaggtattctctggtgtgccaactgagaaaattgcaggagatacattcatcttcatcatgtgtgtttgatagcagttattgaatttttaaaattaaatagtttgcagcctattttagagtccaaaattttctgttaaattttctatcttatgagtgatttatctgtaggtccaaaacagtagaggctataaagctgtggcccaaaagattcttgctctgtgaatagattaaaaggtttttatctcactagaagaaaagctaacgctttacacagatgccaaaatccaatggtgtgcaatatgcacaagttatatcatcttcagtggtcaaagcttggctagagactgatgtcagcctcctttgtgaaatattccttgaaaaacagaggttttagctacttgaggattacaagtcactactagcataattcaaaatttaattctactcctgattttatcaggacaaggaagaataaggtttaaagtttacagggccaatatcttagcttttaacatagaggaatatttgatgagcttatcatcacctagcaagcctatcccatgctgtgatgatataaaggaagctgatattctatgtcacatagtttcatttataagacttagtttatactaggagaaaaaagattaagaaatacaattcaaaacccacagcattttaaatgtattattttcccccaattgtaaactttttagcatagaaaattgctttttatactaggagctcatgatttattgtgtcataacccccctaacctattcaatcagatataatgacaattgtggtaaaaacaaggataatggtaattacaatattaataatatagctgcaatttcataagtgtttataggtgtcaaaattgttctaaatgctttggatatacgcattatcattagaacaatctcattaggttcattttccagatgaatctgagatgagcgcctaaacctatatatgggactctggaataagcagattggattcaaatccaggctctgccactgacaaggtggataaccatgggaacattacttgatctctgacacacattaattgaactgtaaatagctgaccatttaaaagacccttaaagtgaagcctctttataatatgaatagtatttctaacatgaactgtcagctttacttctgaaatgtgttttgatttggtttcctcctacccacattcacagttgttttatgagtctgtaacttcatctatctcacctagacaaaacttattctcttcctctactaccagtggtgttttagaacaagctgtaccggctcataaaattacaattgttaaaattcaggaattctgaaatctggttattaaacaattggcaatttgaaatcagccacagtgggagtgtttacaccagagaaatctgtaaattctacaaatctgtgcttttccttctccccatcgcctgctggagatccagtttaccagcaaattaatcctactctgctagcctagtaatattcaaaagcacacatctggtcacttttttacatactgtacttctactgacttcccagttcctggaacccaaattacttaaaattacttgtaatcattttcataacttaataataggcaatcttcccagctactccaactctcatttctttcatcaaacaacaaatgtatactatgttacaataactcttgacttcttaacattccccaaatgtattatgaactctgcacatattgtcattcatagtttcatttgcctagaattgtcttcatatgatgtatattaggatatttcttccttgttcttcatgattcaattttgttttctaatctgtataacttccctaaatcctttctcacttcaggaaaaaagaaattcctccctctgctctttttaatagcacatttgtaaatgtgaaccttaaacttatcaccttaatttatatttgcctaggtgtctagctaaacagatccaggatgtgagactgtggcttattacctagagtatagtaggcgcttatcagagaaaaagttctctttaggtagttagcaggtaaggaaaactctactcaagactattgcaataggagtcaagactactgcaatagggtagacagactgaactgaacccttctaaaacaaaagataggagagcctttaagcattgaggtgatctaggggaaaagtgctggaggaccttgcggaagcagtgttggtcattgtgattaggccacctgtgtttgctaattgtattatcaaagttaggcttctaccctttcacagaaacaggtatggaggctctatctttcttaatgattatatttgaaagaaatggctcccagatccttgagaaagaaattcctgatttgtaaaacacacaagagcccagcaaagatttgcttctcaaagggacagagaaagaatttacaatttcagattttctaaagtaaatactctaaaaaagggagatcagggacctaaagtcagaaagaaaccagtttatgccaggctttggtatcaggatgatgctggcctcataaaatgagttagggaggattccctctttttccattgagtggaatagtttcagaaggaatggtaccagctcctcttgtacctctggtagaattcgtctgtgaatccgtctggtcctggactttttttggttggtaagctactaattattgcctcaatttcagagtttgttattggtctattcagacattcaacttcttcctggtttagtcttgggagggtgtatgtgtccaggaatttatccatttcttctagattttctagtttatttgcgtagaggtgtttatagtattctctgatggtagtctgtatttttgtgggatcggtggtgatatcccctttatcattttttattgcatctatttgattcttctctcttttcttctttattagtcttgctagtggtctatcaattttgttgatcttttcaaaaaacgagctcctggattcattgattttttgaagggttttttgtgtctctgtctccttgtgcttgtctgatcttagtatttcttgccttctgctagcttttgaatgtatttgcccttgcttctctagttattttaattgtgatgttagggtgtcaattttagatctttcctgctttctcttgtgggcatttagtgctataaatttccctctacacactgctttaaatgtgtcccagagactctggtatgttgtatctttgttctcattggtttcaaagaacatctttatttcggccttcatttcgttttgtacccagtatcattcaggagcaggttgttcagtttccatgtagttgagcggttttgagtgagtttctgaatcctgagttctagtttgattgcactgtggtctgagagacagtttgttataatttctgttcttttacatttgctgaggagtgtgctttatttccaactatgtggtcaattttggaataagtgtgatgtggtgctgagaagaatgtatattctgttgatttgggatggagagttctgtagatatctattaggtttgcttggtgcagagctgagttcaattcctggatattcttgttaactttctgtctcgtggatctgtctaatgttgacagtggggtgttaaagtctcccattattattgtgtgggagtctaagtctctttgtaggtctctaaggatgtgctttatgaatctggatgctcctgtattgggtgcatatatatttagggtagttagttcttcttgttgaattgatctctttaccattatgaaatgcccttctttgtctcttttgatctttattggtttaaagtctgttttatcagaaactaggattgcaacccctgcctttttttgttttccatttgcttggtagatcttcctcaatccctttattttgagcctgcgtgtgtcattgcacatgagatgggtttcctgaatacagcacactgatgggtcttgactctttatccaatttgccagtctgcgtcttttaattggagcatttagcccatttacatttaaggttcatattgttatgtgtgaatttgctcctgtcattatgatgttagctggttattttgctcgttacttgatgcagtttcttcctagtctcgatggtctttacaattcggcatgtttttgcagtggctggtaccggttgttcatttccatatttggtgcttccttcaggagctcttgtagggcaggcctgatggtgacaaaatctctcagcatttgcttgtctgtaaaggatttttttttctccctcacttatgaagctcagtttggctggatccacaataaaaaaagagaattttagatcaatatccctgatgaacatcgatgcaaaaatcctcaataaaatactggcataccgaatccagcaacacatcaaaaagcttatccaccatgattaagtgggcttcatccctgggatgcaaggctggttcaacatatgaaaatcaataaatgtaatccagcatataaacagaaccaatgacaaaaaccacatgattatctcaatagatgcagagaaggcctttgacaaaattcaacagcccttcatgctaaaaactctcaataaattagggattgatgggacgtatctcaaaataataagagctatctatggcaaacccacagccaatatcatactgaatgggcaaaaactggaagcattccctttgaaaactggcacaagacagggatgccctctctcatcactcctattcaacatagtgttggaacttctggccagggcaatcaggcaggagaaggaaataaagggtattcagttaggaaaagaggaagtcaaattgtccttgtttgcagatggcatgattgtatatctagcaaaccccatcgtctcagcccaaagtctccttaagctgataagcaacttcagcaaagtctcaggatacaaaatcaatgtgcaaaaatcacaagcattcttatacgccaataacagacaaacagagagccaagtcatgagtgaactcccattcacaattgcttcaaagagaataaaatacctaggaatcgaacttacaagggatgtgaaggacctcttcaaggagaattacaaaccactgctcaatgaaataaaagaggatacaaacaaatggaagaacattccatgctcatggataggaagaatcaatattgtgaaaatggccatactgcccaaggtaatttatagattcaatgccatccccatcaagctaccaatgactttcttcacagaattggaaaaaactactttaaagttcacatggaaccaaaaaacagcctgcattgccaagacaatcctaagccaaaagaacaaagctggagacatcatgctacctgacttcaaactatgctacaagggtacagtaaccaaaacagcatggtactggtaccaagacacagatatagaccaatggaacagaacagaggactaagaaataatgtcacacatctacaaccatctgatctttgacaaacctgacaaaaacaagaaatggggaaaggattccctacctaacaaatggtgctgggaaaactagctagccatatgtagaaagctggaactggatcccttccttacaccttatataaaaattaattcaagatggattaaagacttaaacattagacctaaaaccataaaaaccctagaagaaaacctaggcaataccattcaggacataggcatgggcatggacttcatgtctaaaacaccaaaagcaatggcaacaaaagccaaaattgacaaatgggatctaattaaattaaagagcttctgcacagcaaaataaactaccatcagagtgaacaggcaacctacagaatgggagaacatttttgcaatctactcatctgagaaagagctaatattcagagtctacaaagaactcaaacaaatttacaagaaatcaacaaacaaccccatcaacaactgggcaaaggatatgaacagacatttctcaaaagaagacatttatgcagccaaaagacacatgaaaaaatgctcatcatcactggccatcagagaaatgcaaatcaaaaccacaatgagataccatctcacaccagtcagaatggcgatcattaaaaagtcaggaaacaacaggtgctggagaggagtggagaaataggaacatttttacactgttggtgggactgtaaactagttcaaccattgtggaagtcagtgtggcgattcctcagggatctagaactagaaataccatttgacccagccatcccattactgggtatatacccaaaggattataaatcatgctgctatagagacacatgcacatgtatgtttactgcggcactattcacaatagccaagagttggaaccaacccaaatgtccaacaatgatagactgtattaagaaaatgtggcacatatacaccatggaatactatgcagccataaaaaatgatgagttcatgtcctttgtagggacatggatgaagctggaaaccattattctcagcaaactatcgcaagaacaaaaaaaccaaacaccgcatgttgttacttgtaggtgggaattgaacaatgagaacacatggacacaggaaggggaacaccataccctggggcctgttgccgggtggggggaggggggagggatagcattaggagatatatctaatgtaaatgacaagctaatgggtacagcacaccaacatggcacatgtatacatatgtaacaaacctgcacattgtgcacatgtaccctaaaacttaaagtattaaaaaaaaaaaaaaagaaaccagtttacagttaaactaaggggaactttaaggccatcttggtcatgtttgacaaatgtcttaagaattgtttgtgtttgtcaccagtgatgtgaatcccattagttatatgcattctaaaatcatttatggctaaaagcaattaatactttgacctttctatatagacatactaagcatataaatggtgactaccgattgttgttatcttgggaatatttttatagtagtctacctaaatctatgttcctacaaagctgtgtgcataaaaaaattgtattaacaaaaccatattttaaatgttgtgaaatagttgagtatttaaagaacccttaaagagaagactgtacatattttgtataataccacaaaattaaatgttttataaaaatttatttcctaatctggttccccttttaaaagtaagttatttttggtgttttggggataatctcttccttgatcgcagttctagttacacaggtgtttagtaattcactgagatgcacctttatatatcacttttctcatatatatttcaagataatcatttttctatatatctattatcctttggtaaaagaagatatacaaccagtgatatgagatttgaaattacagtttctgcattagacgcctaaggcaaattgcttaattgctctgtgtcttagttcctgcatctataatgtaatgtcatttacctaaactactagttaacataaatcaaaagggatcatatatggaaagtatactacataaaactctaagttaaacaaatgtgagttttatgaatatattaatatttataacattattgttattgttataatgtgttgacatgtttgtatttataatataatattttatttagagttccttaattgctcacatgaccctgagtggaaaatgattaatacactgtgcaatttgtttatgctaaatttatttatttttgcctttgttaataagtttttacacctggtcttaacatagagatttttgtttttgaaaaataaattgttttttccaaattttcaatgttttagataaaaactttcaaatatagaacaaagtggaaaaaaatttgcagtaatcctctgtatctaccacctacattctcccattttctattgcttttttcatataggtaatttctttacatggagtacaattcacctatgtaagtgtacagccttaagagttttgacacacaaatacatttgcataactaccaccaaaatgaagatatgtattttcattttcattttcccaaacggttatcaaatgccagttggtaatcatttccttcccctacttccagctcctagcaacctcagatatgatttcttttcccttgaaagtttttgtttctttgaaagtattagttttcctaaattgacaaacgaaaatagcatatatttatggtgatgtgatattgtatgtttgtgtgtgtgtgtgtgtatatatatatatatatatatatatatatatatatatatatatatacacacacacacaaacacacacattgtggaatggctaaatcaaggaaattaacatatccagtaccccacgtggttttttggtttgtttgttatgtttttgtggtgagatgctatagttttatgttttccagaatgttatataaatggaatctgtattagtccattttcatgctgctaataaagacatacccaagactgaggaatttacaaaagaaagtggtttattggacttacagttttacatgctggggaggcctcacaatcatgacagaaggcaaggaggagcaagtcacgtcttacatggatggcagcaggcagaaggagagctttttcatggagactctcatttttaaaatcattagatctcctgagacttactcactatcaggagaacagtatgggaaagacccgacctcatgattcaattatctcccacagggtccctcccataacaggtaggaattatgggatctacaagatgagatttgagtggggacacagagccaaaccatatcagaatcttacagtatatagctttctggatttgactttttttttaatttaatgccattcaaattcatcaatgtcatgtcatacatgtcaactatttaactaacatgtcatacatgtatttgtagttatttcttatttgctgaatattactccattattcaactgtaccccaatttgattatccattcaacagttgatggacctttggtttctctccagattctggcaattatgaatgaagctgctataaatgtttacaaacagtttttgaatggaaatcgatttcatttctcttagagaaattttctcttggaggaacattatattcctagatgtaagattgctaaatcatatgataggagtgtgtttaacttcttataatattacaaaaactgttttccaaagtggttatgttgttttgcatttctcccaatccataagaggatgctcactgcacctcatcattcccagaagttggaattgttgaatttattttcattttatagccattctattagatatgaagtgatatctcagtatagtttcaattttaatttccataataagtaatgatattgagtaattttacatgtttattagctgtctatgtcttcgctagtgtgtctgttcaaatctttttccattttttcttattgtgtgtttatgttctccttggtaaattgtaatagttctttatattttctgtacacatcttttattaatatttctttacaaatttttttattttaatatttatattcatgtttgctctaatttttattttcttcctcctgcttccattgagcttacttttctgttcaattactaattccttgagatgcagggttagattcactttgacattttccctattatcctaatataaggatgtaatgtataaattttctttcgaatcctatacctccactttacatatttttatatatttttaaaattttattcaatccaatgtatttaccaatttcccttgtgactttctctttgacccaaagttattgagaagtgtatttttattttctaagtgtttgggaaatatttccaacatcttttcattatgtactctagtttactcatttggttttcaattctttatatctgttagtttatgttaaggtagaaaatatagtctcctggtgaatgtttcatgtgtggttgaagagaatgtgtcttctgctgtttggtggactgttcaagtatgtcaagttgattgattatgttgttcaagtctcatatattcttaatgtctttgtgtctttaggagagaggtcatgaagtctctacatgtaattgcaaacttgtctgatttttctctctgttctgtcagtttcttcatatagttttgaaggaaatgtacatgtaggcataaaattattaaatctttttaaggaattgctttcattatcattgtaagttttcatttacctctgctaatattgtttgttcagagtttgttttgatagtaatatagcctatctttcttctgataactgtttgtattatatggcatttttaatcattataattttaacatatatatgtttatatattaaaagcagatttcttttaaaagtatcgaatttctggcttttgaatctaatcttccaaacttttttctattggcaatttagaatatttcacatagtttcacataacataaacctatatagttttttaatagttattaatatgattgaatttaaatctgtcatctttctagatgttcttgcttttcccatcatttttgttttattttactccttgttttgaaacacacaaaaatgattatttttatgattacacatttttccctactagcttattaggtttacttgtttagaatgttttagtttcattaacacttaaagtatacaactttaatataacagtctactttcaaacaatatgatataatttcacacatattattaaaaccttgcaacaatatactctaactcctccaagttatcctttatactgtttgtaatacatttgaattttatatgttataagcatcacaagatagtactttttgcttgatgattgtcttttaaaataagtaatgaaagaaaaaaagtattttataattactctcattttaccattactaggcacacttcttctatttgtgcagatccaaatttttatcttttgcctgaagaataatgtttcttgtagctcaattttgctggtatttttttttaacttttttctaacagcctttattttgccttcattttattttgccttcattttatttttcatgattttttgatggaaaaatagaatttgaagttgactggttgtttcttctttcagcagtttaggcctggtttgcataatttctgataaaaagtctgatgtcatgactcttggatgctctggtcttttcattattttttctcttttgtttcattttggggatttttattgatcaaaattaaagtttcctgattctttagctttgttcattcttctaataatcccactgcatgaattctctatcaatgatattgatattttatttctcgcattttctaaaagcgtttctagcttttatttctagcattttcatttgactttattctacagttttagtctctctgccaaaactccttgtttatctgttaacaaatgctgtcctctttttccaataaattctttaacatgttaatcatagttattctaaagtctttgactgctcacccttttttggtcttggtgattacttatttgttgaaaataaatcacattttatttgcttgctttacatgtttcataattttttatggaatgctggatattatgtagtgaagagtagaagctggtaaagatagagtttctgctcattgataggcacaactcttgtatcatcaggcatctagtataagctttggattaacgtagccagttgagtttggtttgagttttattttttatcatgattcaaattgcttcagtggtggtctgcctgttactttgttcttagtgcgtgtttggcaagctagagaatcctctcaacatttatgcttactctgagctttcaacagttccttcagtcctgtgctacagctaagagtctccacatcctccctcagtgttagactgatgctgtttctttctcaatgctaggcttttgttttaggcaagatagattttctctgttgtctttgtccagcttctgtcttaggcaggtcctaagaacctatacctctaaagttaggcatgtttagcatttctggcctttcttctactggcatccaaactgagtttgtatctgtggttgatcttgaacaggagctttatatctcaatttcagtggattataaatgtagcttccagggaaaaaaactggtcccacacctctcctgtagatgcattttgcttatatgtctctcttgcacaaatggattttttgcctgtgccctgatagtaaaaagttttgttcctcctcttccagctgggtaagaattttctttgtataaatggtaaatccaggaaagagtacaagtttttgatctgtcactttcaaaactgccaagcacctcagcatttctatgagctttttagatcttctgccttgtcccaatctgaggacgctgaggaagagcttgcaagtgagtgaaaactcttttttttcccctaggttccccagctgttctaaacatggcctttaagaacgtgttaaaattttagctgatttcttcttaactggtgaatggcagctaaatctttctccaatttcctgtcatagttagaagagtgggtttcccttgtatctccttggaggacattgaccttatttaatatttagttggcttgaataaactcaaagtgagtccatgactggctaaaaatatgacaaataacttagcctccaacaatatagttgatatgtgctctgttgatatttatattttttattatgtagactgacatgaccagacttcatttctgattacaaaaatcagcacagtgacgtagtttcattaagtatttaaattttaagataaacattttcagccgggcgtggtggctcacacctgtaattccagcactttgggaggccaaggtgggtggatcacctgaggtcaggagttcgagaccaacctggccaacatagtaaaaccccatctctactaaaaatacaaaaattagccaggcgtgatggtggtacctgtaatcccagctactcaggaggctgaggcaggagaatcgcttgaactcaggaggcaaagtttgcagtgagccgagatcaggccactgcactccagcctgggtgacagagtgagactctgtctcaaaacaataaaataaaaataaataaaaaataaaaacattttaaaggcatccaggtatgacaagcaaatcacttacaaggaagagaaatcaaattggcctcgagattctctatacaagcataaaatgtcctaagacaattgaaaaatgtccaataaaattatacccatccaagggctcataagcttcaacatgataattaggcacttacaaacaagaagttaaaatgtgataaaatttggcatgtatattagacgtagacctggcatgatgtagcactggattaagtgtgtgtgtgtgtgtgtgtgtgtgtgtgtgtgtgtgtgtagtggtagtaagggaaagaaaggtattaagaatgatgacagggtccttgttcttttgtcttgagaaactgagtgaataatagtactttttgctgaaataggaaagattgatggaaaatcacattatgaggtgagaggcacaaatcaaaaagttctattttagacatgtttaacttgagatgcctattaatcattcaagtgacagctgggtttatgaatttggagctcagcagaaaagttagacaagaggacatatgtttggaactcttcacccaatttatagtattttaagcaatacaactaagattaaatagaaaaacgttttagagaagtaataaaatagagcttacaaccaagaaataaaaggttcaaaaagttaagaaaaaaaaacaagaaatgtactatcacagaaaaagcaagaaaaagtcaggaatcaggtagttgtcaactgtgtgaaattcaacaaagaagcaggcagaacactagggaatttaatgcaacttcagcaaagcatagaggacaaaagcctgatcaaagagaatttgaaagaaaatgggagatgaggacaaagagatggcaagatagattacttttaaattattctgtgaaaaggtgagaaaaaaaggcaaatgctggaataaaatgtagcataaacagtggagatttttagattaaaatgcattgtttttttcttgcaagatttgagataccaaagcacattggtttaattattcagtatagcagaaaaattgttggtgtgagagagaaaggacgggtcaagaaagactgaaatatttaggaaggaaggagggtgaaaatctgggtcacaagtacaggattggcctttagtaggaccacagacacttctttgtagtgtcaggaagagaaacagagcatgtgcgttacaaattcggtaggttataggtttgtttacaggaagattaaatcattcctgtctatatcttgataagcaaatatgaggtgaagatctcatctgagagtagctaggggattggagaggttggaagagagaagaaaaatacaattgttgtccctgggaatgggaattctcacttattggggaaatgtaaaaaattgtctgaatatgttgattacccatttcagctgtgtgggtataaatggaaagataattcgtgtaacctgattgaataattttctacagcaaaattcaacttttcacatataagtgtagtatagaagaagtgttggattaaatagatttgcagttcagctaggtgaataagaaggggaaatgtcaagaaataaggattttcctaataattttgatgaaacaccagatcttgaactggaattttaattggaagatgaaactaatgattgataacagaaaagaaaatagtaaatttgtccagctgaattaatagaaaaatgaggaggaggcaggagtacagggaaatgcttaaaagtggaattttggaagtattccgttacaaattagcgtggttgtgttccaataacgttttacttaaaaataaaacaggtggcagaccagatttagaacatgggccatagcttgcagactcctatattaatgggtgacatggaactctactagtctaaagtagtgttcagaagatactgctttatagttccaagttcaggccacaggtctagactggggtaacagtttctctatcactaagacaatatgaccaagtggatgtcatgatactagccttagccgtcatgcataagatgctggagggagcttctggagaacccctcaaaaagatgtattttacaaagtgataagcagatccttgccgcagaacacaatggggacctcttgatttctgctatgaaacttctctgacactgttgtaaatgaaaccctgtagcatcctgatcagcactcatataaaaacatgcagaaagtccagagtaattaacactttcagtgccagctttgatccacagagtacaggaaataatggtcagatgtttttgtcttttatcacctgagtacatagttttaatagatattttataagacttctcagaattttctgcttgacagtactagttgctcatagtcacggccaactcagttacataggcttgtatttgtttccccttctgcattttgctttcttcatctctctactgatcattctgagattaccttccccaaaacaccacctgtatcaaatgctcatctcagaaacttatttcaagggaactcagtgcaagatgtcctattaaaactgttttaaaatgcaaaaggcaaaattgcattatattccaatcttccaagataagaacaaagaagtttttatttctgcatgcatttatttatgaagaaacataatatcccccccaaaacctaattttagatacaacaaagaatgtggaacaatgaatctccttttctttctcatagaaatgaaaacgatgtatttgaatacagatttaggagtcaaatataatcaaatgagtctgtaagctgaactggtcagcagtatttgatataattccaagtaacttaaatgatgcctctgaacctctgtataaagaaattaaactaaaaggcaatttgtttttcacagatgaaaacacaaatcagatttttaaatgagactatttctattttctctactattttgtgtggcttcttcatttctctttgtttttcatagagggtgttcagaagagaagtttagtaagttgaggtagagtattcaggaaaagaaaactaaccctgttaatttatttattttgaatcatatttggagtcatagcatgtagctttacctttattttaacttggttatgggggaaaatgaagataaatgatagtcttccctcctctgtttgcatattttgttctttatttctctaaactagagatgtgctgagtgtaacacaatatgtcactcttaaatgggttactacttctatctgtcacatttgatcataagacacaccggtttggggcatgaaacatgcaaataaaaatcagggaaataaaaacaatttccattttcacttaaaaattcacaaactgtggtgctctgagcagcatatggtagttaagaaaatatgtctttcatttgtcttgctttcacagaaaacgcaatttggagaaagagtgaatgctgaagatgttttcgtttagctgcccaagcatttgggagtgctatgaagatatcacttaattgaaagagaggctatgaagtcttgttcccctcttgtcttgagcctaatgtgaccaaagaggttagatgtgatattttaactcatcagttgacggaaacgttttgtataacgtacccaaataatcaaaatttccaaaacaaaacatggcgctacagttgccctttggttcttcattaaactgagtgccttgtaaaagctgtaaccagtgtttgacacaagagaagcctcagcaacactagaaaaaatgattaattatcaacatctgaatttcaccattagtcaaatctcagcctgccctctctgcctgtagaatcttgtctgccatgatgactcctgttagaaatcatcttacttttagtttttagttttctctctctgatttgtagacttcacctcttttgctagcaaaaagttccacaaagcacaatttttcactttttacgattagcaagccccatgaaatacaacataatttattgtgtatgagacaattctgtgcctattgattctacctgttttgagaaaaaaagaaaaaaactttaattaccaaaaaaaagccattaatgcaatcttcttaatatcataaggttactttgttcagtttcagatgattcacgtgtcacatctggtaaactaaacccagggattttttaaaaagtagttgtgaaccgtcaaaggaaaaagtagaagaaagggtgtgaagaggtaagaaaaagagaagaggtaacttggaattagaagttgctgctctgccaattagtaccttagactaatctctttaactctctgagattccatttacactgatatgagactaataatacttgtatcaccaggttgttcaaggagaatatgaaatgatatatatgaataccttctttagctacaaaacacttaacatgttatctaccatttctcagtaaaactgcagaattttaaggtagagtatatctagttggaggatagtttataaaataataataatatcttaacgatttattatgcattaacatcaactgagataacacccaagactttttttttggtatttcataactcttctatttttagaaagccaatcgatgactattttctgtattcatatttccagttgaaatatactttcttgatctgataatttttacccaataacatttagtgattttgtagcaagtcacaataaagaacaataaacactacttttcaacctgggcaattctgccttgaggtcatatttaaaattatcagtagaaagaaaagttattttgtttggatcaaagactaagacagtgacaaaatctgcatatccttcatcctctcactcttgagaatctttacttttgttgtgtatttgtctacagttgttagctcaacaatgtcacccaaggtcttgagatctggaacagctgcaactacagatcaaaagtcctcagaaagcaaaatttcttggtgatggcaaaagagaagaaaagtacttttccaaaaaaagtatttaagaagcactttggaatatatctaaactgcattgcaaacagtcttgtttagacttgtctttgacagactataccttacttagatcatcattttaattttgacttccatccagaagttgatgcctgaatttttacaggaaaaaatctcatgtttctcaactctaaggaatgaacacatctagtgctacttctctgagacagaaacagggataaggtgggggaaaaaaaagggtaaacccagaatattttggactataaagttagaaaattgtcaaagaaagagggagcatgttaaaaggatataggagccaaccaaatggacaatttaaacttcaaaataaataataatattaataggggataacccatcaactaaaataagaatcatgagtctatgctgttatacataaataaatggaaaatttgaaagcttaatgagaaatgggatatgtatatagtttcaaagtacatcctcataaaatactgattaattacaaggagaaaatgagcaactttgcagtgaagaagcctggcagacaccaccttaatgaagtgatcaaagtcaacagtataaataattaaataaactaaaatactttgccacttgacagaatgcaatgagaaaaacatagcatcccatgcacttaatgaggaacatgagccaactccaagtagaaggccgtaccacaagataaatgtacaggaatctttaaaaacttcaagctcatgaaagctaaggaaaaactgaggaactgcttcagattgaaagaaactaaagaggaatatttaaatgcaatgcatgattctgaactccatcattctgctctaaaggtcactattggtgtgattgatgaaacctgaatgatgtctgaggtttagatggcagtaatgtcccaatgtttatttcttggtattgatggttattgtaattatgtagaagaatatattgtttgtagaaaatacacactaaaatattcaagggttatagaacatcaagtgagcaagcaacatatcctcaaataccatcatggaaaataaggtttgacaatgcacttgcaacttttctgtagatttgagattgtaatatattcataagtatcagaaacaaattattacagtgcataggcattgatccacaggaaaaaaaccttgattattttaatagtatttcttaatttcatttaattaaagaaaaaatcaatgaaaatagaattatatttagtgaaacgtaaaatcccattcacacctttcctacttctcaatccactttccaagtgtaaacactagtattggccttttcctgtgaatttatatgtatgagaatagcaatgtaacgaagggttaatactatactactaggcagctagtctgcctgagttcaaatccctctgagttcagatctagtcttagcagttctgcaaatctgagaaagttacttaacttctcctcacagcaatgccttcattttggcaactgggttggtaatcacatctaatgaataaggtagttataaagattaaatggtataatacatatagaggtcctagaattatgtttgcccataataatcatgctcttatagacaggtgtgtctagttttccactaaaaatgagatcaaaatataaatatagttgtgcaattttacttttctatatgtataatatacatatagttggggaattttacaatcagtattccacattgcttttttgtcttgttttagtaaaaattattattgtaatttttcttaataaaactatatcatgaacatgtcttttcatctatgattatagaggagagctgattagaccatcatgcttagttcaaaaattccacaactctgctggttatccatttttttccgaggacccaaagtgcttttctctatatggtagctccattcagaattacctttgaagcaatcccaacagcaccaggatgtctgactgacaacctgagatcccaagttgccctctaaatgccaggagatggacagcagctgatgtgctcagcattcaggagaacaaggaaagccagcacaggtggaaaggaccagaaagatgagatcagaccagtcccaatgagatgagctgggtacctcagttggaaatgcagaaatcacccaccttctgcattgatctcactgggaactgcagaccggagctgttcctattctgccatcctgccagccagaatgggtgcagcccacagaggataagccaaagcagagtgggttgtcacctcacccaggaagcacaaggggttgaggaactccctcccctagccaagggaaggcatgagggactgtgccctgaagaagggtacactctggcccagattttacgcctttcccactatcttcgcaacttgcagactaggagatttcctcgggtgcctacgccatcagagccctaggtttcaagcacaaaactgggcagccatttggcagacaccaggctagctgcaggagtttgttttcataccctagtggcacctggaatgccagcaagacagaaccattcactctcctggaaagggggctgaagccagggagccaagtggtctagctcagctgatcccatgcccacagagcccagcaagctaagatccactggcttgaaattcttgctgccagcacaacagtctgaagtggacctgggatgctcgagcttggtcaggggaggggcgtccaccattactgaggcttgggtaggtggtttcccatcacagtgtaaacaaagccacctggaagtttgaactgggtggagaccaccgcagctttgccaagccactgtagccagactgcttctctggattcctcctctctgggcagggaatctctgaaaaaaaggcagcagacccagtaaggggcttatagataaaactcccatctccttgggacagagcacttagaggaaggggcagctgtgggcacagcttcagcagacttaaatattcttgcctgctggctctgaagagagcagcggatctcccagcacagcactggagctctgctaagggacagactgcctcctcaaatgggtttctgacccctatgcctcctgactggacgatacgtcctaataggggtcaacaggcacctcatataggagagctctggctggcatcaggtggatgcccctctgggatgaagctttcagaggaaggaacaggcagtaatttttgctgttctgcagcttctgctggtgatacccaggaaaagacggtctggagtggacctccaagcaaactccagcagacctgcagcagaggggcttaactgttagaagaaaaactaacaaacagaaaggaatagcatcaacatcaacaaaaaggatgtccatgcaaaaaccccatccaaacgtccctaacatcaaagaccaaaggtagataaatccacaaagatgaggaaaaaacagtgcaaatgctggaaaattccaaaaaccagaatgcctcttctcttccaaaggatcacaactccctgccagcaagggaacaaaactaaatgcagaatgagtttgacgaattgacagaagtatgcttcaaaaggtgggtaataacaaactcctctaagctaaaggagcatgttctaacccaatgcaatgaagctaagaaccttgaaaaaacgttagaggaattgctaactagaataaccagtttatagaagaacataaatgacctcatggagctgaaaaacacagcatgagaactttgtgaagcatatacaagtatcaatagccaaatcaatcaagcgaaagaaaggataccagagattgaagatcaacttaatgaaataaagcatgaagacaagattagagaaaaaagaatgaaaaggaatgaacaaagcctccaagaaatatgggactatgtgaaaaggccaaacctacatttgattggtgtacctgaaagtgacagggagaatggaaccaagttggaaaacattcttcagaatattatccaggagaatttccccaacctagcaagacaggccaacattcaaattcaagaaatacagagaataccacaaagatattcctcaagtagagcaaccccaagacacatatataatcatcagattcaccaagattgaaatggaggaaaaaatgttaagggcagccaaagagaaaggttgggttacccacaaaggggagcccatcagtgtaacagcggatctctctgcagaaatcctacaagccagaagacagtggggaccaatattcaacattcgtaaagaaataattttcaacccagaatttcatatccagccaaactaagctcataagcgaaggagaaataaaatcctttacagacaagcaaatgctaagagattttgttaccactaggcctgcctttcaagagctcctgaaggaagcactaaatatggaaaggaaaaaccagtaccagccactgcaaaaacataccaaattgtaaagaccatcaacattatgaagaaactgcatcaactaaagggcaaaataaccagctagcatcataataaaaggatcaaatttacacataacaatattaaccttaagtgtaaatgggctaaatgccacaattaaaagacaaagattggcaaattggataaagtcaagactcactggtgtgctgtattcaggagactcatctcacatgcaaagacacacatggtttaaaacaaagggatggaagaagatttaccaagcaaatggaaagcaaaaaaagcaggggttgcaatcttagtctcagataaaacagactttaaaccagcaaagatcgagaaagaccaagaagggcattacataatgataaagggatcaatgcaacaagaagagctaactatcctaaatatatatgcacccaaaacaggagcacccagattcataaagaaagttcttagagacctacaaagagacttagactcccacacaataatagtcagagactttaacaccccactgtcaataatagagggatcaacaagacagaaaattaacaaggacattcaggacttcaactcagctctagtccaagcagacctaatagacatctacagaactccccaccccaaatcaacagaatatacattcttctcagcaccacatagcacttattctaaaattgaccacatatttggaagtaaaacatttctcagcaaatgcaaaagaacagaaatcataacagtctctcagactacagagccatcaaattagaactcaggattaagaaaatcactcaaaactgcacaactacatggaaactgaacaacctgctcctgaatgactactgggtaaataacgaaattaaggcagaaataaataagttctttgaaaccaatgggaacaaagacacaatgtaccagaatctctgggacacagctaaaacagtatttagagggaaatgtatagtactaaatgcccacaggagaaagtgggcaagatctaaaattgactccctaacatcacaattaaaagaactagagaagcaaaagcaaacaaattcaaaagctagcagaagacaagaaataactaagatcagagcagaactaaaggagatagagacacgacaaacccttcaaaaaaatcaatgaatcaaggagctgctttttgaagattaaaaaaatagactgctagccagactaataaagaagaaaagagagaagaatcaaatagacagcataaaaaatataaaaggggatatcatcagtgatcctacagaagtgcaaactaccatcacagaatactataaacacctctatgcaaataaactagaaaatctagaagaaatggataaattcctggacacatacaccctcctaagactaaagtcgaatccctgaatagaccaataacaagttctgaaattgaggtagtaattaatagcctaccatccaaaagaagcccaagcccagatggattcacagacgaattctaatcctctgtacaaagagaaactggtacctttccttctgaaaccattccaaataatagaaacagagggactcctccctaactcattttatgaggctagcatcattctgataccaaaacctggccagagacacaacacaaaaagaaaattcaggccaatatccctgatgcaatttaatgtgaaaatcctgaagaaaatactggcaaactgaatccagcagcacatcaaaaagcttatccaatcaagtcggcttcatctctgggatgcaaggcgggttcaacatatgcaaataaatcaacataatctatcacataaatagaaacaatgacaaaaaaaatgattatctcaatagatgcagaaaaggccttctataaaattcaacactccttcatgctaaaaattttcaatacactaggcattgatggaacatatcgcaaaatataagaggtatttatgacaaatccacagccaatatcatactgaatgagcaaacactagaagcattccctttgaaaaccagcacaagacaaggatgccctctctcaccactctattcaacatagtattggaagttctggccagggatatcaggaaagaggaagaaataaagggtattcaaataggaagagaggaagtcaaattgtgtctgtttgcagatgacatgattgtatgtttagaaaaccccatcgtctcagcccaaaatctctttaagctgataaacaacttcagcaaagtctcaggatacaaaatcaatgggcaaaaatcacaagcattcctatacaccattaatagaaagccaaatcatgagtgaacttccattcacaattgctacaaaaagaataaaatacctaggaatccaacttacaagggatgtgaagggcctcttccaggagaactacaaaccactgctcaaggaaataagagagaacataaacaaatggaaaaaatattccatgctcatggattgaacgaatcaatatagtgaaaatggccatagtgaccaaagtaatttatagattcaatgctatccccatcaagctaccattgactttattcacagaattaggaaaaactacttcaaatttcatatggaaccaaaaaaagcccatatagccaagacaatcctaagcaaaaagaacagagctggaggcatcaagctacctgatttccaactatactacgaggctacagtaatcaaaacagcatggtactggtaccaaaccagatacatagaccaatggaacagaacaaaggcctcagaaataacatcacacatctacaaccatctgatctttgacaacccttacaaaaacaagcaatggggaaaggacttcctatttaataaatgctgttgggaaaactggctagccatgtgcagaaaactgaaactggaccccttctttacaccttacacaaaaattaactcaagatggaataaagacttaaagctaagacctaaaaccataaaaaccatagaagaaaacctatgcaataccattcaggacataggcatgggcaaggacttcatgactaaaacaccaaaagcaatggcaacaaaagccaaaattgacaaatgggttctaattaaactgaagatcttctgcacagcaaaagaaactattgcgggatctggccagcagcctgcaatgcactggggctctctctttgttcccaggtggatcggcaggtcgagaaataatagacacacacaagatagtgaaagctgggtccaggggggtaaccgccttctggtcacatggtgccgccaatgcactggatataccagcatttattactaagtttagtgagggcgggggcaggttggtaagggatttagggtcatttgattatgaggtgagatggtcacatggggatgaagtaattctttaacataacatctgtatgcagaagtacagtatacagagataagaatttacaatatagtgtgtgtatcagtaatttctaacagagccttaaaacagaaacacagtctttcctttacctatgattagcaagattttaatcagcagtaacagttgcagcaaaagctggttacaaacaatccatagaaacaggacttgaagctagacaaccggttagaccagcaattctcagaagggagtatgccttaaccctaaagaggcctagaagagccgtggcaagatgagggcgtttatagccttatctcatccatatggacaggtgctccccatgcattcgtttataggctttccacaagggtcacattccattcccagagctatgaacatctgcttttctgggataggaatcttggtgatgtgaaacctccctgactgcacgtccattcacaggctctctacagggggaagcacatcacgcactgttggctcattctggcagtccaacctggcattgtctttacacaatcctgcatgcaattttgtatttacaataatcaggagcatttcatcttttattccatagcaatagtttcagggggtctccctacagaaactaacatcagagtgaacaggcaacctacagaatggaagaaaatttttgcaatctatccatctgacaaagggctaatatccagaaactacaaagaacttaaacaaatttacaaaaaacaaacaaacaaccccatcgaaaagtgggcaaaggatataaacagactcttctcaaaagaagacatttatgtggccaacaaacatatgaaaaaaagctcatcagcactggtcattagagaaatgcaaatcaaaaccccaatgagataccatctcacgccagttagaatggcgatcattaaaaactcaggaaacagcagatgctggagaggatatggagaaataggaacgcttttacactgttggtgggagtgtaaattagttcaaccattgtggaagacagtgtggtgattcctcatagatctagaatcagaattaccatttgacccagcaatcccattactgggtatatacccaaaggattataaatcattctactataaagacacatacacatgtatgtttattgcagcactatttacaatagcaaagacttggaaccaatccaaatgtctatcactgatagactggataaagaaaatgttgcaaatatacaccatggaatactatgcagtcataaagaaggaaaggttcacgtccttttcagggacatggatgaagctggaaaccatcattctcagcaaactaacacaggaacagaaaaccaaacaccacatgttctcactcataagtgggagttgaacaatgagaacacatggacacagggaggggaatatcacacaccagggcctgtcggggcttgggggactaggggagagatagcattagagaaatacctaatgtagatgacgggttattgggtgcagcaaaccaccatggcgcatgtatacctatgtaacaaacctgcatgttttgcaccacatgtatcccagaacttaaagtatatagaaaaaaaaaaaaaaagatgaggtaagactgtccttacttctggaggttgatggtagcagttgagttgagaatcaagtacccaaggtgaatcagaattgaagtttaagagtgcgtgcttaagacaccagaagtcactgctgcccatggtagcttggcagagcttgtaggaacatgtgaatctcaaaggtctaggaagaaagccagcagaaatcaggacccagcaatgaaaggagcagaaatagactgagagagtgggccacagaaacaagtaaacatgaacaacaggaaagtttaccctgctggcactgttccaaatctatgcttcattttaggacattttctatgaaggcaagaatcaatttccagcttgtctgacttgagtgtggtaaaagggccatgtttggttgaacctgagataagaggcgcaagcaggtcctgataatggcaagcctagtgtgtatcatcaaagatggcacacaagctgattttaggggccacaagccacctataactgttatgaaacccagtgatttccaaatattcttgaatgcctataatatgcagcacgaaagacagaaagaaactttgttgaaatgggattctgtcaggaatttatttttaactttgttttaactactatggcatcaaaatcttttgcgtagtaaaaaattgttctttctattcaagaagcaattgattatattatagggaatctttaatgtaatgtttagtaaaaatgtaaaaattgtggatatttttattaagcacactgagaaaagaattttgcactttaagatgtatctatttgaatgaagaataatattctaataccagttacaaattgtactgaaaaatgaaagagaggaaacatttagcctgggtgacaaaggaaccagtcactttctactctgggttctgaggctttgggttttgttggagaaagggaattagtagcttagtagctgtcaccttgcacacctccagaatgcaccatttgcatagtggtgcatgtagtgatgtctcctggtgttgtgcagcaagcacagcctgcattgttaaaagtagcagccttgctacaggtctttctctttaaagcttgttctacaatgatctgcattggatttggctctttctgtaatcacattcatattcttggtcttcacttttgcagttgtttaaagctgactttaagaacagcattttcaatttatttccatagcagctttgatagcctcagcatgctcttcagaatgcttcctgcacactaggccttaagagctaactgtcttatacatgatctctgtcatgccagaattaaatttcttcagcctagtattgcttctttgctacaaagagagaatgttatcttatttccttaagcaggaaaaaccacttttcaattagagtcatagctaaaattatatcctgatgtgcaactccttgacactactaaatgaatgttggcattactctttattaatattacacacaatatttataggctatatgccattttgcaacacataggacatgctacacttatgtagtaatatcaacatgaataagacctagtctctctcctcaggttacttttagtctaataaaggagtgataaggagcacagaaaattaaaattcagggtgttccttgagggaagtgtatgtaatttcactggcttctggaaggcaagtattcctatttgtgtcctcaaccacaagcacatactttaataattatttggcaattaaacaagtgctattctagcatatgaacaaaaggttctattagcctggaatgtgacaaaagatcttactgattctttgaaatggaaatggtccaaagaggaaagaatattcaatcttgactttcgaagataaataagatactggtaggcagagaaaatagacaaaccctcctggcatagacaatagtgtgagcaaaagtatccatacaagttcattctctctccctggagctctctttcccagatgtcagtgcctctcacccctcacttcactcgggcctctcctcagatgtcatcccaccagagactcctgcctcatgacctttgttaaagtaacactttatccatcactctctttccctttgcctgttattaaatgttacttcttattactaacttaaatatgtacctaatttttctcctaatttttagtatctgtctccctgacttaaatataagctccataagacaaagaaaatactattttgtccactgtcgaagcctcagatccaagaacaatatttcacgcagagaagatatttactaggaataattttttttaatttgtaggcaatgaagtaagtagaaacagggaagtataattaattgggagccttgattattaaggatagctttaactaaggagcattcccttctctggttcagctcaatgaaaaagtgaatacttgatcaccatacactccacttgggagaaacccagggttactaccatcactccaccatagaagctctctctgccctaaccaaaaagaggcacttcgcttcttgtaagttgccaatctcttcacattggcaaattcatttatctccaagcatacttttttacttgcaaatggataggccttatgttacccgaagaaggtaccttggtatctcaggcaatgaacagggccagggagccgccaaaagtccctgtcctttgtgttaagctaccagggcaggtggaagagcaaagccaggtgggggcttaggcaaatctgcactcttgctccttacatgcaggcacaagcatcagacccaatggagactggagagcagttctctgggcactagggagactttccagaaaggagcacagctgcctttgctgcacagaagaatccacatgggaagtggtgggtagcaggtggtagtaagccctacccagctcccgtgcatttgtcaaggtaggtctcacatttgtagagttccactagcagcagcttgctgggttttaagcagcctgcactgagaactcaaaactgccccaggccacaagccttccctgctgagattgaaaccatagatttgaaagcacacccctcccctttgcccatgatgcaggagcatccagctcctgcacccatggctacagcacacttcccactcacctctcagttctggccaagggagtttgtctccactcaatattatatcacatatcctaattggaagcttccctcactctgtgaccatcacccgagttaactggtggacttctgcaaggtcctctgtgagataggaccagtaatggctttcctccatccccactggagtctgggagtgtacacaaagcacatccccatgccactccttctcatctgctccccaccactcactaaatcagctcgagtgatggcaaggattaagacattcccctgtggtctggattaccaggtctcccagagggagcgtgtgtcacagaggcagtctctctcccctcacactctggagactcacagttttctgcctggctcatagtgtaggctacagcccacctcttctttcaaagggtctgtggtttatttcagtgtgttcctgttaagttcctatgttgcctcttggaaaatagttcgcagcatgaatttctacacactattttgtcttttcaggtgggtgaggcatgctagccgatgcctccaatccagcattgaaatcatcattcctgatgcaagtcagtgtctagctgtttcaaaatgctgagaagttggctggaattctaccaaaactatatgtcaatgaggttaaaatttttatatataatatataacatatatatttataattatatttaattccttctttctaagaatgtggcaaaccgctctattttagctgttttaaaatatttttcaatatgttttttgaattaaaaaacaataccaacaatcagatattgtctaaaaatatggcaagatttaggagctgataagcagaaatttagggatcaaagctcttcatagaattcttgtgatgaatcaagtacttttgcctatatatctgattggactgcaatggaaacaaggccttgtctcactcttaaacgctcaatggacatgagccatacataggctcataagttttcagactatactaactgaagacagcactgataggttaaaagatttgtctaagtttagacatctaattagacataatgttagaaaccagaactcttgtggcttcagtaaagcaattccagcactcaagtcactcatatctaataaatatgtatgtatgtgtcagtgagtgaatggattaatgagtctaaatttttccaacaagtcagttaattcttaacatgggtttttgcagatttctcacccatacatatgcaaaaacttctttggacacaagaaatttaatctcaaaaatatgacatagatttagtggcttataaataagcctagaccatactagtaacattttgacatattgttgcttgggtacaaggcccttaagtccgtcaactagtcccagtttcttggtcaataaataaaaagaaagctttttttatctgattatttacaggaaagcccactttaatcattttaaccaaatataacccattattgcttattatccaagtagaattctcccaactattctttaaaactctaagcaggaaatagagtaaggattaggactgccagaaaacagtacttcacctttgaatacacttttacacttcttttaagatgtaagaaaatataaagaatataaacttgactaaccagcattgtaaagagaagcatcatagcatcatatatatgtatatatatatgtgtgtgtgtatatacatatatatcatatatatgtgtgtatatacacacacacacacacacatatacacatatatgtatatgtagctgggcagccgcacgtgtagtcccagctactctagaagctgaggtgggaggttgaagccagaagttccatgctgcagtgcgctatgaccatgcctgtgaatagcctctgcactccagcctaggcaacatactgagatcctatctcttacaaagggagagagagagagagagagagagagagagagagagagagagagaaaattacattcctgtccttagcctttattcacatcagtaagagcactttgcttcaactttcggacccagtgatgcttgagcacatcatttttgattatatgacttaaaatgatgattaggagaagtcaggagttaataggagataggaatcaaggaaactagatactatacatatagcaagagtcatgaaaatgacacagaatacgtttggttcccatcacctctcttttacttatttgctgaaacatcatggatcagttacttaaatttctctgacatgaagtttatccaatgtaataaagacacattcctgagaggactaaattggcaatttttgtatatttcaagaatactgtgagttttaatacagttgcatcagccatatgtgagtactgagtacttgaaaagtgaccagtctgaattaagatatgctatatttgtcagatgaatcctggatatttgaagacttagtaactaagcagcaaaatacatcatttataattttacattgactgcatgttgaaatgatattttagatatatatatatagttaaatcaaatatattaaaattcattttactttttttacttaacatcgctaccagaatatttgaaaatacaaatatttatattgcacagcattatatgaatattttgccatttcccctcctagaccaaaatcaccttgacagtaagggttctctgtcttatttatcttgtggtcccaggatctagtaaaaatcctgacacaaagaagacctccaataaatatgtgtaaaatttacaatgagtaaaaatagtaattttaatcaggagttcttaatgcagtttcctaaagaaggattaccgcccttataaatatacaaactcagaccacatttccttggtttcctatcccattactcagattttcaaataatacttgttctggtctcactgtttcccataacttatgagtcaaaggagaaattacaagtaaaattagaaaacatattgaactaaatgaaaattaaaatgcaacatattcaattttaagcagtgtctagaagaatatttatggctttacaaggggaagaaatcctaaaattaattatttaaacttccatcttaaaatacggtttgaaaaaattagagcaaattaagctaaaaataagcagaaggaatggaataataattttagaaagaacagattctactgaaataaaaataggaaaatgaatgtgccccaaagcttattttgaaagagcagaaaaattgataaactcctagacagacagttcagaaaaaaaagattctacaatgaatattaacaccaaaacaagagcccattacaaacaatttactgtgaataaattcaacataaatacaatgaacaaatccaaaactaatacaacacattagaatagaagatatcttaaataattcatgttatttaagttaactgagtctgtagtttaatactttccacaaagaaaagtctagaccaatgtggctctaatggttaattgtataaaaaaaaaagaaaatgaaataatataaattccatgcatattgttgcaacaactagaaggggagggagtattttccaatgaattttatgaagctagcattactatgataaaacattgagacaaagacattaaaattaaagtacagatcaatatctctcatgaatatagaaacaaaaatccttacgaaaattttaacaaatggaatccaaagacaaaaaaaaattaataccacctgaccaagtgtacagttcaaagatatttgacaaatgaacaattctagtagtgcaagtgtagtttaacattaaaaacaattagtgtaattcacagtactaatagatgaaaaaaacaaaaccgtacagttatttcaacagatgcagaatatgctttgtcaaaatgtaacacttactgatgataaacaacaagcacaaaacagtaactcatggaaaacaacttaacattaaacttaatgatgacaaactaaatgctttcacccaggatcaaaggaaaactaaatatatgcattttcaacacacctattcaacattttcaacatgcctactcaacatatagaaggacctagtcagtggaataatactagagaatcaatatatagcctgtggatagaaaatgaagcaaaaaaaaactatttttacttatagatgaaatgattcttacaaatccattaaaagaaactaaaatttaaaatgggaaaacaaatgaccctgaaaaaaatgcacaaatgattcgtacagacacaatacataaattgttttaaaaaaatcctgaaatacggctcagcactattagtcatcaggaaaatacgtataaaatccacaatgatatgccattatgcatccattacaacagttaaatcagaaagacgtacaatatcatgtgctggcgaatatgtgtagcagtcttataaatttctggtgggattttaagtggtacaacctcttggggaaacagcttatttcagtttctcaaaaaactaaacatatacttatcatatgactcatcaatcctatatctatgcatttactaaagagaaataaaaggcacatattcacacagcttcaacatgcatgttcatagaagctgtattcatataatcaaaaactggaaacaaatatctagcaatatgtgggcagataaatacatttttggtaatatctagataatggtttattatttaccaataaatatgaatgaagtactgataaatgcagctacatgataaatctcaaaaaaccattatactgaggaacagaaaccacatatagaagaataatttttttttttttggctcaaacaatggaagtttatttgctcgtggatctgtttatgtggaattctagaaagggcaaaactaatctataatgtcagaaagcagattggtttttgccttgtgttcagggtgtttgtaaatgtgcaggggaatgaaggcagatttcactgtaaggatcatgaataaatttttgtgtatatattttatatttcaaatataatgataatttgtcaaaactcattgaaactttcacttgagtatattttctaatttataaatcatgcctcaataaactcatctgaaaaaaataggaattggttgctagggagagggaatagatatgaaaaagttacactcatgagaaaaggcacctagggaggaacgcataggacatctgtgggagtagtggcaagttccattcaattggaacagaagacaaatgaacagaaattgttgcaacacaaattagaacactaaatagagttagaacagtgaaggtcataaacatcagaataaacatctcaaacattatttgtaaactgataagaatgcatcaatttttatttgcctttctctgtttttcctcacctttcctctcttctctctcctcctttcttatctttttttttcttttttaacatttggagtaacatcctcagacaagtagatagacaagcctccagcaaacaatgggaggaagaatgccatgattcctccttaaattgtagaagctctctggcctctgctgtgcataatctgcctacccatcaaatcacaaaatttgtttgtttatataatatcatcctttctcacagcttttatcagcagagttcttaagttctcaagggaactgtctatttgaggaactataaggattggtcaaatatgctggaatactgcaaaggctaaaaaaatgagattctttataagactatgaatccagtgaactaaatattaggcaagacaacattgttttatccagatggctaatttgcatgactccgtttaacacttgatttttttccacacacatctccttattataaagactgttataagaaacacattacctcgtttggagagaaaaataccttgcagaaatctggcagccagatttgagtcttgctattcatgtttctaaaatgaaggcgaaaagaggtttaaaggatttgggactttgaaaaggcagtagctactttggtagcctcctgtgaatggtcttttcttagattaacaagctagtgaagttttaaatacgagctttttaaaataaagtcttgcttgaaaagttcaagatcaaaattcagatagtgtctcagtatcactattatttcaaagttcaattactgtgtgtaattaagcatgtttcaaaggttttatagaaaataaaacatttaggtgatatgaaattataaaaatgtgttaatatatgatataaaaatatgatatcaatatagcaatataactgttgttacttttaatttcccatcaagcagggatccccaatgtttgccttcagtctaaacactaccaaaattgttttctatttgtacatggcactcctgataattattatctctacttaataactgttttagcacattcttgtaatatcattgtatcgcacttgtaagtgtagaataagatgtctaaaaagtagcacagtagcattatctgaagtagaggtgaagcagcatcaacatttggtcatatctcacaccctctctgaaatactcacttctgtgaacttgagcattgcatgcccatcatggttgctctctcctagacaactaaagaaaaaagaaagttagtaaggaacagaatagaaaatttaatatttgggaattatagagatccacaaaccaaaggaatttgttatttatattctgtcaatattcaggctgaagccaaagaaattgagacagatttgaattctacttcactgagtgttgcttaggaaagtcacaaactctcttaacctcagtagtatcacctatgtaaatgatgtgtcagataaatctatgagagaactttgtagtattaaaccatattacacacagctacatggtaacatcaacattaacgaaaggcatgaatatgtggagacttgaatttgagtcctgacagcagaatgtgttaattttatgaatttggttggttttctaaatttctctaagtctcagttttctaatcactaaattaatgataataatatttacttcatagaatggttgtgaagattaagtgatgatcaatttaaagtagcatgcaaagtagctgttttttcctctgaagcaattctaagtgttggacaccagcacaaataaagtgactccctcttctatagattcaaaacaaatgtagactctacaaatataaggcagaacaaaacaaaacaaaacaaaatttaaaatatatagttgcaggtagtttagcttctctagtaaccctaataactctaataattacttcttccacatgtttttgttgttgttgttttaggtcagaatgaatactctctcactaatcaacctgatgtttttcttcaaaatattccaaaataaatgctacccgagtatgcaaagggaccagtatgcaaattcaattctgtattctccgcaactactgtttttttttaagaaatagttttcagaaatttatctatgtccccgagttaatcatttctttacccatttccttctgtttcatatgctcaggaacctaatgcttttttcaatagtttaaaaataattattttctacacaaaataaacaacaattacatgaccaccaaaagaagcttttaaaaattctcttttaattaacaaattgagatctgaaaagtttataaatgattgaaaagtaaaaataagatattatcttgcttaaaaaaatgaagcagcaggctgggcacagtggctcacacctgtaatcccagaactttgggaggctgaggcaggtggatcatctgaggtcaggtgttcaagaccagcctggaaaagatggtgaaaccccatctctactaaaaatacaaaaattagccgggcatggtggcgggcacctggaatcccagctactcaagaagctgatgcaggagcatcactggaacctgggaggcggaggttgcagtaagccaagatcataccactgcactccaacctgggtgaaggagcgagactctgtctcaaaaaaaaaaaaaaaagaaaagaaaagaaaagaaaagaaacaaagaaacaaaaacaaacaaacaaaaaatgaagcagcctagaagaaaaaatgacttaataaaagaaataaatgaaatagagaaatatgagccaaataggtattataaccctaatattttcaattctatttatataatccaaatatcaacaatatgctcttgtgataaatcagattgaattatcagtgacaagtggaagctttctctgctgctaagtcacgacagaactgaagcaatttgttaactacacattttgatgaatttctaaaaactgttctattaatgtattaaccatttataaaagagattttaaggaaatatagaatttgggtaaagtgatcataaacttttgaaaaagaaactcttttattatattaatatgcttaagaatgcaataaaataactgggtcgtaggagatcatcctgggaatattattattattatttgacacagattctcaccctgttgcccaggctggggtgcaatagcacgatctcagctcactgcaacctctcccttccgggttgaagagattctcctgcctcagcctcctgcgtagctgagattaaaggcatgccaccatgcccagctaattttttgtgtctttagtagagatggggtttcaccatgttggccaagctggtctcgaactcctgacctcgtgatccacccgccttggcctcccaaagtgctgggattacaggcatgagccccgcgcctggccaggaatattattttacccaagagaagttttaatctgtcctaatatccacagatcaacagaatatgggtatcaattacttaaatgaagagcttgataagaatttccaaaaggcatgatagaaagataattgtaaagggggaaacaaagaaagattgggcttaagaatgattagtggagatccaagaggagagcactttgtttggggaatgttattcacgtctacagtaaaaattagggaatttcatttgtaaacaggatggaatctaccagtgttaatggtagttgtcatggatacagttaagcttttcaaatcatctgaaaataatcagcctatacctgtcaatggaacattaagtatagaggaccagagaagtgaagacaaaaaataaaccattggatatttagacactattcattcctagatcatcaatgaaaggttatcttaattgcatgataattcaaaattcttagtcttttaatgtaaatgtttttcagcatttgtcaaaaaaagtaagcaaaacataaattaatatatctcttttatcatatatctattgaccctattctaaaatagcaaaatatacccaagttatggttcttctttcaaaaaccatgtttttgttgttttaactgaattttatattaaaagattctacactatttttaaatcggttagttatccagttggggaaatgaggcacatcaactttttactgctccctactttctgctctttaccacacagagcatggctaagctgccataatgaaaaagacataaaagaacaaaaaaagagaagtatgtgaaaaaagaaagagaaggaaggaaggaaggaaggaaagaaggaaggaaggaaggacaggggaaggaggggacaggaggcaaggggagggaagggagaggaggggaggggtggggaggggaaggggaggggagggaaagggaggggaagattagacagaggaaataaatttatttctcccttgaaagtgacatataatccagagtaggtaggcggctctgcttagtgagatcattcaggaactcaaattccttctgtcttcaggtttcattgctccccaaagttcttttgtgcacttttaacaaactcccagatgacatcgatgctgttggttggtgcatggatacactttctgtacaggaatgtgactctggactaatagagtcgcaactagctaattaaaatctaaaattaaaatatctttaatgtcgctggccacaattcaaatactcaattctcacagatgactggtggctatcattacagaccttggagaccaagaacattttcatcagcacagaaagtgatagtaagaaggctgatcttgagtatagtgtacttgtataatttattatctttagtgaccaattattactatattttacactactgatactttctagatttggctagagttatatttcttatgtcttgctaacagaaacaaacaatgttattctcataactactttctaactctcaactatcattatatcaaaagatcttcctgaattttatgtggacagatagtcttaactctttgtttgtattcctgagaccaagatttcccttgaattgtttttctactctaatgatttcttattttgtttcagttatttatttaacaaacattttaaatgcttaccataatcatagttaatatctacaaagactttaatatacgccaagtattataagcctttcactttatttctgtcttaaaattcttacatcaaaattaaatatattattttcctcatttgacagataagaaatctaagagatctaaagagggtagatacgatttgccccccaccccaccaaaaaataaaaaacagttaatgtttgaaatgtgattcaatgacaaaacttcataatccacctatttaactactgtgatatttcctttatgccagctatcttggtacctttaccctgactatgagaagaagggaagaggaagagaaaacaaagcatctgcaagctcaataagacatgatacattatcaggggataacaaacaagctcatcaatgctacagaaataggagtgaaaactagtaaatatctctacatgtatagaaactcagaaaacatagtttaatgatgcacaaactaaagcacttgggtcactgacccagaggaatcaagggactaattatcaacttgcacatgggacagtgattgctgcaaacagaaaccatattgtcctgtagtaactaatgccaaaaaggaatcagacacaccaatatcctctcaactggagaagaggcaggcaagtaatataaaagagaaagccggggaaacagatctatttgtagaattagccctttagaaaagtagattagaagagataatcaagccatgcaaagttcacaaagtcttctctgatttggtcaagtcagaatttgagatctgaactaaaatctggtccaaaaccacggagtgtaggaagccaatgacagataaaattgggcttaaggtaacaaacttaccaccgtaaaatcctgaccagtattgagaaagtatagaaaaggattcagcacccaagtgacagagcttcagacattgttagagtatcacatctgcaaaaaataaagccaaagttctaggtaaggcttcaactacgacgacgagcaactgtagtgccaggcagagctgctgaggcagagcctcagtcctctgctccaaggtgtggggcagagggccatgcaagtttgggactctcaaggccaagcgaatgttcaagggtcacatcatagatactggacaactcagatatttggcaataaaatgtatcctatacctagctggtaaggttggaactccttatatatactccttgagtaagacagggactaattagtctgactctgtgtagagcccaagacggtctggggaaaagcaacagttggcattctacattacacaaaagttgtcctgacctctaattctgtcatctacaaaattcctctgacttacgtattacttgtcagtcactgataaactgccttaactgtctttcttgcataagctctttaaaggaaaactagtattcatccgtatattttctagtagttttttttctccttcatacccatagaaaatatattccttatatatagatcactcataccctgaagtatatctacacagatttttaaaatacttattgtgtcttcttagtaaaagtctttgtgacttaggtcatatgactttgtttcaaaatataaacaatctccatttacaacagttaatgctattccaaagatttacttaggtagttacatttagtgtatattaaattttgttttctgattcctggatttgttatatttctttacaggatattctcttaatttttgaaagctatttccaagctcttcttctctaaaaattaagaattcacacacaatggttttatttctatgggctttttttttaaaaaaaaaataaatgttgttgtgtatatgcgacacttataacatgatattatgggattcatataggtaataaaagggttgctataataaagtagattagcatatctatcagctcacatagttactttatttgtgacaagaacagctacaatctacttatttaaccacaatccctaataaatataattttattaacattagtcattttgttgtacattatacctctaaattcattcactctacatattattttgtatccattaacctgtatctccccatttccttacctccttaccccaagcccatagtaacaactgtttcattctctatatctgtatgtttgaactctcttatacacactcacacacacttcacatataatgatcacgcaatatttttcattctgtgttgtttttgtcttcatatcaaacatttataaacaggtctcaggactactaaaattcagtcccactaatatgtaatttgtatacacccactggagaaacagaaaaggtaagagactgtaactactataaagaatctcagtttaacctggatgaagggaaaaagacacatgcacaaacaactgcaatgcaagtacacaatgataaatgctgtaggaaaactataaacatttcttgtggcagcaaaaaggaaaaagtgattgattaattaggattatggtattaagaaagagaagctttgcaaaggatatgacatttgagttatgccttaaaggatagttacttcaaaaaggcagagagggaaaatgagggaagggtgagggagagaaggatatttttggcagagggaggaaagaatccaagacctaaaattgcatgttttattcaaggggcaggaaatagcattctgtgtctgaagtctggtggggtaaagagaagagcaaagctgttggaagatagtagattcatacaaaaaaaggcattgaacacccaattgaaattcccttttaatccctaggaaatggggagccatacaaacctgactcataatggggaatcagtcaagagtatgttaatatcatatttgtagattttgatctctcctttctaagattgcaaagagtgttttcaataaagcagtactgtatggcagtaaaatgagttatttgactttcaaaatagattatgtaagagataggtatgatctagtccaaagcagtggtttaaaacaaaaacaataaaaacaataaaaagcaaaacaagccagttagtggggagagggaacatttgcagattgcagagagagtactaacaaagagctaagtcatcttccttagactccatttgcatatggaagactacattttatagttttagagaatgaatcaaggaggacataataaaagaaactgggactacaggtaaaggaagaggtgtcagaaaacacaatttgtttgaacatatggtagaggctttgatttcggccacacagctagcctacaattcccaacctcctttgtagttaattgggacatgtgactgagttctatctaagcatatatagcctgagtgatgtgtgccatttccaggcctggcaaaaaaatcctcccatgcatattccttgttctttctccttctgccacagaatgcaagtgacaatgcagccctatagggaataggagatgccttagttcaaggataagatgcatgagaatgagatgtactttccttgtaatgttccttgagtgatcaataaacctctattatttttgagaaattgtattgtttttgagacaatgaggtctatttgtttctgcagtttagccaaacagatgaattgaatttaaaattcctgtaatacagagattacaatataatgtgccaaggtgataaataaataggatcataaagttcacagatgagaaaaactcaattcagaatgagaaggctgagagagcttctcagcgattgatcttaaattgaggttggaagtttaatgaaataggaaataacgggataggcattcctgagaataggaaaaagccacccagctataaataaaagatagaaggccaggatttttgtgggttttatatattaccagttggattcttagaaatagagacaacttagtaagttttactgagatacaagagtttaaattcaattactaattattttgttcaaaggtagaactatgagaggttcttttgtccataggatcaggtaggtctttgcttaaagaatagacactaaaatcataggtaatcctcacagaagcttcaatgcagctacccaccctccctagacaaaatggtgaagcaagtaaagagtctccagaaaaaaaagtagtttctcatcacacaaatcaggatggggactgtcagcagacaaacaaaagtaaacgtgttttgacaaactgtgggtgccaatggaaattggatctttcctcattttgtcagaggagtaagacaacagaccaaattcttcttctgttttctgaattactctcctttgcaaatcatataaattttaaaaccaacctattaaacttccacaaaggaagacaggtggaaattttattgagattacattaaagttataaataatttgtggagaactggcaactttatagtgttaaacctttcaaccaatatatatcataaatctctatgtttatttagtcctattttaattgttcttgttgatgtgttacatcattttttatagagtggtgtttctcacctagggacagttttgtactgatgttattgaaaaatcctgttgtagaggtggggcaaatattttattagttttatttcctaatattttgcttagttttaggcaattgtaaatagtaacattctctctataacctttcagtttatcacattaaaaaatatcgttttctaggtgttagtgaatcatagacatacaattgatttctatgtactgatcttgtatccagtgaccttccaaacttcacatagcagttataacttcttaatattttctgtattcacagttgtggcagatttgtatccttctctccaagtattaaatattttcttttttcatgtcttataatactgattaagaactccaatgtgcatgtaatctaggaaagtcaatctcataggaacagagtagcgaggtggttgccagaggctgaaggggaaagaaagggataaagaaaagggaaatgctaattaataggtacaaacttttagttagacttgaggaaaaagctttagtgatctagatctattgcactgatatttaatcaagctaataacatatccaacacctcaccaactttttttttgtggtgagaatgttgaaaatacatacttttagcaattttgaaatacacaatacattattaactgtggtcaaattcaaaaaactcagataaaccctgggagatactatgggagatgaccatccccaagacacatagtcatcagattctccaaggtcaattcaaaagaaaaaatcttaaaggcagctagaggagcaggtccctaactaagggaaccccatcaggctaacagcagatctttcagaaagaaatcttatgagctggaagagattgggggactattttcaatatcctttaaaaaagccaatttcaaccaaaagttgcatatcccatcaaactaaatttcataagtgaaggagaaatgaaatcctcttcagacaagcaaatgctaagggaattcattaccgttagacctgccttacaagagttcctcaaggcagtgctaaacttggaaatgaaagaacaataactgcatcagaaaacacacttaagcacataccccattgacaccatagagcaactatacaattgagtctacataacaaccagctaacagcatgatgacaggatcacatcctcacatatcaatattgaccctgaatgtgaggaggctaaataccccacttaaaaggcatgaagtggcaagttgaataaaaaagaaagaatcaactgtctactgtcttcaaaagacctatctcacagttaatgatacccataggctcaaagtaaagtgatgaacaaagatctatcaggcaaatggaaaacaacaaagagcagggggtagctattcttgtatatgatattcaaacagattttaagcaatgatgaaaaaggacaaagaagggcattacataataataaagtgcttaatccaacaagaacacttaactcccctaaatatatacctacccaacattggagcactgagattcataaaactggttcttagagacccattaagagacttagacaaccatacagtaatactggagaacgtcaacactgcactgacagcatcagacagatcactgcagcagcaaatgaattaagatgctctgggcttaaacttgacacttgaccaattagacataataaatatctacacaacactccaactacaaacaacagaatatacatttttatcacctatgcaaggcatataagatgccttataaggcatatacgatgaaccacatgcttggccataaagcaagtctcaacaaattcaaaaaaatcaaaattataacaaccatactcttggactacattgtgatataaatagaaatcaataccactaagatatattaaaaccgaaaaattacatggaagttagacaatctgcttctgaatgacttttgagtaaaaaaaaaattaaggcagaaattaaaaaattatttaaagctaatgaaaatgaagacaacacaccccagaatctttggcacacagctaaagtagtgttaagagaaaagttttttgttccaggcatggtggctcacacctgtaattctagcactttgggaggccaaggtgggtacagattgcctgagctcaggagtttgagaccagcctgggcaacacagtgaaaccccgtctccactgaaatacaaaaaattagcagagtttggtggcatgtgcctgtagtcccagctactcaggagactgaggcaggagaagtgcttaaaccagagaggtggaggttgcagtgagctgagactgtgccactacactctaatctgggtgacagagtaagactccatctccaaaaaaaaaaaaaaaaaaaaaaaaaagagaaaagttttgagtactaaatgcctacatcaagaatgtatacagatctcaaattaacaatctaatggcatgcctagaggaactagaaaaacaaaagcaaaccaacccaaagttagcagaagaacagaaataaccaaaatcagagttgaatggaataaaattcagatgcaaaaatccatacaaaacatcaaaaaaagttggttattctaaagattaaagaagattgatagatcactagctagattaataaaggataaaagagaagatccaaataaacataatcagaaacaacaaaggtgacattacaaccaaccccacagaaaaacagaaattcctgagaaactattatgaacacctctttgcatacaaactagacaacctagaagaaatggacaaattcatggaaacacacagcctcctaatagtgaaccaggaagaaattaaaatcttgagcagactaacagtgagttcttaaactgaatcagtaataaaaacctatcagctaaaaaaaaagctgtggaccaaatggattcaaagccaaattctaccagatgtaaaatgaagagctaataccaatcctactgaaattattcaaaaatatcaaggacaagggattccctcctaactcgttctacaaagccagcatcattctgattccaaaacttggcggagacacaacaaaaaaagaaaaattcagtccaatatctctgatgaacacagacataaaaatcctcaacaaaatacaagaatacaaaccaaatacgaatgaaatcccacagcacatcaaaaagttaattcatcatgatcagaaaacccaatttctttcaacagtatttttaaattctcattgtggagatctttcacctctgtggtaagctgtattcctaggtattttattcttttgtggctttattcctgggatgcaaggttggtttaacatatgcaaatcaagaaatgtaatttaccacataaagagaattaacaacaaaagcgacatgatcatctcaatacacacagaaaaggctttgataaaattcagtatcccttcatattaaaaaccctcagcaaattacacattgatatattgacatattgaaggaagataactcaaaataataagagccatctatgacaaacccacagccagcatcttaatgaaggggcaaaagctggaaacattccccttgagaactgaagcaagataaggatgcccactcttaccactcctattcatcatagtattggaagtcctagccagagcaatcaggcaagagaaataaacaaaggtgatcaaaataggaagagaagaagtcaaactgtctctcttcctggaaaaatatgattctatacataaaaacccatagattccaccagaaggcttctagaactgacaaacaccttcagtcgaatttcagaaaacaaaatcattgttcaaaaatcagcattatttatctacaccaataacatctaagctcagagccaagtaaaaaacataatcccatttacaatagccacaaaataataaaatacctaagaatacaccttatcaaggaagtgaaagatctctacaatgataattttaaaatactgctcaaagaaatcagagacaacacaaacaagtagaaaacattccatgctcatgaataggaagaatccacattgttgaaatggccatacttcccaaagcaatttaaagatttgttgctattcgtatcaaattagcaaagtcatttttcacagaattagaaaaaactattctgaaattcatatagatccaaaaaaatattcaaataccaaaaagcaataatacttaagcaaaaaggacaaagctggggtatcacatttctcaacttcaaactatactacaaggctacagtaaccaaaacagcatggtactggtacaaaaacagacacttagatcaatggaacaggatacagaacctagaaataaagccacacacctacagccatctgatgtttgacaaagttgacattaacacacaatgggggaaataatttcctattcaatatttagtgctgggataattggctagccatatgcagaagactgaaactggacccctttcttataccatatacaaaaagtaactcaatgtgaattaaagacttaaatgaaaaacccaaaactataaaaaccttggaagataacttaggcaataccattcaggacacaggcataagcaaggatttcattatgaagacaccaaaagaaatggcaacaaaagcaaaaactgacaagtgagacctaattaaactcaagagcttctgcacagaaaaagaaactaacagagtaaacagacaacctacagaatggaagaaaatattcagaaactatgcatccaacaaaactctaataaccagaatctataaggaacttaaatcagcaagcaaaatccaaataaccctaattttttaaatgggcaaaggacataaacagacacctctcaaaagaacacatacatgtggccaacaaatatatgaaaaatgctcattctcattaatcattagaaaaatgcaaatgaaaaccacaatgagatatcacctcacaccaatcagaacaatggttattaaaaagtcaaaaaacaagagatgctgcccaggttgtggagaaaagggaacgcttatacactgttggtgaaaatttaagttagttcagcaattgtggaaagcagtttggagattctagaagaactttaaacagagctaccattcaacccagaaatcctgccactgggtatacgcaaatgaaaacaaattgttaccaaaaaggcagatgaacttgcatgtccattacagagctattcacaataacaaagacatgcaatcaaccatgatacccatcaacaatggactaaataaagaaaatgtggctcttatacactgtggaatactacacagacataaaaaagaacaaaatcatagcaacatggaggaagctggttgccattatcctaagcaaatgaaggcaggaacagaaaaccagacaccatacattctcacttttaagtagaaaccaaacactgaatacacatggactcaaagatgggaacaacagacactggggaatgcttgacggagtagggtgggcatggcccaccctgtaacctgataggctacctatcaggtactatgctcactacattggtgattggatcattcacacaccaagcctcagtgacatgcaatttacccatgtcagaaacttgcacatgtacccccaaacataaatgaaagtggaaaaaataaattaaaaaattaaatagtaaataataaggtctcagtgtttaagacaaatatcagtagctgatgtcttcatcttattcacagtctcaactggaaagttgtcaatagtttaccattaagcatgtctataaattgcctgtgtgtgtgtaatttattaaattaagcaaattactttatattcctagtttattaagattttttccatcagtaaatgctgaactttattaaatactatttatgtatctagtaataggattacataatgttttgccttttatactttaattttattaataaatgagtacctttcctgacataaattagcagttttgccaaacaattaaaatgttacacttttatttttaaaaatttgattcaaaacctattgaaatgctttacatggaaaattgtaaactatattagaaaaagtgtgtttctaaatgtctacattgtataattctatcaagctaagaaagtttttgaggatccatagctgtactggcttcaaaaacacataaaaataaaaacatttaaaaacatgttttcagaatgctttctccataggatgagcttctcttacaaacatgtatattttttgctcattttcaaattgttagctttaactccaagatattcattttctagactgaccatccaaaatgttggtaatatactacttgagaaatctgtgggtaataagcatctcataaacttctagtgaaaaataaaaattgatattgatatcaatgttatggagggaagcttagccatatctatcaaaattaccttgtttatatcctttgactcataaattccacttctctgagaatttaaacttaaattcacttagacattttcaaatggcatgtgtaagtcatcgcagctttatttgttatagcaaaactttggagatagctttgtatcagtcaggatagtctaggttatggtgaagtaacaaacaccaccaaaatcttagtgctttaaaacagcaaagttttatttattactcatgctgcatgtttagcaatgggctttacaagggtagtgttcacagaatctaaacagccactagaaccaaaaagaaactgcctggaatagtgcaggcttcagtgacagaagagaaaagaaaacataaaatcattatataaagattaaataaagattatgactacatcaactatatttacacatctttagcaaagtaaaatatatggctaatttgggccctaatgagagtacaaattatggcataattctctttcaaggtagagatttgaatattggtaaactgtgagatctactgtagtcttccattcagacaaccaaatatttgcttccatccttctctcacatacgcattcacttcctccaaagggaaaatatccaaacatctcacccatttactgctttaagctcaaagttctaggtctcagtcatttcagaagttcaacaagtccaacaccatctgccagatgtaccaaatataaagtagaacagcccacctgctatgaacattccattcagatggacaaatttacagcaattacttgtatttagcaatgctgattcacactggccatatacagaaatgggcttctatactgggagtggagcatgttccttgattggcttctgatttgtcttcctaagactaattcccagtccatcattctccccagtccttgagtccaacccctgggtggtaattcttttttcatttttctcctaggctacaactgaataagtcacgtaacaatataacttttttttttttttttttgagatggagtcttgctctgtcacccaggctggagtgcagtggcgctatctcggctcactgcaagctccgcctccctggttcacaccattctcctgccccagcctccctagtagctgggactacaggcgcccgccaccacgccccgctaattttttgtatttttagtagagacggggtttcaccatgttagccaggatggtctcgatatcctgacctcgtgatccacccgcctcagcctcccagattgctgagattacaggcgtgagccgccgcacccagccgacaatatgactttttaatcaatgagaagctttctcagctcatttgctgcccacagagcactaaagcaaaatagtgattttaagtatcaaacagtgactgtcctttttagttcaggaaggtgtttctctttgtagtataactcaaataatttattgaactcttttctatttaatttcaatcagcattatgtacaaataaccacacttacaaattattctccagacatgcttctccgcatattcttaattgcagataccttgaactgccaagatttttgaaggaagccgtatccttagccttttctttcactaagtcttctttccaactaaacaaatgtattgcttgccacttaatctgttcagttgtgatagaaattgttatttgggccataagttttatgtggtctttgccaaacactgacatcaaacaatttttctcttaattttaccttttactgtcataaatcaagacaatttccccttgcaaacctcatatcctaacttttatgactgtttttcttcttttccttctctccataaaaccagcaattctgccctgggcttatcgctctttgtaattcattttcaagcacagtcaacagtaaacaacctatactactagtattcttttaccacacttttcaccaaccaaaaaggacattattgacttcctaagttgttgcaggtgatggttttaatactggttcttcaaagcataatataaacccccatctttacagatttaacaacacttttcttgccactcattgcccaaacaaaatgccaataacatattgttaggttctatgtttttgtagcacaaaaattctggtaccattttttatatcagtcatgattgcctagataatgctatagtaacaaacaaaaacaaactctttgtagattttagtaataaaagttaatttctcattcacaccagatgtctagcatgggtcttaaatattgtgctctatatagattccaggtcaaaaagaataaaacatctggaattgtactagttttattgtctggtgaattaaaaaaggaggaggaggagaggacaaataagaaaaatgaaagaggaggaggggaacagaagtaaggaagaatatggcaaaacatttactctcttaaaatttctaccataagtgaattttagcactatcattcatagttcattggtcaaaattagatatgtggccaggtctttttcacaaggacagagtagaatgatgctcaggaattggaaatgaatatagtgaacataacaaagtctacctaccacaaataaatgttcatccataggcaactttaattaattatgctaaatctgtataaagcagtatcaaaaagctatttaagaaaaagaatgaagatagactgggatattaataaagatctacaagtctaatgtcatttgaaataaattaagagcagtatgtataatatggttcattttgtgaaataaaaggatggggggagaaaaatacacattcttatactcttataaagtcataaaaaagtgtgtaagaataaatcagaaactaaaaagactagtaatgtatgtgcacagggaattgattaaatgaaggataagaagacaatgcagactgttcatgagatgatagttttgatttttgcattttgagccacataaacgtatttgctactcaaaagttctatttaaaatagtaagctacattttgaagaaaaagaacgtttgctttgcatttataactataactatctactagtgagtgtattcctgacagccacatcacagagaatgtcaattcatttagaacaccaggtgttggtgaaaagaaattgttgaatttatttctcactctaccgttttgtttgtttgtttcttcattatgatattcaggtaactctttaaggtaacaagagtttcagagcattctctatatcattgcatagtattttaagtattttaatattcaaggtcttgttcctataacactaatcacaattaatgatattaatgtagtattttgtgtactttgtttttgttttaaaaatgttcctctgaattatgtagggaataaacttcagatatatagctataactaaaaacttacactagaattcttttaaaattccagacaaaatagctccaatgttgattataacatttgcaaatttttaccttaaaatattttatataaaggaaacatttatggtcagtaacatttcttttctagtacatctttaacataccatgaaaaacataatttattataaaagtcactaataatacaaagtacgtgtcacacaataatatgagactgaatttgaaaatctagctgtatttttcagccatggtctagcaacactcccaaactgagtatattgctttactatattgttttaaattaatttcatgtgtttgtttctttaaatttcagaattttttgtttgtttgttttccagcactgatctttgtttatatccatattccaaattctatttctgtcatttcagccatctcaggccagtaaacaacccttgctggagaagagtggtcatttgaagaaaagaagactctgtttttttgagttgtcagagttcttgtgctggttctttctcatctttttgggctgatgtttcttcagtctttgaagttgtcctttggatggttttccaagagaacattgaaaccaaatctaaggaagctaagaatcacaataaaaagatatagcagttgaaagacaaaatagccagtatagaaaaagtgtaactgacctgaaagagttgaaaaacacactataagaatttcataatgcaatcacaagcattaactgcataatagaccaagcagaagaaagaatctcagagcttgaaggctggctttctgaaataagacactgttggtgggactgtacactagttcagccattgtggaagtcagtgtggcaattcctcagggatctagaactagaaataccatttgacccagccatcccattactgggtatatacccaaaggattataaatcatgctgctataaagacacatgcacacttatgtttattgcagcactattcacaatagcaaagacttggaaccaatccaaatgtccaacaatgatagacaggattaagaaaatgtggcacatgtacaccatggaatactatgcagccataaaaaatgatgagttcatgtcctttgtagggacatggatgaagctggaaaccatcattctcagcaaactatagcaaagacaaaaaaccaaacaccgcatgttcttactcataggtgggaattgaacaatgagtacacttggacacaggaaggggaacatcacacactggggcctgtcatgaggtaggggggaggggggagggataacattaggagatatacctaatgttaaatgaagagttaatgggtgcagcacaccaacatggcacatgtatacacatgtaacaaacctgcacattgtgcacatgcaccctaaaacttaaagtataatttaaaaaaatttaaaaaaagaataaagaataaaaaatgaaaaggaaagaaacaaaaccctcgtgaaatatggggttatgtaaagagaccaaatgcgtaactcattgttgtccctaaaggagttggggagagtgtaaacaacttggaaaacatatttcaggatattatacatgagacttcccccaacctagctagagaggaaaacagtcaaattcaggaaatgctgagaaccccagcaaaacacttcacaagaagatcaaccacgagacataatcatcagattctccaaggtagaaatgaaagaaaaaatattaaaggcagccacagagaaaggacagcccaactacaaagggaagcccatcagacaaacagaagatttctcaacagaaattctataatccagaagatattgggggcccatattcaacattcttaaagaaatgaaattccagccaagaatttcatgtcaagctgaactaagcttcataagagaaggacaaataagatccttttcagttaccaaaatccagagggaattcatgaccaccagacctgccttacaagagctcctgaaagagacactaaatatagagaggaaagaccattaccagacactacaaaaacattcttaagtacataaaccagtgacactataaagcaaccacacaaacaagcctgcaaaataaccaactaacaacatgatgacaggatcaaatccacacatatcaataccaaccttgaatgtaaatgggctaaatgcctccaaataaaaggcacagaatggccggctggataaagaagaaaaatccaatagtatgctgttttcaagagacccatctcgcatgcagtgacaacgataggttcaaaataaacgatggagaaaatctgccaagcaaatgaaaaacagaaaaaaagcaggaattgtaaaactaatttcagacaaaacagactttaaacaaagttcaaaatatacaaagaagggcattacataatgataaatggttcagttcaacaagaagaactaactatcctaaatatatatgcacccaacacaggagcacctagataaataaagcacgtttttagaaaccttcaaagagacttagacttccacacaataatgggaggcctgaacatgacttaaatccaagagctgtgttgttgaaaaaattaataacagagactgctagctagtcttaataaagaagaggaagagagcagatccaaataaacacaattagaaacaacaaagaacatattaccactgaccccacagaaatgcaaacaaccatcacagactactatgaacacctctatacacacaaactagaaaacctagaagaaaaacgttaagttcctggatgcatacaccctcccgagactgaaccaggaagaaattgaatccctgaatagatcattaatgagctccaaaattgaatcaataataaatagcttgccagccaataaaagcccaggacaagatgcattcacagcaaatttctaccagatgtttgaagaagagctgttaccattcctactgaaactattcccaaaaattcaggaggagggactctttcccaacacattccatgagaccagcattatccttatagccaaacctggcagagacacaacaaaaaaaggacacataaagccaatatccttgatgaacatttatgcaaaaaacctcaactgaatactagcaaactgaatgcatgagcatatcaaagagctaatccaccatgatcaaataggcttcatccctgggatgcaagtttggttcaacatacacaaatcaataaatgtgattcatcacaaaaacagaactaaagacaaaacccacatgattatcttaatagatgcaaaaaaggcttttgataaaataaaatatcccttcatgttaaaaaatttaaacaaactaggtattgaaggaacatacttcaaaataataaaagccatctatgacaaacctacagccaagatcatactgaatgggcaaaagttggaagcattccctttgaaaactggcacaagacaaggatgctctctctcaccaatcctattcgacagagtattagaagccctggccagagaaatcaggcaagaaaagagataaaggacattcaaatagtaaaagaggaaatcaaactatccctgtttgcagatgatatgattctgtctctagaaaatctcacagtctctgctaaaaagctccttctgcttataaacaacttcagcaaagattcaagatacaacaccaatgtacaaaaatcaacaggaagactgagagccaaatcaggaatgcagtcccattcacaattgccacaaaaagcataaaatacctaggcatacacctaaccagggaggcaaaggatctctacagtaagaattacaaaatacttctcaagaaaccagatatgacacaaacaaatggaaaaacatttcatgctcatgaatagcaaaaaatagaaattgtaaaaatggccatgctgaccaaagtaatctacagattcaatgctgttactatcaaactaccaataccattcttcacagaaccagaaaaagttctttcaaatttatatagaaccaaaaaagaacctgaatattccaggcaatcctaagtaaaaagaacaaagcaggaggcatcatgctacccaacttcaaactatactaccaaaacagctaccaaaacagcgtagtactgttacaaaaacagaaacatagaccaatggaacagaatacagagcctagaaataaggccatacatctacaactatctgatctttgacaagcttgacaaaaacaagcaatagggaaaggactccctattcaataaatggtgctgggataacacactagccctatgtggaagattgaaactgcaccccttcattacaccatacacaaaaattaactcaagatggattaaagacttaagtgtaaaacctaaaactataaaaaccctggaagaaaatataagcaataccattcaggacataggaacgggcaaagatttcatgacgaagatgccaaaagcaattgcaacaaatgcaaaaattgacaaatgggatcaaattaaacaaaagaagatcttctgcatggcaaaataaactatcaacgattgaacagaaaacttacagaatgggaaaaactttctgcaaactatgcatctaacaaaggtcaaatatccagcatctataaggaacttaaacaaatttacaagaaaaaaacaaacaactccattaaaaagtgggcaaagtgatgaacagacactcttcaaaagaagacatacatgtggccaacaggcatataaaaaagctcaacatcactgatcattagggaaatgcaaatcaaaaccaaaatgagataccatgtcataccagccagaatagtattattaaaaagttaaaaaatatcagatgctggtgaggttatggggaaaaggaaacacttatacactgttggtgggagtgtaaattggctcaaccatcatggaaagcagtatggctatttctcaaagagctgaaaacagaattcccattcaacccagtaattccattactgggtatataccctaaggcagcagtccccaaaatttttggcaccagggacctgattcatggaagacaattactccacaggcagggcggggggtggcaggagtggatggttttgggatgacacttttccacctcaaatcatcagacattagattctcataaggaggagctcacaacctagatcccttgcatgctcacaatagggttcacagtcatgagaatctaatgctgctgctgatctgacagtaggcagggctcagatagtaatgctccttctctgccacttacctcctgctgtgcagcttggtttctaccaggccatggactggtactggttcgtggcctagggtttggggactcctggcctaatgactataaatctttctatcataaagatgcatgcacatacacttctccttatgagtactatttacaataggcaagatattgaatcgacctaaatacctatcaatggtagattagataaagaaaatatggcatatatacacgatggaatactatgtagtcataaaaaaagaatgaggtcatgtcctttgcaggaacatggatgaagtcagagaccattattcttagcaaactaacacaggaatataaaaccaaataccacatgttctcatttctaagtgggagctaaatgataaaagcacatggacacgaagaagggtacaacagactttgggcctaaaaattgagaatggaggatgggaggacagagaggagcagaaaaaaataactattgagtactaggcttagtacctgggtcatgaaataatctgtaccacaaacccctgtgacatgaggttacctatataacaaacctgctttgtacctctgaacctaaaagtttaaaaagaaaaaaacaataataaccaacattttaatgtaaacattttcagtctcacactgaaagtgtttgagtgaaacaaaacattttcctttaaaacaaaaacatttaaaacatttcatttcatttaaaatatttttgtataaaaacaaaaaataatcagatttaattttgagttatttatttatttatttttatttatttttttgagatgcaaccgtgttggctaggcgggtcttgaatggcctcaagaaattctcggcctcctgattagctggggcttcaggcacgtgctaccacacccaggctcataagtaaactttctcaatagtgaaattaggccacttctcagagaatatgtatcaactatttatattgccacaaactcagaattagagttaaaagggcagaatttagtgctagaaaaatctgtaggtgttatcagagtaatgtattttaaaagttaattttctaaataaatagtgtttgcatctttcttgatagaaattcacacaatttcagtgatggtcttaaaggtacttagggcttattatattatttatccttatactacatgttctcaggttatcttaaacattttttagctcctctgctgatagcatttggtcaagtttctcactccccttgtatcattacattggctcctggtggtgttaacccactcttacttatggtttccaattaccagagacctgggaaacaaagtaaccaatcttgttactctaaatacatatatctgtgagtggatatgtgggctctgagttattaggcctcctcctttctaataaaatttttggccttttgttcatgggcttgtgtcacttatttcatgctggttttatcagacaaggattgtaatgggtattttaaccactagagaatattttctcatctcatttcagagcctaaagctgtttcctagggatttgaaattgttactgactcaactctgggtaactgctaaaaaaattaatgcatttaaaaaatattttcatactgtctgataaaatgaattgtaattatatttgtttttttctacaaaaagcaacaaatgttattttctttcaaggtcttgctaagactttgaatgattttgctttttgtgtttataatacgactattcttattattccaaatagcaaggcaagtacttacacagaaaataattatgttttacctatcccacctatgaagagaaatatttaaaagtaaaacagtgaagtcttagtaataggacagcaaagcattgactgaggctcgagatggggactttcattctcatctcacagatccttgcaacacaagcaaagttctattgactgtagtaacaaaaggagtgaatatttacttagccatttctctcatagccaggtatgttagtacttgattctcccctgcctaaattcatcattaaatgtgtatatacgaacatactttggaatcttcaggtaacttaactcagggaatagattatgtataaaataagttgatttattcaacaacatatcaacttccaaatatccaaaagtagttatctatcttactgtgagttttctctaagaaatttttacctttacacagatttagaaaattttaatttccagccctccttttataaatatttgaagcaacaagttttagttttacactaagaaacatgtatcattttcatttgcaaaggtatgctttgtaaaacaatatgttaaacaaattcctcacttggatatagtaatccccatttttgttgatcaatatctaaatgttctgatttccttcatgaatgtgagtgaaaactttatagggaatataaacatggaaactaaataaagattttcttgttcagttgtttattgtatgcatgataatcaataaaaatgactcatacaatgcatttgaaattaaagaaatgttaatacatataaaagcaacaatttcccccaatatcatataaacgtgtttttgggaaatgaaaattcattgtatgtttaacaagtggtaaatgatgagaggattttcaatatggatgagtctaatatttatagaaaattgttattttatataagcatttatttctctgcttctagaataatgtaacatttcctgaagtatatggcatttagaatttgaaaataagctcttaagaacaaagtgattattttacttatattttgggcttaaagggtaaaagctctgtttcagcccacaaaaattattgttttctatatgcttcttgggtatattattgtaattcaaaaaaagactgaaaatagaggcgtaaaatagtttctgcttacatgctgtgaaattctcaccacaagattttaaattgaacttgcttaacaggcagagagaaccgtcttctttcttcaaagacataaggacttgttcagtaagaggaaaaggtctagcagcattttcagaaaggggcacattgagtgcctctgtgattcttgctcatattggctctactcctaacatcagaacatgccaaagaagaacatgtgcatgtgacaagcaaaagtaagttaaagaacaagctaacctaatggcctggaagaagtatcttaaaatgataacatcatttgatttgcacattttgtggtctgaaagtccaagacaaccagtgcttacaatattaagtatatttcttagtctgctatatgtaaaactagatataaacttgctttcaccctgaaacaaggtttgggccttgtttaaaatttctgagtagcaaagtactactccagtagcaaagtgctttcatctaaaggatagggaaatattcgcctctattatttaagttttctataataaaaatgtattctatttagcccttgaatacagcaaaagtgttttaataagaaatatgcattttaactctaatcagacattcaaatcataagaagccttttctatatttggtagctactctggctaaagtactgtttcaaatttgtgcactttcagatgtggtaactacaagaaaaagatcaattagctcaaactgataatgcttccatgtatcaatttgacactttaggaactacttgcttagattctacaatgtgaagggatagttgttaattcatgacaggagaaaagtatgttgaagaatttagacaaatagaatgattagacaggacaatctgaatgtgaggtactatcaggggaaccagcccccagtatttcaacgtaggttctattttccctaagtgttggctggtctgagaaataaagagaaagagtacaaagagagaaattttacagctgggcctgcgggggtcacatcacatattggcaggttccatgatgcccatctaagctgcaaaaccagcaagtttttattagggatttcaaaaggggaggggtgtatgaatagggaataggtcacagggatcacatgcttcagagggcaataaaagatcacaaggcagagggcgaaattagaattactgatgaggttccatgtcctgctgggcacgcattgtcttgataaacatcttaaaaggaaacagggttcaagagcagacaaccggtctgactcgaattcaccaggctggaatttcccaatcctggtaagcctgagggcactgcaggagaccaggttgtatttcatcccttatcttcaaccacataagacagacactcccagagcagtcatcgataggcctacccctgggaatgcattccttccccagggttattccttgctaggaaaagaattcagtgatatttctcctgtttgctttctgccagaagaaaaatgtgactctattctgcccaaccccgtgggcagtcagaccttaagtttatcttcccttgttccctgaagatcgctgttgttctgttctttttcagggtgccctgatttaatattgttcaaacacacgttttacaaacaattcttagggttaatgcaatcatcacagagtcctgaggtgacatacatcctcagcttacaaaaatgacaggattaagagattaaagtaaagacaggcataggaaattataagagtgttgattggggaattgataaatgtccatgaaatcttcacaatttatgttcagagattgcagtacagacagacataagaaattataaaagtattaattttgggaactgataaatgtccatgaaaacttcacaatttatgtgtttctgccatggcttcagccggtccctccgtttggggtccctgacttcctgcaacaaggtacctctagaaagagatgaaaagtgccatcataatgcaatgctttgagctactccaagatacaaaacataaaattaacccatagaaaagtatttcaagtagattaaatcatcatgaaaacagaagacaatcttggaccttacatagaagaaatttggtttattattcattggagaaagctcatagaactctgactcagccttcacaagtgatgatgtaagaccattctgccaatgcagcctacttctccctgcgccccaatgcctctcagatcataagatgagaatgctttgcctcactgcttacaaggtacactgctcacttcccacactggagctttgctgtggcctctgatgaatgaaacctataggactcctttgacacccagcctacaggcagacagaaagctgctagctaatatttgcttgctagctggctgtgggtgctataatgttatgggtctggttgccctagagtctataacaaaatcgcagtttagaggagccagataacatcacaagaaaatgttaatgccttttggaggtaactgtaaccaataatagatgggagacgggaagaagccagaacaaattattttctcttcttctcccccagaagttacaatattttcattgtaaccagctgtgatttcttgcaaagctgtggcagctccacaatgcagcactttgcttctctgccttgctctccttttatcctcacttttgtttccataagattgcactcacccactcacatacatatttaataaaattagcacctatgtcttacctcaggaaacatgtcttacatgtctttccttctaggaaacctaaataatcaagaaagggattttcaggaaaaataccaaagagccctttcctttggaaatatttctctcaactatgtataaatgagagagataaaattgtaaaatagagcaagtaagaattatgcaaacagtaaaataaaacaaaacgtaagaatactacatcagccatgaaactcaacagttgttgcaagaattaaaatattagctaagttgctttactttggatcagagcttgacagcgtaagttgacttataatctgtggttcatttacagcctaggacagtttgatagagggagctaaaagtcactactggtagaataaaggaataggaaaattagacatacacaacattttgaaggatctatttattcttctttgatttcagtgtttctagttagcttccagttttctaacatttctccaatgtggttttctacattggcatactctttcctctttcctcttcttagatatatctaaatttcctgtatctttaacataaatttagttggcaatagggaaagcattcaatcaaaacatttacatgaatttttagtgatgatcatacatttaatcctttgggggcagttgaattgtagagacagaattgcttaatcaagagtaacaaatattaaatagtgcatgatagttgggtaatgttaacgtttctaatcatcataagtaatctcactgacatattcttctagaaaaagaagatacaatatttattcctcttgcactcttatagtgttctcaaaatatttttttaaagtcattcttagtttttattttcttatattcacaatgcttaataagattttgtagactctcatgctgaatgcatgtaatgtgtagattcaactgtgcctagtttaaaacacaagctatggtcatctctttgtgaagcttaaatatgtgtctgtcttttattccaattgagtccctggtaactcacttgtgtaacaattatcacagtttccacaccattaactacatttaactaaattaactacattttctattaagagatttgaaattatttgaggagtttttatgaaattcctagaactctacatgctgttggtaaatcctaaccaggatttacctgagacacagccttccagagggaccatcatcaccaagatgcaaaacataacatccttctgttcatctactcatcaacaccatttctcacctgccatgatttcccaataactcatccctcttgtaacttattatctgaaattagtaaaatcaagttatctcccacttcttctataaagctccatttgcacattttgtgctgattgaattcttgctgtaacccagaaacaatgtttctcttgaaattctctcaaacaaaggtattcttcctcattcttgacagaactcagagactgagttattccacatttcctaaaaaaatatgattttgctgaaattctttttttagactatgctatcatttgcctttatttgttgaagattttagccttcttcacaattggacccaaaattcttgaaaatatcaacctccacctatatcattcatccagaatttctgcctctcatttccttgacctcctcactttctacaacgggttattttacctcaactcagtcatgtcctctcatgagcaaatttagactttgtcatcagaattatcatgcaacctccataatttcagaataccactttctatatctccagttaatgtgcactagaaataataccttgctctatcaggtctaaggaaggaaacatgactctcatttctgccagccaatgattaggtaggacttactgcctctgcgttatcagtgagtaccactcaagagagccaaaactctcatttccaccaagcagtaatgagaacaacccccttaagctttaataaaggtaaagtggagaaaacacactctatatatacctaagagtaataagaaaactacccttttccctagccgagacagtggccatagacagccaactaaatggaaggactaagatccagattctcataagaaagtaccccaaaatgtccatatttaaatgaaaaatcaatcatcatctcaaggacaagaaaaatatcaaacagaatttagaaagataatcagtagatgctggctgagtgcagtggttcatgtctgtaatcccaggaatttgggaggccaaggcacgcagatcacttgtagcaaggagttcaagacaaggttgagtagcatagcaagaccatatctgtttaaaatcaataaaaaatagctagatggatagataaattaaaaaacagattccagtactaagtttacagagatgttagagttatcagacaaaggttttaaagcagccgttatacaaatacaaatgcttcaacatgcttgaattgtaaaataaaaagtctcagcaaaaaaaaaagtctaggcacaaaatagaaagcataaagaaaaaacaaagattctagaaatgaaatgaacttagaaatttaggtgatcagatttccaagcaaagtgttgaagttatagactggtttattcttgctgcttttagtgaaattcaagaagaaaattaaagaaatatttataaacataaagaaaatggcctacaaactttacaaaagatactaaaattaagacatttactgtattaagtattttctagagaaaaatatgagtgcctggcattataacctttggataataccttagatcagaaatgcacagtgttcagtcacacaaaaactcttaagtaaattaaaggctcatgcattgaccgcttttgccatattagcagaaccaaaaagtaaaagagattatttcagaaagatctgttgacaaatttcctgtttagtggagtgaattcccatgccatttatggagagacccacaaggtacgtgagaatgttatatgagtagaaacactgccagttttgtccagaaggcacagaaagcacaagtaaaagaaagctattgaactgcaacattccatagtcaagatataagctggtaagactactcaactacaaatacattctactttttatgaaaaggaatgagtgacttagagtcaaaagcccataggactgagctatgaacccaaatgatcaattcatgtgcttcagaatattattcccaggcactgacaagtcaagttttcccatctagattttgaaattgcttggaccagttgattctggttttcctttaattgtttcactcttggagtggaaatatctgtagctactaaatatatatgtctcaccattatatttttgatcagataacttaattcttgtgctttaaaaactttacagatgaagagaaattgtgcttcaggattgattataaccagagcctcacccatgcctaatttgtattacttagatgacgatacacgaaacttttgaggttctaagatttagatgagattttgggttttagttgatgctacagtgggttaagacttgggggtggtttgaatatggtgactgtactttgtaggttgtattcaggtaagtctgaggtccagattttggactgtgatagacagaatatgtcccctcccaagatgtccacattcagaacctattaatgtaatgttatttaaaaataaatacataaataaatattgcagaaagaattttgctaatcagctgacttttttttttttttttgagatggagtcttgctctgtcccccaagctggagtgcaatggagtgatctcagcttactgcaacctccatctcccaggttcaagcaattctcctgcctcagcctctcaagtagctaagattacaggcacctaccaccacacgcagctaatttttgtatttttagtagagacgtggtttcaccatgttggtcaggctggtctcgaactcctgacctcaggtgatccacctgtctcggcctcccaaagtgctgggattacaggcatgagccaccacacccagcctcagctgactttttaagatacggaagatagaaggttactatgcaaaaatcaattgttttcatacctacaagcaatgaacaactggaatttcacatttaaaaaccaatgctataatggcaccaatagaacagaatacttagcatggatctaacaaagtatgtccaatatctgttgcagaagattacaaaacactgaggaaagaaattacagatctaaataaatgatgacatgccccatgtttatgtattgaaatattcaacattgttacaattttagtacttctctatttgatctgtagattcttcagtacaaccccagtcaaaattctagcaagctattttgtagctatcaacatactgaatctaaagtttgtatgggaagacagaagacctagaatagaaaacacagctcataagaaggattgaatttagaggccttacaccatccaatatttggagacttactctaacagctgtagtaatcacaacattcattatttgggtgatgggtacactagtaacccaaactccaacattatgcaatatacccatgtaacaaacatctatctgcatgtaccccctgaatcttaaaacataaaaaacaaaacagcaaaagctgtaagaatcaaactgctgtggaactgacttaagaaaaacatatatagtccaatggaacagaatagagataccactagcagaccaacacaaatattgacaacttattttgatggaggagcaaaggcaattaaataaaggacaggctatccaaaaaactgagcacctgtatacaaaatgtgaacttagacatagatcttatacatcacacaaaattaactcaaaataaatcaaaatttcaatatctttatataaaatgaacattaaaatatattacatatatgtatataaatataaaatgcaaatatagatataaaattcaagactatcaaacttttgggagaaaatctatgtgaccttggtgaagagtttttagaaaattacataaagcatgatctgtgaaagaaagcattggtaagttgaatttgtataagttaaaaatcctgtctgtaaaaatcacttataagggacaagccagggccagacgcagtggctcacgcctgtaatcccagcacttttggaggctgaggcaggcagatcacaaggccaggagttgaagtcaatcctggccaatatggtgaaaccccgtctctactaaaaatatatatatataaaaattagctgggcatggtggtggatgccggtaatcccagctactcgggagggtgaagcaggataattgcttgaatcaggacccgggaggcagaggttgcagtgagccgagatcgtgccactgcactccagcctggattatggagtgagattgcatctcaagaaacaaaaaaacaaacaaacaaacaaacaaaaaaagagacaagcctcacgctaggagaaaatatttgcaaaatatgtagttaataatgaatttatatccaaaatatatatttaaaaaaacacaaaaagctcaaaattaataaaacattccaattaaaaaaaagataggcaaaagacagatgaccaaagaggacatagaaaagggaaataagcatgtgaaaaggtattcaacattatttgtcattagaagaatgttaattaaaaatactatgagatggcatttcttacctattagaatgaccaaaatccaaaaacctaacagtaacaattgctggtgaggattcagagcaatagcaactctcattcattgctggtagaaatgcaaaatgtttcagccacattggatgacaatttgtctatgtcttagaaaactaaacctacttacgatatgatccagcaattacactccatggtatttcacaaatgactggaaaacttacatccacacaaaaacatgcacatgaatgtttacagcagcttattcatcaccaccaaatcaagaaacaagcaagatgaccttcaactggtaaatgagtaaataaaatgtagtatatttatacaatagaatactatccagtgataaaaatacatgtgctatcaagccatgtaaagacatggataaatcttaattgcatattgcaaagtgaaataaggaaatctaactaatctacatagtatgatttcatttatatggtattttggaaaagcaaaattataaagacagtaaacagataagtagttgataaaggtccaggagtcgggtgatctggggagttaaattagtgaaacagggaattgtttagggtaattaaaccattttatatgataatttaatggcagacacactatatatttgtcaaaactattaaaacttcgcagcacaaagaatgaacattaaatatgaaaacgttttaacatttaggaagcagaggaccccaggatgaaatacagactgtaaccccaaaataatataactatggtaaaaatatataaagcaatccaactgaatgggggatgctgatctaagtaaccttgcaaatgagtggcttctataagactaaaggcaaaaagcactgtacgtaaacacagtactttagttgataaagttgttacccatgaaggtatgagttaacaattctgaaacatctacatatttgtactgggattaaacaataaaacaaatgggcaatgcataatgggagccagatttctcatgtttgaagctcaagtttacagaaaagcaagaggagaaagctggaatgatccatgtggggatgcattagaataggagacatcagtacggaatcatgttcagcttaatacagatacagatgcttatgtgtagacatgtggatatgcattggttagtatacacaaatatcctttttgctctaccagttgagaggggatagaaacaatggcaccccaagagcaagaaactcacctatcactcagacattttttttttcctaataccatactccaacaaaaggaactgggtctcggagagatgactgattctcaggcttcagcagggaacatataaattgaatgaggaacattttgtaatatcagaaagttaaaaagtgctttcaaaaaactcccacaataatgcaggtatataagaaatacccaggaaccaatttaaagccaattgccaaagctggaacaattcaagaacccaaataaagcaacattggattataagtcaaagtatgaaatatacattgatgaatccatattgatataaaaaatgaataaattcataagtggagatagttaaatatcccttgcagaagattcctacacaatttatgtagatattctactctcaaggaggtagagcatagcttttcagaccttaagtttgtgctgctcatagtgaattccttccaaagagaaaaaggggaaaaagagtaagtttacagtggagaaacctgacaaatactacctcagcctgatgagaaaggtcaatgtcaacagtcataaatcacggtgataatatctatctttgatgtgatatgatgggaatgagacttaacctccattatcttcctccctaaaacccataacccaaggctaatcatgagaaaaacattagacaaatcccaattgagagagagtctagaaaatacctaaccagtactcatcaaaactgttaaggtgacccaaacagaaaagctctgataaactgaagccagtacagcctaggagacatgacaattaaatgtaacgtgatcttctggatgacatcatatggtaacataataaggacgttaggtaaagactaaggagctctgaataaagtatggactttggtttacgataatatacaaatatcgattgggacaaatataccatactgacgtcagatactaataatagagataattgagtatggaactccattattctcttttttattataaatccaaactattcagaaattaagttcattttttaaaagttatgggccataggagcacatatttctcaaatctgtgcaatggttcacatttaacaaaaaatgttactcctcagagccagacaatctaatataatgcccacaattgtattcaattccaaacccaggattttggagcacatgtctttgtatggggcaacctgtagatgagtaagggctttccaacctggattgcatggcacaatatgcagagtagttaaaaacacaatctctgaaaacaaatcacccagtgtaaaatcctagctctattgcttacgaatcttttgactttgatattggttaaggaagggagattgctttgcagggattgccataagagataaaaaaatcacagttggttttttatgtattattttcctgtcactaaaaatttatacaaggtttagtagctttgaggcaatttacatttagtccactccaggggacttgttgactcaattcttatttctatagctcagtctgaagattatttttgttaacaacaggctttggtgatcttgccaatccaccactgtacccaactccccagtcaagaaataagcttaacatcctcagtcttggcttctaggaaaatgtaaagtggagtaacctggggtgagtagttacagtcccgcccttgcctcagagctacattactttagattactcttccaactggaaatttttagggatgttaagtggggaatatgccacagaagattgagagggatatagtacacagaaaagtaaatagattgattacttgtaaattgttgaatcaataactgcttccaacaggaagtaaggttctgaaggtccaggagtacagcaaggtaccatctctgaaactggggattcagatacccacatctgaaatttttattattcaaaacaataataaaaatgcatgtattctgaccagaagatatcagaactaaagctaagcaggcaaaaggaggagatgcccactaccattcctttgtgttattatttcaaattttattcaataaaatattgtgaaatccaagctttagatacttcattcccattcttttgggaagtaggaactgaaaagccacctgcttctatttactctgctcgagtttatactactaccatatatctgaaaataatcagtttttcacaccactccactgactctcaggaacaatatgagaactcattaggttacagctgtgaatcgcataaagtatttatgagcatagtgtcatttaaatgtaatttacagtgttattctcattcaataattttttgtgtgacctgtgttctgaaaatttccgcttgttctactttatagttaatgataaaatgtcattcaagctgcaattaaaaaaagatttaaagcaaatgttaaactaaataaactataggacttattttctgaagtgacagagaaaaaaagagcaatgaaaataactctagcatggaacaaaaaaagatataaatttgtaaaagaaataatttttcaataaaaattgtaaagcagaaatatgtgtattttcacacatagctcagagttcacataaatgtcaagaggagtgacagttgctgaaataaatgtgtttttttaatgaaaagcaaagtagtaaaacaagcaaaatagatgcataaaatgggtaaattttcagtgtattagttattgctgcctcagggcagctgtaaattactaacttgtttttaaactttttttagtattcatgaatgtattctgagtctgttcttccttcttctgctcttgtgatttgaccctttgcttatttataatcttctttgaagtacataaattaaaggataccagatatttggatggagaagattcatataaaaaataaaatgtaattgtggataatatactaactttagaagtatcatggttataagaaaatcctagtaaaacataagattttactttgtctcctcttatccaaacacttattttaacaaatataaaacgtattcttttgcttttctttttcaaaaatggacaatgccacacaccatgactatgaaaattttaaatgacagtcttagttcatctgaccataccttcttcataggtttataatgctgcagtgaaaatgtgtaatgagatacagaaaatagaaaacagctgtagattaaaatgttttttagtatggcaacgaatctttcagtagaaaagtcattttttttgtacaaatctggagacctaaacagcatattcgctagagctacagagaacagagcaaagtacctcttaatggagttaccccaaagtttatgcaccctaaagttcctatctggcgtccattcctgcaattgcaattaggaattaaagcaaatatctcaagaactgtaagaaatgtttaattcggattttaagtagaaaatcaatacctaaaaatgaactttaaataactgcccaaagtgcagattgtaagaaagtagtaagttaaagttaactccacagttaatgcatttttcataagacctataggaatcccccttcttaaggatgctgaaacttaaaatgaactcaaaaccaggcaaataacagaacaaaagatcaagaacagaactaagaataataaacatagccactttaacaatatcaagtaagaaggtttaaagttataacaatatactcagaccacagtgtggttataaacctatgttacctataatttgctatgcaatatgcttaagaaaagtgtaacatgtatatcagtaattttatcttcacttttgagttcaaaaataatcatagtcatgcacagttcatttttctgcatatattacctactgcatataggtatcgctataatggatctattatactcattacatcaatcaaaaattggcataaaatatagaaatgtatgagttaatatctgatagaaactgtaaaagaaaatcgatttttaaaatccagtagccttaccacttctccctctcactcataaatatgcatgaccaatagccatgttggaaaagcaacttttaaaattcgattttaaatacgtggaaatagaaatttttacaacaattctctctcatcgctaacaactatattaaatcaatgaccattcttctatgttgattttcccctactccactataagttctggaaggaaccaagtcttatgtgactctgactcaaaatcatttagcacagtactctagttgttacctaggtataaaataaatgtttattgagatgacaaatacaaagagcatatacatacggtttagagatcaacctcacaattattttttcacctaaaagctgcattttacaataactattaaaacagttctattgtgaaatatgacacattcaggaatgcaaataaaacaaacacttaacaaattattataaagctaacactattgtaatcaaacccaggctgaaaaacaacctgtatatcaattatctcctatcctcaaagtgtaactttactgatagctattttttaatttatacttttatcacctgagtgcaactgtaaacactagtgtgtagttttatctctttattcgcttgatacaaatgccattgtacagtattcactcatctgtatcagactttctttatttagtgtcaactattgtaaggttatccatgttattctgttaaagtaggccattattttgtttctgagtgttccaattcctgaatgttgaataatatttatttcatttacttatctattttattgttgatgggcattcatgctatctccagtgtttggcttttacgcattatgctgccatgaacgttcttgtgtacacctatatatctatatccagaaacagaacactggggcatgtagaatacataggtttactttattaaacactgctaaagttatacaaagtatcttgtgataattttgaaaaaaaatatttacttccaccagcagccccttttgctctatgttctcaccaattctttacattgtatggagttttttgtttcattgattgattgattaatgatagctatttttgtagatgacagttgaggttttcatttgtaatttccttattaggagggtgaacacttttccaaatgattattggccatttggatatcctgtttggggaaataccagtttgagtattttgtccatgattctcctgaatcatctgacttcttctttttgacttctaggagctctttataaattcagcatatgagcccttactctgttctgcatgttaccttttcactctcttaatgatatattctgatgaacaaaatttttgtttttaatacagaccattttggcaatctttgttttatgattagtgcttttttctgtattgttaaaaattttttctacccctgaggtcatattatcttcaaaagatttatgctttgtttggtcttaccttcagttgttcttttgaagagtgaaaggtagaagtcatgctttttaaattattattgtttcttatattgacgtatcatcatatactgggaagaccatcttttccttcctgctctgctgaacaatctttatcatgaattaagtgttcgtagatgtgtagagtctatttatggactctcttctttgctccagtagcctgtttgtctctatctttgtgtcataccattatacaccaaaagctgaatatttataataaatcttcatattttctatagtaacttctcttctcatcttatgcttctatattattgctttgcctattcttattagtttacacttgcatacaatattagattgattctgccaatttccacaaaaatgtttgttggaattttaattttttcattgcacctatagatcagtttgaaaatcagagacatatgtaagtattgaatctttcaatccatgaactcggtacatttctctatttacttaggtcttctataactttagcaataatgttttataacattgtagaaattaaaatttttattagcattattcctatgtatttgatgttttaaaaccatcaaaatgctatatttttgttttattttaaattatttgcttattgtatagagataattgagttttgcatattagacctataaacaactattataataactttacattaattttaacaatttatcttatattattcttgatttttctatatatacaataaatataagcaagtttatgttatcttttaaataatattttttctcttcatgtagttgttacaacttctaatagattcttgcatggaaatggtgagaacagacgtatttgtcttgatccaaatctcagagagaaaggtatcaacaattcattattaagtatgatagttactgtagagcttatgtatacatcttttatcacatttagttatcctctattccttttttgctgtttcttttctttttgcttagagcttctgttatgaatacatgttaaatttttatcaaatgctttttctgaatttatttaattcatatttttaaaatttacttgatttttgtagtgattaacatcaattaatttttaaacgtgaaattataattgtttcctggaataaatagttgcgtattagtgtggaggggcacagagttaatcaactttgcttttgaatttgagcctttcgtttatttatagttaatgtagtcttaatgattaagggtttaaatcttctattttactatgtgctttttatttattagtgttttataatttgtttaaagatttttatcattttttccctttagttagtttggaagttattcactcttaatattcctttgtaggtttttttgttggaaattacaacaaggattctcaataaaatctaattatacccgaaacttttgcattatctggataaccaaagggctttaagtaattgtatttccatttacttccctcaaaatatatatgctatatttctctatatatactgtttcgtgatgaactatgaaatcaagaccatagatgttcataaccagaatttgtttagatttaccacatagcaatctttatgttgattttcatttttttttctgccttcccatttttcatctggcaacatttccttctacatgaagaacattctctagtattttcattagggcagcacttctgttgacagatattgttagtctgtcttctgaaaattctcatgtgttattttttaaaggtatttagctagctttaagtagctggaatactaggttagtagttaattttatttattacaccatcttccagattcctttgtgtctaatatgaagtcagatgtttgttaatcttttgaaagtaacccatctttaatatgtatttaccttaaaattctctctcaatttgatttcctgtagttttactatgaggtagaaatttatttaattatattgcttgatatttattacatctgtgaaactattaatatttattatggtctaaatatgttctccaaaattcatatgttaaaacttatataccaatattatagtattaacaggtaggatttttaggaggtaagtaagaagggctccactctggtgaatgggaataatgatattaaagaggtttcacattgcattcacccattcttccccttccatcctcctgccatgtgaggacacagctttcaaagtgccatcttagtggtcaaaagcaggcctcataagacataaaacatgccaatgccttgatctttgccaatctagcccacagaacagtgagaaatcaatttatgttattaattacccagtcgcgggtaattttatagtagcaagttttcagctagtatataaatttttattgtgacccatttgccttcatttgtccttccatgactctgataaaaatacattctagatcattctaccgtatcatctagatctctaatccattaatcttcccttccaggattatttcatgtctatgtgtttccttctgttttttttttctgatttatttctagtttgtcaaatatctctttacatattttgatctcgtgttaaacccatccactgagttgagacattaatcttagatattgttgtttttcagtactaaaatttatacttggttcttttataaatcagccttgtaaatttgtattgttgctagttctcttttttaatctcatcttaatatccttgagtatacaaggcatatttattttcatttgttttccaataatttcaatatctgaagatcttgtgggtattttttctatttaacatggtatttctgctggtttaccttcagattgccttgtatcatcatgtgtctagctatcaggggaaccagcccccaatatttcaatgtaggttctttctattttccataagtgtcggacagctgagaaataaagagaaagagtacaaagagaggaattttacagctaggcctctgggggtgacatcacaaatcggtaggactgtgatgcccacctgagctgcaaaaccagcaggtttttattgaggattttaaaaggggaggggtgcaagaacagggagtaggtcacaagatcacatgcttcaaaaggcaaaaaggagaacaaagatcacatgcttctgaggccagtaaagatcacaaggcaaagggcaaagcaaagataacaaggcaaaatcaaaaactcctgataagggtctatggtcagctgtgcatgtattgtcttgataaacatcttaaacaacagaaaacagggttcaagagcagagaactggtctgacctcaaatttaccagactggggtttcttccccaccctaataagcctgagcgtactgcaggagaccagggcgtatttcagtccttatctcaactgcataagacagacactcccagagcggccgtttatagacctccccccaggaatgcattcctttcccagggtcttaattattaatattccttgctaggaaaagaattcagtgatatcttccctacttgcacgtctgtttataggctctctgcaagaagaaaaatatggctgtattctgcccaaccccacaggcagtcagaccttatggttgtcttcccttgttccctgaaaattgctgttattctgttttttcaaggtgcactgatttcatattgttcaaagacacatgttttacaatcaatttgtacagttaacacaatagtggtcctgaggtgacatacattctcagcttatgaagataacaggattaagagattaaagatttttataagaaattataaaagtattaattttgggaactgataaatgtccatattaaaatgaaatcttcacaatttatgttcctctgccgtggctccagccaatccctccattcaaggtccctgacttcctgcaacatctagctatctttgcttgtgggacagaaattttgttatattcttccagataatatttttcttttgtttctgccagatgcctggggacactagttatctaagaccctcttcatacaatttctgagacagttttttcctgaacttcaaatataactctaaactgggctataagctgtataaaagctggtagacttctagttcatttgttcaatcttttttttcccattttaaaatgccagtggttttatagcaccactttaacaggctctgactataacctttccaccatgccctaaggtgctaaaaaatactgatcggcttttcagccatctcttccaatttaacacatgacctcagaacataagcagctctgaaaatggaagacctacttttctaatctttccatatttctgacattctttagaactttaaaattgaatagttctgctgttcaattcataattacatctccgatgccttcaacctgattttgtctacttttgccagttttcttagttagagggttgttataaattcacacatctattactatagaaggtcatactttaacatttatttcttattatgtaatacctgttggttcttgaacattcagaaagtgttaaaaagcacaaagaaacaaaaacacttttttcataaaatccagaattatctactgctagcatttcacatacaaatttcctttttttcctatgtatgtgtatttgagtatccatataatcttttgtaacactggttcatataataatttatagtctgtttgttggtttactcaatattttacaaatattttttcatgttgctaagtcatcttctaaaatgtttgtgagagtcatgaatgttttattaaaaacgtatgtgattataagaattaaagttatagaaaaattataaggaaaagaaaaatcaactgagcactattaacaccagataagtatgactgtaaatatttctcaagagacagatacatatagaaatggacatgtaggttgataggcagaaataaagtttttaagaatgagataaggatttcacacattattttcagaggaattattaaattttatttgaatttcaagtcaaatgaactctgaagaagtacattcaaaattgacaaactaagtatttcttaacaagaatatatacatatatacattatacaattatatacacagagaaagatataaataaattttgatatgttattgaaggattaatttgacacttatgattgctcctctccccttaggtatatgctagatttccagttaagtggaaataattctggcacagaggtacttaagaaggaagaccagaccatgggtcttcaaataaaaactgcaatgtcagcaataaatgtcaaattgtttccccaacttattgcctggccctaaaaatagcaagcccaggtgagattcttcaggaataggtaggctctcaaatatactttatatctattttccatgctggatcaacaaagtaagactttactggatgttctgaatcactgtctttcacagaagcacgtctgagctctgagcatggagttcagcaccttccaatgctgcatagaatcacgatgaaatgttttgtctctccttggcctttacttgtcagggcttatgtcataaagtattcattttctgttttcttgttgctaatgaatttttcctctggattttactgctatttgtttattttcctagttatgagataatgctgatccaagtcacagtccccaaagcctgcttttgttggtcctcttctagttggtgtccctgccttactctaataatacatctgttctgtcttccttagaacggtcaaaatgagcatcgcaaaacattaatcagatcatctctcttctacttaaactcctccattggctcccctggacttggccctgctgcttccttcacacttttcactcctgtatttccctcattcctactgtttctctccagtatctccctcactcctactaaaacacagtggcctctgcctgtctttcaaacagcacaagcctgaagccatctcaggggctttgcatttttccttcctgttacataattcttttctttgtaattttactaggacatttttcttctcattattcatattttaactttaagttggcactgcaaagcagtcttccttacccacctcactaaagtagtagttctggacatattgtgctatttttccattttatcttttccataacacttctcaattcaggaaaatatttgtttatttccttacttatttactcacttcttttatgtgagtccagaacaaaggaggaagagtctgaaattttaccttacttgaaacttaacaggtgagcctgccatatctttctcattgctctaaggggatgagatactcctgggccaaagacagtgtacattattattcacagcaatagtgtctgtgtcagtttctggagccccaattcccacacaatgagtcaaagaggatcaggaaacacctgaacacaagtgacttatattacaggagagaaattctgagcttagggaagtcaaaacttatagactagactttaagaaaacctcctctttgctccagagaaatactctaaatacacactacatattctaaggatgtatgtgttggggctcagaaacagatgtcttaaactatggtgctttgtacgtgctaagttgaaaaaggagcctcagatttctctgacctacctcttaccctgtgctgtctctccccaggattttctgaagttccttgtctgcctgaagtccagacctgccaaagaagaaaactaccttcagtgcttcccctgagtttttcttaactgaacctatattgtaggaaggaagactaaaatctgtcaacaaaccaggacagaacttttgtcacaaatcattttccattctgtgggcccaagaggctttgccctagaccattatatgttcttcaagaccactgaattctccctagtaattatttcttgtccctcgacagaattcctcttctccctccttcctacaaactgttttgccaggattcaagcctcccctttttctgtaatcttaagatggtatataagctcctgcccttcattgggaagttggatcttcattctgaaggctttcatatacacaagttaaataaaattatatgtcttttctccaattaatatgcctcttgcaagttcccattagcccttacatgtattttacataatgtcatcttatattctaccatcatgtgtgtgttagtaattaatgtattgcctttcacctccaaatttacctttcaatatatgttctgtaataatagatggaattccttcgagtatttcccttttaaagagagtacgatgttaagctgtgtcagctgagagtgctcggctggcaggaagttcccagaggaaggagctccccttggttttccagctgcagcacagagtggggtgtcagcaaccatgggtgtgaggacatctggtagagctctgatttagctgggggcccagaatgtaagaaacttcagcaactttacaaccttagcctggagataaactttccataactctcttgaccaagaaaactgttgccctgaaggcctttcatccaaatcagcattccccttttgccatcctctctgaaggtctctgggcagactgccggcagcctggagggatcccacagagtggctattctcactgcagtccattatgcagcctgcctatgcctacggaattctcactaagcctctgttgagcacagtacagctgcctgcaacccagtgttcccacctctctggacacttctgcccctaactgctgattgcctgctcccagcctgcattctggagagttgcctcctgcttgccaagtgcagcaaaccaaaccagctccggcctaaccaaacctatgaacttctctgctatacaatgagctgaactattaggttggtgcaaaaataattgtcatttttgccattaaaagcaatggcaaaaaaacccacaattattttgcaccttcctaatactaaatgacaagttactcaagaaggtcgaaaatccttcaaaatttgtttttctttcagtactttccctctgatcaatcgatctatctatctgtcatctgtcatctatctatctctatttctatcaatcatgtatccatctatataatgtagttactttttatcagactttaattatttttatattaaatttgcccatttaacctacagtatgattttccccttgtttaacctactgtataatttttatgtcctaattggatctacaaaggttcaatgcatttaatcaattcatgttgtaaatatatatgttgtttgtaatctttcatcactattaagaatacgaaaaagaacatctctgatcatgaatatttccatgtgtctgtgattatttcctcagagaaaatacctaaaagagaaaatgctgcttcaaaagttatgtacatttttggctttttatatagtttgcagaaataccctccagaaaggatgtgataaaacatactttttgtagtgaagtatggaatgacaaattcccatcacattataataagcatggtatatttttaaaaaaaggaaaagaaaaaaatgcactaagattacccaacagcatttccctagcctacaaaaaatttaccaaaggtgaggaaaacccatattacagcacatgttggactcttagaggttattacttagagaaataaaagtagtattagatgaaaaatgatttctaagtccctcttgacttgtaaacactccacaccccagaaccctctccacttttgcttccaccagaacctcttcacacctcatttctttattcatcgaaaacctcaaaggaactcagaaggcttacagctgagccaaactatgagttttaaaagcttatcagtcaacttcatcactacttactgtgttcttggggggaaaaagtattctgaatttcgaacatattgcagaaagctaaaactaaaaagaatatttgttctaatgaagcattagacttttttatttccatgaagaggaacgtgcttaaattctgagaatgaggtacatttggtttgccacaggaactgaaaatctgaaattctaggattcttaatctggaagacatgggttttggcaggtaccaggtttaaatcaacagatgtgtctttaaagtcatagtaatagcaaactgaattgcatttgtagagacaatgaatcaaattattacaagctggtagtaaaatataaaatgaaactaactagaaaaaggcaatgagtcaagatgactatagacttggaaatcaatcaatttacaaacatcccaataaaccctagagataattaaagcttcttctcaatcattaactagtaaggccagagccacctttattaaacagggaattgaaaagaggcaaatgtctatgttccaggacacttcacagttcctacatatttgctacttattcaaacacttgtattctggaccttaactttccttccacactcagcatcatctctcaattttggcaaactctatttattccaatatattgattgctttgcataggtaaatggcgcccataagtcatgccacaattacatgtcaattaggcttaaacccgctcagtgactccttggctgcaaatgtttacagacatgatactaaatgatcacttatatgaacattaaaaaataataaatcttcaggctggttgatttggccatttgtacagctgttgacttcattttttgaaatcagataatagttttcccacattcttgccaattaaagtataaagattactggcttaatgattttaaaagatttctggtgtcttcaagagtaagatcctcctaaagtgcatggggtcattatgcctccattgtgttacttcaaaattgcacaaatgagatggaaaatttggtaacctaattccattctcattagtctcatgaatctactataaactcctggtcaaagccttggcactgacctattaatagatgtttgaaacaccaaggaaacagaatattcttttgaacttgaactccttgttgacaggaaatggaaagagtagtgggtgttttgtttgaggggtgtgtgtgtgtgtgtgtgtgtgtgtggttttgagaggttcctgcactcagcagccccaaagctgcagctgcttcagagagacttcctgcagagtgacaggctcccttctgaggaaaacaggagtgaaagctgttttggatctcagcactacagggtgctgcacatggcaccagctttcaaagtccctcttatgctcttcaatgggacaatgtcagtttagtgaaatgtgactaggtagaaaagcacagaaatatcatttgctttttgtctactactcagcacttcaagggttctgtcatactgcctttttgagaaaaaaaaataaaattgtttaatcatatattgtgagcccaaagtgttcagaattcacaagtagacaaacatatctgcagaactgggtgaacaatgcccccaaagatctccgcaacctaatccctggaatttgttaatatgcttccttgcatgacaaaaaggctgttgcaggcttgatgaaattatgggctttgagatggggagattatcctgtattatccaggtaggccaaagtaatcaaaagtgatcaaaatcagaaaaagaagatgtgactatagaaccagaggttgaagtgatgaactttgaagatgaaggaagaggctataagcaaacatatgcaggtggcctctcaaagctgataaaagctttcatgcagcctccagatgaaaatgcaggcctgccaactccctgatatcagcctctgaacatcagaactaaaggaatataatttttgttgtttaatgctactgtttctcgtaacttgttagagtagcaataggaaactgacacaagaactaatcagcatatacggagctcctaggatgaatttagttttgtgactgtttagggatttcatgatggtaaaactcaggataaagtcaaagtacttctaaaatctccaaagactcaagaagtcccacagcattctgactgccacgagcgaaaggatacctggaatagaggccaaagcagtcatccttaaaaattaaaaagtcttcagcatatggctagccagttttcccaacaccatttattaaacagggaatcctttccccattgcttgtttttgtctggtttgtcgaagatcagatggttttagatgtgtggtgttatttctgaggcctctgttatgttccattgttctatgtatctgtttttgtaccagtactatgctgtttttgttactgtagccttgtagtgtagtttgaagtcaggtagtgtgatgcctccagctttgttatttttgcttaggattgtctttgctatacggactcttttttagttccatatgaaatttaaagtagttttttccaattctgtgaagaaagccaatggtagcttgatggggatacattgaatctgtaaattactttgggcactgtggccattttcacgatactgattcttcctatccatgagaatggggttgtttttccatttgtttctgtcctcttctagttccttgagcagtggtttgcagttcttcttgaaaaggtccttcacatcccttgtaagttggattcctaggtattttattctctctgtagcaattgtgaatgggagttcgctcatgatttggctctctgcttgtctgttattggtgtataggaatgcttgtgatttttgcccattgattttgtatcctgagactttgctgaagttgtttatcagcttaaggagattttgggctgagatgatggggttttctaaatatacaatcatgtcatctgcaaactgagacaatttgacttcctgtcttcctaattgtatacctgttttctttctcttgcctgactgccatggccagaacttctaatactatgttgaataggagtggtgagagagggcatccttgtcttgtaccggttttcaaagggaatgcttccagcttttgcccattcggtatgatattggcagtgggtttatcataaatagctcttattattttgagatacgttgcaccaatgcctagtttattaagagtttttagcatgaagggctgtcgaattttgttgaaggccttttctacatctattgagataatcatgtggattttgtcattggttctgtttatgtgatggattacgtttattgatttgtgtatgctaaaccaggcttgtatcccagggatgaagctgacttgatcatggtgaataagctttctgatgtgctgctggattttggtttgccagtatattattgaggattttcgcattgatgttcatcagggatattggcctgaaattttctttttttgttgtgtctctgccaagttttggtatcaggatgatgctggcctcgtaaaatgagttagggaggattccctctttttctattgtttggtatagtttcagaaggaatgataccagcttctctttgtacctgtggtaggattcagctgtgaacccgtctggtcctggactttttttggttggtaggctattaattactgcctcaatttcacaacttgttattggtctattccgggatgagacttctgcctggtttagtcttgggagggtgtatgtgtcgaggaatttatccatttcttctagattttctagtttgtttgcatagaggtctttatagtattctctgatggtagtttatatttctgtgggattggtggtgatatccactttattatttttattgcatctattgtatcccttccttacaccttatacaaaattaactcaagatgaattaaagacttaaatgtaagacctaaaaccataaaaaccctagaagaaaacctaggcaataccattcaggacataggcatgggcaaagacttcatgactaaaacaccaaaagcaatggcaacaaaagccaaaattgataaatgggatctaattaaactaagaatcttctgcacagcaaacgaaactatcatcagattgaagaggcaacctacagaatgggagaaaatatttgcagtctatccatctgacaaaggctaatatccagaatctacaaagaactttaatttataagaaaaaacaaacaaccccatcaaaaagtgggcaaatgatatgaacagatacttctcaaaagaagacatttatgtggccaagaaacaattgaaaaaaagctcatcatcactggccattagagaaatgcaaatcaaaaccacaatgagataccatcttgtgccagttagaatggtgatcattaaaaagtcaagaagcaacagatgctggagaggatgtggagaaataggagtgcttttacacagttggtgggagtgattagttcaaccactgtggaagacagtgtggcaattcctcaaggatctagaactagaaataccatttggcccagcaatcccattgctgggtatatacccaaaggattgtaaataattctactataaagacacaggcatacatatgtttattgcatcactgttcacaatagcaaagacttggaaccaacccaaatgtccatcaatgatagactggattaagaaaatgtggcacatatacaccatggaatactatgcagccataaaaaggatgagttcatgtcctttgcaggcacatggatgaagctggaaaccatcattctcagcaagctaacacaagaacagaaaaccaaacaccacatgttctcactcataagtgggagtggaacaatgagaacacatggacatggtggtgggggacatcacacaccatggcctctcactgggggtggggctgggggagggatagcattaggagaaatacctaatgtagatgacgggttgatgggtgcagcaaaccacaatggcatgtgtatacctatgtaacaaacctgcatgttctgcacatgtgccctagaacttaaagctaaaaaaaaaattttttttaagtcattctagaatccatcccttctttaggtcatgttactacttgaaaagtctttggcccagtagattagtctttaaaacattgatatcaaaacatgttaataatttgtttccaacctatttcttcagccccatgtcctcctctagcatcctgcatgacagatgcatccctggaaaaaacataccaatgctggagccactgattagaatgacttacctggcaaatgtctgctcttccttccagaagtccagagtaagcattaactttgtaaacagcctttcctaactttccacgtcccttccttaacagcctaaatactttgctgaataaaatattattacactatcaatgttgtagtgtaatttctattatgacataatctatctttttaaaaatcttcctatccctgcttgattatggttttataaagaatgaaaagagcaaacttattaactgcctgatccttaatacttaagttttggcacttaaaaaatgaatgaatgaatgaatgaacaaatccaagagtataggttttaatgagttcaatttgtgtgcatgccaacaggttttctatggcaaaaatacctgacccctgacatgactctcatagctctgtgacaggttttccatggcaaaaatacctgatccctgacatggctctcagagctctatgtaacctgtctccaacttcttctgcctttcctctactcaattgccttgcttcccagctctgctaaccatctttcaattactcaaaataaaaattcttttttgttgttttaggaattctgcaaatgcctctgttcattattcaaatcacatcaactaaatccacttctacttctcatcacacactttgctttgatagcttcttcctatccaataagtctcacattaaattacaattttcttaaaggcctattgtgaccaaccaatctaaagtagatagctattattacactctctcacagctcatattcttttcctatgtataacaacttgtaattataagcacacgtgtttagttgttaaatttaggtctctccctcagaaatgaagttcaatgaagacagacatgtcagttttcttccccattattgtactatctacatggcaaaatttgcacacaatgtcagggctcaaaaatatttgttcaattattgactagatgaaggatacatgcatgaaagaaaatataaatgacttaatagcaaaagtttcccaagcagagatggatactttgccatactttgttgacatgaagagaatcagctatatgtagacaaattgatgaatacaaatctatcaatttgtttgtaaaaaaaaaaaaagtgtataaatcagcccattttaatcccaggttacaataatacttgctagatattatggtatacaggtaccaatttaagtagtaattatagctgagtagattaggttagtgtgtacacattccatacaaacatcaaagtctttgttcaagaaaataaaatgaagtacatttgacactagattgccctcatgtctcaacagtaaatattgtttctgatcttaaaagttgttttatgcccacagattcagaattagttattgttgtttcctactttgcacttaaatgcgttttcaagtgataatagaatttgtacaaatttcttcattcacaatttgttttgcttcattcacaattgtgttatttctttcttattataaacaactatatagtaccgtatcaacatgttaagtttcaactttctgaaagctgtgaattccatagtctcgagaacaatggctctgtctattgcaatcaccaggaaaaacagcataattttatcaggcacaactaattattttagaatgtttttagacagtgataatgttaattgtgactcgtactaagatcatctccaagttcttaaaataattgattaatctcttgttttcaagactccttaaatttctgttgttttctggggctaagagactaagaagcatatatatatatatatatatatgagaaatatatatatatgagaaatatatatatatgagaaatatatatatgagaaatatatatatgagatatatatatgagaaacatatgagaaacatatatatatgagaaacatatatatgagaaacatatatatgagaaacatatatatatgagaaacatatatatgagaaacatatatatgagaaacatatatatatgagaaacatatatatgagaagcatatatatatgcttctcttacacagtgtttaatagtagtagtgataaaacatatatatatatgtcaagagagagaaaatcataacatttgacttgttttttatagttttgttctcaatgcacattagtattcattcttacttgaggttcagaaaaacattaaggtttttgtctcttcttatccttgttccattagttatcaatataaacatccttaccatgttgtattataataaaactttatcaatattgttcatagttatctgtatccatatgttttttcccacactagcaaggattctaatttattcatcttggtataaaaaaatctctacagtgcatgttatacaaaaggccttaataatatttgctaaattgagcagactggagtaggaattgtagttattaacaaacttttgaaattagaatcctaggctaagtttataatccatttacaagattcaaaatgatggctaacaaaatcaggactagaagttacctagctgatactttgagcaaagctttttccactaaatagtatatctgaatgtcttgtgacataaattcatatgtttatatatctctaggaattagaattatccctaaaaattagaaaacgaaggaagcaaatgacttcaattcaaaataatataatatgtaggtgcataaaatattaattatcactttaaatagtagttagctttgagttactacagttgttaaaccatgggctagacagcttttcaataatgatattagagggaggactcaaacatgagacggttgggctagataatatttgaatttcattccaataggtaaagtccacgactctattttttcagacttgtacttctaatgaaaaaaagtagccctttatattttacctacataccttttatgatcaattaaaaattaattaatagaaatatatatattctaatcaagtagattgggttctaattctgttattgtttgacttggggaatttaatgacagcacagcaaaatagttaagagtgtgagatctggagttatccctgctgaatttgagtactgatcttcatttttgtatcctaggcacataacctctataagaatcaattgcctcatctgtaagtttgatatgatgccacgtgaggatgctctcaggagtaaataaaataatagctataacatgcttagcagagtgtttggcctggcatataataaagtctcaatatatgccatttatccttcccatcctggttccccagaagtaaaattgaaattgtactagatcagaaatatcacataagagtaagagtaccacccctctcacacttatacaaaacatttccaagcaactgcggcacagaatcctgaagagtcagccttgttttcaggatccttcttaacacacccttctaaacaatcaccatcagttaatcaaaattggcagagaaattaaagcctacttgtgctgtctggacttgatggcactaagattacttgtgatgttctagaacatggtagaaactataataataaaacagggtcatagtattgtagatacgatgctattatttagcttaaaaaatttaaaatatagtaaatacacacccatgcactcatccacagtacgttataaagaatagaatcctatccattgtccatgttaaaaaaaagaaacacttgcccctcttcactattctcatcttactgaagtcatggtgagagtatttctggaaagagtggctgttggtagaatgagaaagaaaaactgcaagcatatagcaccaattccaccacattcacagtatgtatatcttactatcatgtagcatcagatgcatagtgtgaatagctattttgggtcacaacaatatagcctgagaattgaatacattttttaagttaggcatgatttgattgtatttggcatagaagatttagaatgtgacaaaaagtaaattaatcttaatgtaatatatctcgcttttatcatcaacaatctttattattctaattatggaaatctgttggtgaacaatgggcacaaacagaataaaaagattggatggtttttatttaagttgcaattgctaacaactcatacacagttaacatttcaaatgaaagggcaaacagtgttcatgactaaaattaatggaaacagatgagaataatctgttctcttaatttctcttattgaagctcagctacaccttactgtcctcctgatggttggctatcaatcatttgagtcatgcatctctttcatacagatgacagtcaagcaccagatacactggatgtgggaatgtagaaaatctgatatttcaagttgaccatccagatagattatcaaagttttgtaattgcattttgtaattgtattttgtaattgtcttctgtgggtttaatctgctatttttaatagagaaaattatgagagattaaattttccatcttcctactctagcacttttaatgctacaaaaacattttagagactgtaatgattgttcaattttctgtctttaggtacaacttgttaagtacttgaatcatctgcccaaaatttataaacaacatataagaagcactttaacaaagacgtttgatgaacaagttgttttggattggtttacttttaatcacttcataggaaatcctaatgtttcccaggtgagtattagcaggattctaagaaatcataaaaagtttttcacaaaataataattcatttggatttatatttgcaaatgtgataggtttgcctacctatacaagcactaatgatgtaagggaaggtatataacaaagacctgaaatgaacatacatttcacaagttttaattatatgatcttgaagtgtttaaattgctgaatgtgtcaaaaattatgttaagaaataggggccgggcatggtggctcacacctgtaatcccgtaactttgggaggccgaggcgggtggatcatttgaggtagggagttcgagaccagcctggccaatatggtgaaaccccatctctaataaaaaaaaaaaaaaaattagccaggcatggtagcgggcacctgtaatcccagctacttgggaggcaggagaatcacttgaaccctggaggcagaggttgcagtgagcctagatttcaccactacactccagcctaggcaactgagtgacacaacatcttaaaaataaaaaaaaaaagaaaaaataaataggaacagtgggaaggaaaaatatcaagaatcaaatacttattctgaaatacaaaacaaaatttatttgcctttctccaaattttaaatgctatcctttaagaatgttccaaaatcaatcagttctcaactgtacagtagttgttaatatatcattagttaaatgggatataaaataaacaacaaatatacaaatattgttctgcaaaaatatgttgtaatttgtttttgttgtatttatttaggaataaatattttcttctagaatagctgaatgtagcctaaaatacaactttatagacattcaaactgtattaaattgccaattttgaaccttctgttctttagaaatggcaaattcgtattattacatataatattttttaacagaaaatacttttaaataaaaacctttaaattatactaaatagttgccatattggacttaaactacctaaaaatactagttttatctagttttcatagggatatttatatcagaaaggatatttaaaggaaaagaatacctttaagattttcaaaaaacagttgacaggtggagtaaattagcctggaagagtgcctggtctagagtcaacaccgcaataaaactatgaaatctattaaatacaaacaaggcattttctaaaaatataatttttaattaagaaaaattcagacagtacgtatgcgaactataaacatttcatacttgcccacaaatgttacagtccctctaaatattaattgattcacttatttctaattataacttaatacgtagtatttacataagaaagagtagagagcatttcacaagcttaaaacataatataatacctgctttttcataggcataactttcttactcagatgtatttcccaaaaaaaagtggttttaaataagacatataatcaaatctataaaagataaaatgttttcattacacttgaaacatactggataatagaacattgaatgtttctctctcacaatccatattgttccttttatacgtgaatccttttataatgcaaaagagaagaaaaaagctaaatttcagcaaatgaaaaagaaacatgcaaaataagagtaggtacagaagtttctagtctggaggtcagatccaggcatcattatgttgaaattgatgtggtcacacccccagtggtgatagaaaaacatttcacctcaggaactatttgagataaagagcaaatgaagtttacacagtgtttaatcggagtagtgataagaggtaggaagtaatgacaccctgaagtcgcagcctcagggaaatggttgacaagagtaatttacctaacactttggaacctctaaagtctctatctaataattatctccctgcctccctaaccttcatttatccactctcttttcattcattctcttcaattcttggagtgtgcttccacagtttgttccctgacttcttaatttgtctgagtccgtctcatagagtttgcccccactccatacacacacacacatgaatgccaaatttatattttctttccttttctttcttattgtgtctatagacttcttcttaagaaactatattatgaaactcaagtaaaatatttaatatttattgggcttttagaataagactttatttttattataaaattcagatgaataaaatatcacctgttttttaaaaatctctaactaaattaacttacctttgacttttattcagctaccattataaatgtagtgacaagaaataggaaaaaattctctattttaatttatacttagcaaaatatatgttggcacaattaaacctcatggcaagaatgaggacctggaaactttgtcagttttaaatccctttctatgtaatttactcacaaaattttgatttaatctttggcctcacagaaataaattaggtacaaaaaacaggtgtagctggtgttgtgttaaatcagtcaaattcatttttttctttttccactaatgatacttcccattgttcttagtacaaacgtatgacttcaaacagcatgtatcaaaagtcaatcaagcattttatacatttatattagcagcaaatcattaagaacacccagcatctaaaattagaaaagtattctggagcaaggcatttcctcccttggcactatcaaaagctcttctcagaggtaaatattttgttcacacaacagacatcagctgattgtataaccccagtaggccataaaatgaccttattaattgaaatgcattgtaaataatagcagggatttcacacagcaaaggctgtacgcgaaacaaattaaaaaaaacacaccaaatctggagaaactggttatgtgtgatggccaataatacatttatttattaatatatattatagtctattaatatacataatgcaatataattacagtatatattgtaacaatatatctcattgttctgatatgcatgcacatttgatgggtgaatgtgatcaattattgaactcagaaattagttaagactgcaagtaaaaatacttctaaaagatggaattttcctccaatctcagaacacttgggaaaagtcactttgtcatcatgacatgaacaaaacatgtcaaaataaaaagctctattttgtttatctatctaaaaaaaaatcaccctcttgcatgtacagctgtttacacatatatgcatgtctgcatgttctttgggggaagagggcctgtaccttgtttttgtcccttaaccatttatatctggatgcctgggaacccctaattcgttcacataaatctattttgttctttgtaagggctctatattagtccatgcctattgtggatgtaacataattatttagcctgccaaatattgtagtcattatgttatttctgtaattatgtgattataaacaacactgcaagaaatgttcttgtatataagtcaactcagacatatgttagtttattagtaacagtcctacatgaaaagaaagatatagctcttttcatagattttatcaaaatgtccctcaacaaaaaatatataaaaaggcatgttctgaaacctcactgacaatttttgtcaaacatttttgatgtctactaagtatttaggtaaatatattatgcctcattattttaatttaaatttttccaagtaaattgaacatcttttcacatgttgtctttttatgtctattctttgcctacttttctatgggttattaaatttttttgaattttctaattagtcctcttcatattttaaacaattgagcatttggtcttgcacacatattgaaaatacttttctataatgtgatttgtcttttaactctgttaagtattttttcaactgtattgaagcataatttaaatacaataaaataaaccagttttaagtgcaaaatttgaggttttataacacatgacataaaattatttctgtcactcagactgtcctcattcccacttcaaatcatttcttccctattcaccttcccaagcaattatagatcaaattttcataactataaattaggtttttctttaattgtatttatttatattatttttattttatttttatatacttatttctgtaacaatagattagttttgtgttctaaaatgttacacagatctgtccctaacctttacctccggactcttatggtgggaaaaaagaggctttgagacttcactgcctaacagcagtgttctggaactccatgctgtcaataaggtagtagacaaattaatttgtgagggactggcttcttcaccttatactttagcataaaaattgataaagcaagtttttaaaaattttctccaagatggcagataagaggtttttagtgtgcctcagccacttgaaaacaggaaaacggtacataaagatcaactctgggagctttaattcaaaaaggaaaacaggaatccactggaatcttgaaggacaaccaagattctggggaggaaaacattggcaaacagcctctgtgatggaatccagctgataaaagtgagtacagtacaggagggaggcagagagccttcctccgtgacttacctttccactggggatcggagaaacccaggccaagagagagcacttcgtttctcccaagccttggagctaacatagggagagccttggaggactgagaggaaaagacatggggaaaagctacagatattttcccagaccttggaccaagagcagggtgtcatttttaatctgggtgcacacaaagtcaaccattctttggcaaaaaggcagtgtggtcatgcaggtgtttttgtctcaggccagagattggggcacttgctctggattgtggtagcggcccccacagccagaattgtgaaaagcacctctacattaggcataagaattgtgctttcccctatcacaggcttagggtgggaggagtgctgccacagctacagtgggaaacagaattgaagccaaggccagtttggcaatctggaaccagtctgtgtgtgttattgctgggtgccccagcttgctcccctgagatcacagtgcagtggggctctctccacttcaaccccaggtagaatttcacccattcagaacacacgcttatctggaccactagcctgagccaccccactcttcctgggcatagatcctggtgcaatgatgtcttctttgctccatgcccaggcagatctccaagaatttggatcatacactcacatggactagtaatctgaggcaccacacgcctcctgtgcagagatcctggtgaagggggccctcttcacttcacaaccagtcagatcttcaggcattcagggcaaccactggcctggttcagcagcctgagctatgccacctttcctgagcataaaccatggtacaatgcaatgctctcttctccacactcaggcatatctctagacattcagagcacctactcacctggaccagcaacctgacccaccctgcctttcctgtgcaaagattgtggtatgtgggggatgggacactctctgctccacatccaggcacatctccaggcattttgagtaactgcttgcttggttaggcagcctgagccaccatacccttcctcaacatagatcacggtgcagcaatgccccgtccgctccacacccaggcacatctccaggcatttggagcacctgctcacccagattggtagcctgagccacttcaccctgcctgtgcagagatcctagagcagcaggcctctctgcttcatacccaggttgcactccagtcattcagagctcccacttgccttgttcagcagcctaagtcacaccacctgtcctgtaaaaagatccttgtgcagggtccctttccactccacacccagtcaaattttcaggcattcagagcatctgctcacctgaatcaacagcctacgctgccaaaccattccttgcagagactgtgaggaagcagggccctatccaacccaagcccaggcagatctccaggcagctggagcaccagttcatccgtattaccagcttgagatgccccacccttccagtacagaggctgtggtgcagcagggttctatcaactccatgcccaggcagatctccaagtacctgtagcatccactctccttgattaggagtttaggccacccctatccccagcttgttcagagaactttggtttaaggaggtttcccagctccattcctaggcacacatctgggaacttgctggtcacccactggattcttcctcagcactggtgcttatgcctgccatcaggggactggtggtcagtgcttcccaatctagcctcatccatctctcacccatctagggcttggcattgagctcagaacactgtgcactccatgtagagagcttcttttggtcagcaaggatcaagtatatatccagccatgttaactgcagccagctcttacccataagtgccatctactggctgtacgtcaaactgcacaactcaatataaaacctgtcaaaagaagcatgtagggatgtagaagcaaagccaaaacaccctactcaatattctctaaagtcacacaccctaaggaaagggggaaaggaaagaaaaaaatcagtaatattattgaaagaaaatttaaaatcctacttgcatgaaaataattataaactagaagtgctagcatttccagatgagaaggaaccagcataagaattctgacaaacatgaaaaatctgaacacactaacaccacccaactatcacactgtctctacagaaatggtccctaaacaaaatggaaactgagaaatgatagacaaagaattcaaatcatagattgcaaggaagctcaatgagatccaagacaaggtggaaatcaacaacaagaaaaaaaaaccttctaaacaatacaggaaatgaatgaataaataaatatattaaattgaaaatttcccttaaggaatttaaaaatataactgaaacctttatcaattaattggaccaaacagaagaaagaatttcagaacttgaccagtcattcatgcttacctagtcagacaaaaataaagaaaaaagaatttagaaaatgaaccatcttcaagaaatatggaattatgtaagatgacaaaacttgtgaattattggcattcctgagagagaaggagaaaaagcaaaactggaaaatatatttgaggtaataattcaattttttaaaattttgctagaggtagacatttagatacaagacatccagagaacattcttgggataatataaaaaatggacactacaccaaggcatatagtcaccagagtgctgaagggcaatgttaaacaaaaaatctaaaaggcaactataggaaaagatcacattacatacaaagttttagctatgacttctaaatttcttttcaaataatcgatatgttagtatgttcaattctttaccttctacttttaaacttaacttcctcataaagcaacctttttcgattacctgctccaccctgactcatttcaatcacctgctcctccctgactcattccgattaccctgctctgtcataaccatttttccccaccaaaccactcactgagtcactctctttaaattaaccaatcagaattagtttagcctgtgtagtctagccctagccaataggggaatgacacagcagcaggggccacgtatgtcagggataagaaccccttcccctcccttgtccaagtgtgcgctcaccattgctccatctgtaagggtgcacccttctatagaagtaccttgccttgctgagaattaaaaagaaaaatttatattcaagtgctatttattttgtggcaccgaaactttatatataacaatttgggggctcgcccacaattacatttccctctggggatggtctctggttctctctcatgaggaagtacacaccccgctccttgtggcagcctcaggggtgagaaatcagaacccacccagtgcgaggaataacctgagcactgaacaacgcagaaaaaagaaaaaaagattggccagcaacctagcttaaaggatcctgatactgctgcgatgactctgcgcacagaccaaggaaggagaagccacgggagccggtacagtatttccctggtggtcaggaccccctcggaggggggtgtggtggtgaagtactccttggttggggtggcttagaggttaaaaagcggcgagacgtctccactgggggggtttcaacctcacatgaacctccagtagtagaaaaggcaagaaatttccagtggggaaattgagcctcacctcaaaaaggcaagaaatttccagcggggaaattgagcctcaccccaaaaggtgagaaatttccagtaagggaaattgaaccttgaaccttatcccaaaccatcaagatgggaaataccccaagcaagacagggagcaagggggataaagatggtaacaaagatatccccccaggtagccccctagtctcatgctaaaacactggaaggataataaaaggactaaacagaggaaaaagcaacaaatgataaaatattactgttttatttggactcagacccatcctcaaaccctcaatattctggccaaagtttgggtcgaatgagtatgtgatgtgtaagcttctaatccgatatgttaatgataaaagtccagtgtctcaagaggaactaggctatgccctttgttggaggcaaggacctgctctccttttctcccttaaaaacaaatagggaaaaacccaatctggcacctcaaaatgaaaagtcagaggagccagctgtcatgcctaaagactccagtgcatgggatcccctagactatcttcccccactcagtgtccccaatctttcccctcagacagccactgccgcctcagatcccattccaaattccccctctactcacattatccctcctcgttataaccctgactcttaggaattactgtcccaccacctgttccctaccaacctaaagacccttctctaaaaggatcccagcctccatctggagaaccaaggtccttgtctaccaggccccctaaagagtatgggggagcagggttaaagaattccagaactaagagggaggaaggacaagataggtgctatagacgtggaagaacaggccacttcaagagaggatgtcctgaacaaagaaaggagaaagaagcccttccactcatgactttcaaggaagaatggggggtcaggggctctatctcttttatcctgagtcccaccaggagcccttgataaatttggaggtgggacctaaacatgagcttatcacctttttagtcgattcagagtttgctcgctcctgtgtttgtttccccccgtctaatgttgtctcctcctcagaggaacttagtctctggggtaaaaggggaaggagaggggagaacagcagcataagcagctggcagaggcagggaaagaccagcagagaggaaagagagagagagagaaaggaagcagagagaaagagaggaaaaacagaaacagagagaaaatgagtggcagagagagaggaagacagagacaaagagggagtcagagagaaagagagagacagagtcaaagagagaaagaaagagagagacatagaagtagtaaagagaaaacaatgtaccctattcctttaaaagccagggtaaatttaaaacctataattgataattaaaggtcttctccgtgacactataacactccaataccaccttgttgtcagtataaacgagggcatagcccgaaagcactgaggccactgacaacccgtagccttcctaatcaaaaatccttaacccggtaacccaggatggcccacatgcatttaatctgtagtggcaactactttgctagcagaagaaagtagaaaaatagcttttagaggaaacctcattgtgagcacacctcaccagttcagaactagcctaagtcaaaaaaaaaaaggaaaaaggaaaaaggtagcttaccaactcaaaaatcttaaaaatcttaaagtatcgggctattctgttagaaaaagacgatttaacactaaccactgaaaattcccttaacccagcaggtttcctaacaggggatctaaatcttaattaccatacaaagttccgaccagacctaggaggaactcccttcagtacagtaccatagatagatggttcctcccaggtgattgagggaaaaagacacgatgggtattcagtaattgatcggaaaactcttgtaagagcagagttaggaaaattgcctaataattggtctgctcaaatgtttgagctgtttgcacccagtcaagccttaaagtatttacagaaccaggaaagaaccatctataccaattctaagttaatttggactaaacaaggtcttattaataacgaaagataattgaaatcccaaacttacaaggttttcaacaaaagtaaaatttgctacaagttaacagtgtaacatatattaccctaacttctaatcttgtggccttaggcagtctagtccacagacatgaaggaagttcgccttggaaaagaatggttatcatctttggaaaaaaaaaaaaagggagaatttatgtaaaaagaatgttatatggtaaattattgtcctaaaaaattaactggttgtttaaagaaagggatgtttgcaacaagtcagaaagttgaagcgtgttgaagaattgtctgtgaaagtcgtggaaaaataaaactgtattgtaaaagggaatttatgcaagaaatgtataatttaaaagtaattaggcctcctgaatgtaaaactattaaagaaacagtttatgtgaaaggtgtataaggaaagtaaaatatacttttggtaaaaggattatacggaggcataataatgtggatttttatctacattaaaaggttaaaaaatgttctgttttgaaggtttaagcaagttttaaaatgttaattgtaaaggaaattctgtgtgtaaacatattggctaaagttaaaaaggtatcatccagtttttctgtgaattggacattaaaattaaagcacaacagatttttcttaaagcactaacttgctctttaacaaaaattataaaaggttaaaagcagtctataaaaaatcttaccttatggttagatgttaaaattaaataaatatgtctataagatttttttaaaattgagtttaacattaaaaacacactaatacaaaggtgaaatttagcttatctggtataaaaatcatacaggaagcattgttaaatataaagtggtgtttggctttctttggtctaaaaactaataaaaataggtgctaaaggaaatttctcagtaagaaggcaccaaagactataaagtccactgctgatgtccccatatttaaaacaaaagatcaatttcttagaaattatatacttggtttatcttcccctttcctttccctcaaaactaaaagtctttcagcacaggtaccacccctagaatttccagtaagccagcaccagcttgaagatcattctcatcaaagggtggaaagaaggaaaagttgagccagcctgggaaggaccctaccttttgctgctaaccactgagactgctgttcatacagcataaaggggatggactcatcacatccaagtcaagaaagcgccgccccctccagagtcgtgggccatggtcccaggggaaaaaccctaccaaactaacgctaaaaaaaaatttaactctctttcttctacgctattactctttcttctttcctcactctattgctgaccaactagttattaacataaccaagtcaattttgcctcaaactattgcatttaatgcttgccttgttataccctgtggggacctgccaagtcaaagaccgctctctacttcagaaaagcacctctgtccctcctgactctcctcagactgggcactagtgaattgggaccatttaatccagggagatttcaataaagaccccagtgtcaaccaggagtcttgctccccaatctagagcttttatgccatagttagtccaacgttctgtggaccactaaagaacaacaatggactgccccaaccagtttttgtagtttcctaaaaccatacattcattttactagagggacagccctccccgctaactgtcggctaaaccagtgtaattctatatgggttattatctcaaaccttcaaagttcttccccttttctaagccggttcccttctttaagccagttttatggtatggggactgaggtttcagggacaaaccctgttagattctttgaagtgcatttctttgatcccccaccacctgcaccttcctctaagccttcttccaaaacctcttacaatggaacaattgttcctcctccatctaacaacaagaccaagatagctattgtaaaagttaaagacttaaaacatactttggcaattaagacaggataccaagatgcaaatgcctggttggaatggatcaaatattctgtctgcatgttaaacaaaagcaattgttatgctgtgcgcatagcaggccagaggcccagattgtcccctttccactaaggtggtcctccagttgatggggcatgggctgcatggtagctcttttccaggattctacagcctggagtaataagtcatgccaagatctctctctgctatatcctgaagtccggcaccctgagggccatccagcttccatctcccaccactaagttcactttgtgtctctcatgacagggaggaaagttagtgttccttggagacctgaagggatgcagtgaacttaaggatttaaaagagcttatcaatcagcccttgttcatccccgagcagatgtgtggtggtattgtggtggacctttactggacactctgctgaataactggagcggtacttgtgctttagtccaatcggctatcccattcaccctggaattttatcaaccagaggaaggaaaaaaagacatcgtaaagtgagagaagccccttatgggtctttcgactctcacgtctatttagacacaattggagtcccacagggaataccagatcaatttaaaacccgaaatcaaatagctgcagaatttaagtaaatattttggtaggtgacaataaaaatgtagattggataagctacatctactaagccaagacatgttaaaaagtttgaaaagaaaactgtaaggaaatacaaggggaggggttgttagatatgagtcctcctgcaacataccatctcacaccattcagaatggccattattagtacatgtgctgttgaagaaagcaataacagatgctggtgaggctgtggagaaaagtgaacgcttatacactgttgatggggagtagttcagccactgttgaaagcagtttggatatttctcaaataacttaaaacagaattatcatttgactgagcaatcttattactaagtatgcatccaaaagaaagtaaagtgttctaccaaaaagacacatgtgcttgtatgttcactactgcaataatagcaaagacatggaatcagtctaggtgcccatcaatggtggattggataaagaaaatatggcacatatacaccatggaacactatgcagccacaaaaaggaaattatgtcatttagaacaatatggaggcagctataagacattatcctaagtgagttaatgcagaaagagaaagtcaaatactgcaggttgtcacttacaagtgggagctaaacatggtgtactgatggacataaacatggcaacaataggcagtggggaatactagagtggggagggaggcaaggtttgaaaaactaactgttgggtactatgcttactatatagggaatcattcacatcccaaacctctgcatcacataatatacccaggtatgaagcctgcacacatactgcctgaatctaaaataaaatttgaaattataaaaaaaataaaaaggtaaagaaaactttaaataaatacatagtatgtactcttttctatttctggcttatttcacttggccctatgttttagtgcatatctatcttgtatctgtagtgtattcttttttactcctgtggagtgttatatatgaatatacaaatgttttaatccattcatcagttaatagacattaaggttgtttcctattttgataatataaataaatgtatgtgcaagactttgtgtgagtatagtttcaatccttttgcataaatacctaagaataggattgctagctctattttaagtgtgtatttaaccttatcagaaattgtctgatatggcttggatgtgtgtcccttcatattgacatgtaatacccaatgttgcaggtggagcctagtgggaggtatttgggtcatgggggctgatcccttttgaatggcttcatgccatccttgcagtaatgagtgcgttctcactgtatgagctcacatgatacctggtcccttaacagagcctggaatctcctcctgtctcttccccctgctcttgccatgggacacacttgcttcccctttgccttatgccatgagtggaattttcctgatgcccacaccagaaggcgagcagatgctagtgccattcttcttgtaaagcctctataactgtgagccaaaataaacctcttttctttataaattacccagcctcaagtatttatttatagcaatgcgaatggactaacacagcatcaaactgattttcaaagtagctggaaactttacttttctgtcagcaatatatgagagttccatttgtctgacattcagacagtcttttaaatgttcaagttgatgtgttgtggtattttataatggttttatttaaaatggctgatgaatagtgatgttgagtatgatttaaatgcttctttgccagtaacatactatgttttatgaagaatttgttcaaaactttcactatttgtttttattgggttatctttactttattgaactttaagaactatttatacattatgaatgctagcttttcatctgatatacatgcaagcgcatatggacacgcacacttttcacccagtcgggtttgccttgttatttttccgaacattttttttaatgacccaaagttaagttctcaatgttaataacatctgattgatcaatatttttcttttataatctgtgctttttctatcaaatctaaaaattctttgcatctccaaattctcaaaattattttcatatgttttattttatatttctatagttttagattttatatttaggttcataagatctttttagatgatgttcatgtcatggtgagttattgcaagacatttacttttgtccataaggtatctaattatttcagagtcattttttgaaaacactattttgcttctttggattaccttcacatttttattaaaatgaaacttaccatataaatatgggtctacttctggaccctattcagtttcattgatctatatgtctatccttcaaaaataataagctatctagattattgtaactttataacaagccttgaattcagatagtttttaaattgatacataataatttacatatctataaggtacgtgtaatattttgttacatgtgtagaatgtgtaatgatcaaatcagggtatttggcatatccatcaccttgagtatatatcatttctatgggttgggagcaattcaagtctgcacttctagctactctgaaatttataatacatcgttgttaacatagggaaaacactccaggacattggtctaggcaacaattttatggctaaaacctaatctgctgttgaacattggaacttgggtcttccatcagactatatatttgtactcattaaccagcctttcttcatccgttacatccacccacacacttcccagccactagcatctttctactatctatgtcatgagatcaactattttagcccccacatatgagtgagaacatatgatatttgtctctgtgcctggcttattttacttaatataataacttccagttccatttatgttactgcaaatgacataattttattcttttatctggctgaattgaatttcactgtgtatatataccatatttcctttattatctatccattgatggacactgaggttgattacatggctttgctattgtgaatagtgctgcaataaagatgtgagtccaggtatccttttgacatgctgatttcttttcctttggataaacaccaaatagtgtgattgctgcatcgtatagtagttatatttttagtttcttgagaaatcgccacaatattttccacagcatctgttctaacttacctttccaccaagtgtacaaaacattccttttcttcacattctcaccagcatctgttattttctgtctttttgataacagccattttgactgacttaagaagaaatttcattgtggttttgatttccatttccctaatgatgagggatgttgagcattttttatatacctgttggccatttgtatactttgttttgaaaaatgtcttttcatgtcctttgctcactttttaatgggactatgttttttttgctgttgttcagttccttatatattctagatattagtcccttgtctgctgaatagtatacaaatattttatctcattcaacagattgtctcttcactctgttgattatttcctttgctgcacagaagacttttgtttaacattctcccatgtgtctaattttgttgttgatgatgcctgtgcttttgaggtcttagccataaaatcattgcctagaccaatgtcctggagtgttttccctatgttttcttctagtagttttattttggggtcttgcatttaagtctttcctccaacctgtgttgatttttgtatatagtgagagaatgggtccagtttcattcttctgtatatagatatccagtccttccagcaccatttattgaagagtttgttctttccctaattatgttcttggtaactttgtcaaaaatcacttggctgtaagtacatgtatttatttctggtttttctatgcagttccattagtctatgtgtctgcttttatgccaatatcattctgttttagcccatataaccttgtaatatattttgatgtcagatagtgtgatgtctccagctttgtgctttttgcccagaattgctttggctcttcaggctcccgtttggttctatataaaattttgcattattttttctatttctgtaataaatgatgatcatatattcataaagactgcatgaaatccatatcaaacaaaatattatatgatatttcatagtcgatttctttgggcagtatggtcacttaaacaatattaatttttcttatccatgagaatgtgatgttgttccatttgtctgtatactcttcaatttctttcaacagtgttttgtagttttccttctaggagtctttcaccgccctgattacatttattactagatattttattttttgttgctattagaaatggaattgccttcttcatttgtgttctcatcaagattattatgtgtatagaaatgctactcatactgtatgttgattttgtatcccgcagttttactgaattttaaaatcagatctaaggggtttttaagtggcatctttacatttttctagatacaaaataaatgtcaaaagaaccatttttctatttctgtaataaatcatgctcatatttttatagagattgcatgaaatccatatcaaacaaaatattatataatattttaatatatgataatatttcaaatagccaaatggactatttgacttctttttcaacttggctatcttttacttctttcttttgactgattgctctagatggaacttccagtactatgctaaataggagtggtgaaagtgggcatccttgtcttgttccagttcttggaggaaaagagttcagcttttcccaattcagtatgatgttaactgctgatttgacatacatggtgtttattatgttgagggatgttctttctatgcctagtttgttgagagtttttattatgaagggatgttgaattttaccaaatgcttcttctgcatattttgagatgattgtatgggttttgtcctttgttcttttgatgtgatgtatcaaatttattgatttgcatatgttgaatcattgttgcatctttggaataaattccactttatcatggtgtattatctttttgatgtgatgttggacttgatttgctagtatcttgttgagaatttttgcatctatttttgttagggatactggcctgtagatttctgggttttgttgttgttgttgcacctttggttttaggatcagggtaatgctggcctcatagaattagggagaattccctcctcctcaattttttggaatagtttgagaataattggtattagttctttgaaaatttggtagaatttggcagtgaagccaaatggacctgaaattttctctattgggagagtttttattactgattcaacctcaatattcattattggtctgtacatattttctattttctcctttcaatcttggtagtttgtatttgtccaggaatgtatccattacctctaggttttcattttgttactgtatagttttttcataatagtcttggaagatcttttgtatttttgtagtgtcagttgtactgtttcctttttcctttctgattttacttatttgggtcttctctctttttgcctgattagtctagcaagcatttttgtttatctttaaaaaaaaaacccacttttcattttgttgatcttttgtatcttgtttttagtttctatttcattttgtcctgctctgatgtttattatttctttccttctactaattttgaatttagtttgttcttgcttttctagttcactgaggtacataattaaattgtttatttaaaaatttctactttctaaatgtaggcattcatttttgtaagcttcttttttgcaatgcttttgccgtatcctgaaagttttgatacgttgtgtttgattcttatttgtttcaaaaaattctttgaattcctcatgagtttcttgtatgcaggatgtaattaggtcatttttaaaatctattcagccagtctctatcttctaagtggaaactttaatccatttacattgaaggttattattgatatgtgaaggcttattcctgtcattttatttattgatttctggttgtgttgaatatcctttgttcctttctttctttctttttgtttttcactgtggtagggtggagcttaattgggcagacctgtcctcagggaccctggtggtgcatgtcaagcaaggctggctgtggtagtcaatgggccaggtgataaccaggtctctggtggtatgtcagatggggggccacagtggctgtactgtgaccatgttactggaggaggtgaagtagctttcagtggaagcctccataggcaggaagctagggacacaaactttgctaatgctttagccccagaggctacaacccagcacagcagcagctatgagcagtgaaatttacccttgaggtacacaaaaaaatgccccattatccctttgctgtgggagcagtgctgatgctagtggctcgctctttggtcctggctctgactccaccagcagtaacaaccagcagtggtggaggctgtgggtgcaatagacttttatcatggccactcttctggaagatgtcactgccagcaactcctgactcagctttggcagcagctgccgcatcgaagactgttgtgagtggggaaaggtaatggggctgcaggaatgtgaggatgtagggactttgggacctccaaggcaggatgcagtctagacctccaaggcttggctttcaaaatggcaccttgttgtagctgcttaggactctgggggtgtgttggatccagaataagctcactctctaaagcagtaccttctcacagtctccgggcagtttccagtgatggtcttaggtcctgtaagggtcaaaggaccctcccatggctaggattgaaggagtccctaatgggaatgtgtactactggggatctctcacttattctttttccaaactggatagtctctccaggctcccaggtgaccctagctgagcaggctgcctcacttccctccccttccttgatttaggtgtttcttgtcacttctctgttgaattccagtattccatcttagaagatctattcaaagtgtggttatctacctgctattttgtttcttctttgtggaagaggcaagtacctgatgtgtccagtcagctatctggaagtcagatagtttaagtcttcctattatttttctttttcaaaattgttctggtaatctattatattttaaaatatacatttcagagttagtcagtttccacaaaaaaagaccttatacagattcaatgaaattacattgaatctataaatcaatctgagaaaagtagatatcttaacaatattgagatcataaatctataagcatgatgtgtttattgatttatttagatattctttaatttatctcatctgtattttgtagttttcctcaaacagatcttgtgtttactttcttatatttatctttaagagtttcatgtattttgaggctattacatttggtattttaaattttgcattttctagttgtatattgatagcatatagaaacagttggtaaacaaacttagttcttacagatatctgtggattctttcaggttaactgtgtacatgctcatgtagtctataaataaatattgtttactactttcttatatatatattatttcctttcatgtcatattgcattggccatgaccacaaatacaaagttgaataaagaagtaacaaccatatatttttcctgattttgagagaaatgtatttagtctttattaagtgtgatttaactctaggttttctgttttgttttgttttcttttctttttttgagacagagtctccctctgttgctcaggctggagtgcagtggtataatctcaggtccctacagccttggcctaccaagttcaagtgatcctcctgcctcagccccacgagtagctgggactacaagcatgcaccaccactctggctagtatttttgtactttttgtagagatgagttttgccatgtttcccaggctgatctctaactcctggtctcaattgatccacccacctcagccacccaaagtgctaggattacagatgtgagtcactgtgcctggtcaatgatttaattctaggtttttggtaaatttatttaattaatttgaatagacctacatcactccactaaaatccaacatctccatcatttactaaatttctataagtatatgaacttatttctgtgtcattacaaacttttattaattattactttctatttgtgtactattaacatgttttcattactctgcccttacttcatttatttatttattatttatttatttatttttacacagagtcttgctctgttgcccatgctggagtgcaatggtgcagtctcagctcaccgtaagttccgcccgctgggttcctgtcattctcctgcctcagcctcccaagtagctgggactacaggcacatgctaccacacctggctaatttttcatatttttagtagagatggggtttcactgtgttagccaggatggtcttgatctcctgacctcgtgatctccccacctcggcctcctaaagtgctgggattgcaggcgtgagccaccgcgcccggcctactttacattttaatgactgttttgaatagatattaattatatcccctaccactcccctcaatattctgactattcttattacaagctttgtaattagcttctctggttcttcagagagtgtatagttaattttattgacatgttgggattttgaaaatttatatattaatctacagactattccttattataataatgagtttaaaagtatttgttttatttgttctagtcattttttgtgtcttttaagaatatttcaaagagtttttcataggaagcttgtcaatttgctgttagacttattcttaatgtcttttatctttttaaataactttctctattaataggagtccttctgtgacaccttcctgaagtttctgcttcttaattgccctgcctttactcaattgttgatgttcatcatcaaaccattcagcatgtaagcactgagaggaactccactgaatttcttgaggttcaaaacatagttcagatggcattttcaatgtccaaattcaatgaaaccattgatatgttccttactgtaagcattctcctttgaaaatcaagattcttaaagaagcaatgagcagagttatcaggacaaaagagaaaaatgattcagataattaagtaaccctaaaggagattatttctacttccacccctatattcctgtatatgtgaattgtggccagggtagtggctttatattggtcaatatctcaaagtttatataattcttgcagggcaccacccaactgcacaggatgttgtcctagcccacactgtaactctggtttcagtaagatagtctgaattttgataagacagatacttctagatgtgagacctgtaataacaccaatgatttacataacaggaggatatgggatactgacagcttctaatgcattctgtaagtccagtagagtagtgatggcagcattgcaggatggaaagacctgtaaaatacctgcagagaacaggtgtatattcaacccatgagggaaaatccctcacctcaaaggagaaagaagtacaaagtaaccaatcttccacagggtagctggttgcctttcccctctctttgaacaaagacatattgtgggctcagttttggaatctggtattggcaagttgagctcttggtaatggaagtagccagaggatatttggtaatggaagtagccagaggaaaacaatgtttgaaggggtcaatttctgtgatagagagcagggcaggacaagcataaaaagcagatataaaagcaaccaggcaaatcactggcataggagctttcttgtgataactttcatatgtacttccactttctcccctccaatcttaccgtgttattttagtacttctagtatctccccttacacatttaaatacacatatcctgttctgatttcatcaagtttatattaatatgatgtaatccataattttaaagggtaaagcaatctgcatactaacatcatctctaaataggaaatctagagtttttttggccagttctcttcacaaagggtgatggtgttattgtttttactttttaaaatattttttttttcattttctgttctgaaaccataattgcttggcccttcagttgaataggttgaatgttcatctataccatgccctttttccactgtttctccattaatctctcacttgtctttaattggcacaggagttttcccctgaaaatcctttgaactcttattctaaggatgagatttttttttttttgctaatccatagaaaaatggtcactatttctatttgatttatgaaaactgtttttttaatgaatgttcttaatttgttgtttctattatcccttttctccttcgtaggttcctttttttgtaattcatcttgttaataaagttcttcctcacctagttaatttcagaaaattaatgtcaagtaggataaggcattaattcaggctagcaaggattctttctggttaacataaattccttatgagatggtttatgaaatgactatatttaattcaaattttagattcctttttcagaataaaacaggctactcgctgttcacaaggttatttctgaggtgcaaaattatcttcttctctctgtctatgtttttatacatcctgaattcccccatgcaaccttggctgacacactcagacagaaaaaacgtgcaagggcacttttttcttgcatctgtagtggaaacctaaatgggtttagttttttgttgttgctgttgttttgctttgttttttcaatgtttatttcttcttcagtgtcaaaattcagcaaatatattctggctccttcagaatcttctcttcctcatcaaaatggtgtcactgtgtgtttccttttcagtctcagaaacttgattttcaatgggccaaagatggttctagccaagagcccatgcaaccatttctacttcataaaacaaaaatcagttttgggtttggacctatatggtaccactctatcaactttgggcagctccatgctgctacctttttctaagatttatagtaattatgttttctgtggacaccttctctttccctttttgatattcaccgcattaagaggccctttctcctagctacaataaagtacaaaagaacaagtatcaattttactttgaaattctaatacagtaacaatacaataattaatatgcaataaaatccaattccatttagcttacaaaactttcgtagattaatgtttctgtaaactataccaactttttttttttttactatttcatctggcatgagaaaatcatcatatagttttaatccaacattctctattaacatgagtttctatgatacaaaaagacagagaaaagaaagaaaaattacgttgatcctaccattgtttcttcactagtataattacatttattcatttattatttttccatttattttaaaatgattaaaaacctagtaaactatgtaactacatgaggcttatggctcaataacctgatcatttcccagagtggggaaaaaacatgaaaataaatgcagtttaatatgtgttaaataggtatctatataaagatgcaatgggcataccaagaaggggagaattgaataagagcttttattcctttctcaactagtagataaattatttttaaaatagcactaaaaatcacaattaaaatgtatttgctgacagtctaaagctcattgtcaaagaagaaaaaatggtagagactaagctaatgctactgtaagaagatttaaactctctctgtcactgtgtaagaatctgatgaatggaagattgcaggtaacatggtataaactagggtatcagagattcagaaaaaaatgaggctgtttagatgctcctgaagaatgctgagtgggagtgcaagagatttaaaaattcagtaattttttgtaaatgccatcacatgttgttctttccagcgtaaggaatggtcccaaatgccttgacatttaaccatgtgcacatataattattttcaagcctcatccttttaaatctcatttgagatagaaaatttttccttctttctcctttttcatgcattttcctgcttatcttgatggttttccttcccaccacatacagcagcaatttttgtaaatgattctacattttaaagtcactaacatcacatgtgtaattcaaaggaatgaaaatcctcaaaattcataggaatgaaagtcctcaaagttggcccattcaatcaaattttcattccttgaaataaataagaaaaactagtatttggagtaaatcacgtgatatatgtaaatatatttgaagaatttctcgggtgaattgatagacaaacacaagttttgcgagcataactctaaatacatgagttcttcatctgggaatttccttgaatttggaaactagattatataattagttgcacacctacatccccaaaatgctttgcatacaggaacaataattttgttgactaaattttacaattacagaaataaattagtctgattctatataactgactattttaaatgcacttcaaggtatagacataagagtacagggttttattataattttcaagtaagaaattatttttaagctggtctgacttcataagagtttttttgagaaatatcactttgtcaaacataggtagtctaccaacttcagacttccatacgtcttttccttcactgacaagtttttcaaaggggtagtttataacattcatccacttctcaacttattatagtttgtctttgcctcccacattattcagaagctggtcttaatgactttaaaattgacaagcaaaagacacattgaatcatgatttgagttctgtatatgataggatactgttttcctcatcccactcattacagcttccctactttgacttcagggactctctcctttcctgatttaattccattctttctttacttccatccctggggttagtattttaacagcagtgtttctgagggtgccatcatcaccttcttttactttacccactctcactaagagatgccatccaaccctattattccaaacactacatatgggagattgcattgttttagtcagaatcctcctttttctccatatttattccatagctgcttctgggaaaagtacatttttcagtccctttgacggtaagtttggccatatcatttgttttggttaatggaatatgagcataaagacaatttgctaagtgcacaccgaagcttcaagagacatcctgtacttttgctcacccgtcttgcatcttagccatccaccatgagaacatctcttgggaagcatctagtcacaggataagatggcacatgaaatgtcactgagatcaactatagcctgatgagaagctcaacctagtccagtagagccacatcaaatccacagacctgggagcaagaaatcagtgtctgttgctgcaaaccactgagttttgggatagtttttatgtagcagtttttgaggaaaatacttgatactataccattgttaatgtatttccaaacatccttcagaattttaaacaaaaatatctaactgtcatttgaatttccccaactagatgattcataggtacctcaaattcagtgtgtacaaaaattaacttactttctctccaagtaaggtaatttttccatgttatttcctatttcagtgaagaagaattgcatctgtctattttccaagcagaaaaaaatcaaggtgctatctttttttctttctgcctcttccttggactaattgctgattgattaatcattaattcctttgacagtaacataattttatgaactaatgaatatattttcatggcattttatatatccctataagctgccttactttttcataaaacagggcagaatataaacaaataatcaaaaagaattctgttgattttttctcttcagtagctctaaattatttacccacttctccaaccacactgctactacacttgtttaggcatttatcttttcttgcaaagaatgacacatgccttctaacttcctgcaggttgcttactctccagtatattctccactcttcttccagtgtcctttttaacataaacatttgatctacttgttctcactcataggtgggaattgaacaatgagatcacatggacacaggaaggggaatatcacactctggggactgtggtggggtggggggagggggagggatagcattgggagatatacctaatgctagatgaagagttagtgggtgcagcgcaccagcatggcacatgtatacatatgtaactaacctgcacaatgtgcacatgtaccctaaaacttaaagtataataaaaaaaaagagagaaaaaaagtcctcactgtttagctactttcagaataaatgcaaccaaagaagaaaatataaactcaacttgctattcaaatatattaacacattacagctctatgaaaacagaaaactctggtttttctcatgttttttaaaaagtagtttccttctcatgaaaatgtcttgtgccctctacctctaatccagctacatagtccagctgatccctgctcatctttctcaacccaattcaggtgttatctcatctgaggacccttttgaaattgttgtatgccacttcattcgcagttaatctaagttaactgccccttgggaatttgtgtataagtctatagtgacatatatcacagtttcttacaatattaacttatgcatctgccttctgctttagatgtttcatagaaaataaggaaagcatatttctttatgtagattctcctcggcttacaatgaggttacatcccaataaactcattataggttgaaaatactgtaagataataacacatttaatacacccaacctaccaaatatcacagcttagcttagcctaccttgaacatgctgagaacacttacattagcttacagttgggcaaaatcatctaacacaaagctattttatgatacagtgttgattatctcatgtaatttattgaatactgtcctgaaaatgaaaaacagaatggttatatgcgtacttggagtacagtttctactgaatgcataccagtgtcacatcattgtaaattcaaaacatttttaggtggaaatatggtaaagtgggaactgcgtgtatctagcttccagggcagtagtcttatttgtcattatatctcaagcgcctatgcatatatagtcaaaaatatttgaaacatgaaaaaataaatgaaattttggataaataggtaatgatcaggcttaatttagcactctaagttctcaaataaaacacaaattcatcataaactgaaactttttttcatttgaaatacataaattcaaaaatagccaccctaggaagtcttcttcaacctaccaagacaaaagttgggcattccacactggcttagaactttgtacaaactttaatcatcacaccatattgctattattttgttttcatgtctgacttttccagtacactgtgaaatccctgaaccctgagtgccagttttataaagctgtgacattctaaaattgaatgcagttaaatctcaaagccaaatgctattactgtatacaacaatgatcaatgcttgttgaatcagctaattcattctttgaatagtaatagagctttattatgtgtcgtacaaaaatccccagagctgagaataaggcagaggtacaacagaacaatcacctatacacatttactataaaaacttagagtatgaaattcaaaataagaaaggatggtttactgtactctatagttagaggatgtttgaaaattatctatagaattgcaactttaacaatggcttcaagaaaccgagaataaattgtcctaaaataaaccaacagcccttgatcttctattatcatttgaagttgtgtataattgcacttaagttttatattggtctcaattcaatatggtctataacattaggatatcagcaattttcattgtaaaagaccattactaatccaactgagtttgattattgtattttatcaggttagcaggtcttttcctgagctctgcagcattgctgtttttaatatgtgtctacattttgtgtattggtcttcaaacccctcctatgaaaactatttcccttcgtggaggacctgattttatgaattgtgctttcattttttcacgttgtatagcattgtaatagtaagtaaacttaatgactgcttaaaatgtataaagtactcctggattacattctcattatatactttatattataaattttaagtattttattattttttgaagggcactgaaaatcaataaacaatttacattagtgtcttaattatttatggatttctcattaaaatttcatttcatatgcataaatattattactaatatttaatatgaaaactcttatttggatatataggggtataaataaataacattgttctacaacctgataaaactttattatatctaacacatatataatatcatacatttcacttttttctataattaaaatggcgaaagtatcatgactgccactcagaatgaaaattatgactttgttgctaacagtttgatgcataaagaattctctgagcaccagttgtggcttttgatacaattaggctacctattatgtattcttgtttttacatttgtgaatccaaaaccacttgagggaaaattcacattctcggtctgttttagaaatgaaattattcttaccttgtgtctttcttgaaattatagtcaaaaatgcttaaggaattggaaaaaatgaactcttaggtcattttaaggactcaaaaacaatgtttctaaaagaatccttctccacaccatctttcatagcatcagagtgaggcacactgcaatgactgcatcgccttttatattattgtctcctaatccaagtggcatatatgtcatgtatactgcacaagctgaaatgttattatcatacttaaccacaagttcttcaattgcatatgtctggagtgcactaaactttaatgagcttcattctgcttggccctgaccatctcttcaattaatcatcactatgtaattggctcctactttctaaagtatttaccctacctactttgaaataatctgtgaatttaatgattatagcctttaatctaccattttttcactgaggaaagattgttacattccaaacttgattgttatatgtcactagggttgacactgatacattgttaaatatacttgtcttgaagaaaggcatcatactctgtaatatatcaagatagattagaaatatttttaaaggctgttatttttcaagagacatgaaagttattgaaaggaacttgttctttttaaagacactggttgatatgaaattccttatttcctaagtggtactgaatcctgtaccaaaacttcatgataggcagacttcaaatatcttcttgaaatacataaaaatatctttgcttaaaatattatttattgctcagctttccttttaaagtattctttattcttctgttgactgacttagaacattactaatcagaaaattgctaattaattggtctagcagtcatgagtcttaaaattggaggtggtaattacttcaaaaaattctattcaagttaaaattatgccaataataccaaaactctgggtaagcatggtaagtgcttccattccttctagccagtctggaatgaattagaaagttacagggatggacttttgtataaaattgccactaacattaaaaattcaaaaaaaaaaaaaaaaaaaccccacatgtctgtggcattctggtcccggcttccaaaataaaaaattactcctgaaactctgtaaggattttaaaacatattttggaccaactcattatcaaagagtactacagctagaaaccatcattatgtatcaattaatttaaatcagttaacgtataaaaacctcatgtcccaaatgatggaattccctgcttgaagttggggaagtatggttggtacagagcaggaaccagaatccaaatctaactcctagaatttgtcggcaaaaatggtggggctgaagaacaattggttgagacaaagcaaggatcagaacaaaatcttccaattctcattccagtcattccagtgttctttccagtcatatgatgagacatcatgtagggaaagggagagaatgaaatttagcatgagtgaaaaagatcctatgggaagattttggtaaggttcagttacaaagtcatactctgtaatgtcttccagcattggcaaaaggaaaggagaggagataaaatctctgatgaaaatctgattcctgccttttttgtgtgtttcattttctctttggatacttatgtgatttctcttaatcactgaaattttttaaatttgccaaaacatatccaaatgtgagtctttttgtcttttatattttctacttcaaagagtctgagagtttgaaatgtctggcttttttcaaatagaaaaattttgatacttttttttttttatcattgcttctcctcactctcctgttttgaatattgctgacacttccaaaacttctttctcattttcagaaaaatctatgatgtcatcaactgtgagattcaactcaatttaagagatattcaaatgtaaaacgaataaagcagtagtaattatcatatggtatcgattgttaggcacatgtcactttcagcattgttaatacgtaaaaatattgcttctggaaataagtcaattctgggtttacataaatcaattttatagtcttcttttataatcccaaaccctttataattctaaattccatgaacatatttcaaggtcatcttttaaaatttatttttaaattgacaaataaaaatcaaatatatttaaagtatacaacatcatgtcatgatatatgtatacactgtggaatggctaaatcaagctatttaacatattcattaactcacatatatatcatttttttggtcagggaaaccctctaaatctattctcttaggaatttttaacttattgtcattaactataggcactgtgaggtacaatagatctcttgattttattccttccatctaactgaaattttgtgttctttgactgacatctccctgatcctcccattccccagcatctggtaaccaccattttgctctttgtttctattaattagattgttttagattccacacataactaagacgaagctgtctttctgtgttggggttatttcacgtaatataatgttcttcagattcatcaatgttcttgtaactggcaggatttcctttcctgtttttaaaaggctgaatagtattctgttgtggatatacatcacatttcctttttccatttgtctgtcaatggacacccaggttaattccatagcatggctattgtgaaaaatgctgcaacaaacaagggagtgcagttacctctttaacatactcttgtcatatcctttagatatatactcagtagttggattactggaccatacagtcctttatttttaattttttgaggaacctccaaattgtttttcataagagctgtgctgatttacatttccaccaatagtataagagtttccttttcctcatatcctttccaacatttacattttctctttttggtaatagctatcctgactggtatgaggtaatatctcattgtgattttaatttgcatttctctgatgattaatgattataagcattttttcatatacctgttgtccatttgtatatcttctttagagaaatgtccactcaagtcctttgcccatttttaattgagttgttttcttacgattgagttgtttgagttccttgtatattttagacttaacccattattagatgtgtggtttgcaaatttattctcctgtacatagattgtctctttattctgttgtttcctttgctgtgcagaagctttttatattgatgtaatcccatttgtctatctttgcttttgttgcctgtgcttttgggtttaaatccaaaaaattattgcccaaaccaatgtcatggagcttttcctctatgttttcttacagtagtctcacaggttcaggtcttaatatctaagctttacattttgagtttatttttgtatatagttatgagatggaagtctaattttattcttttcacgtacagttttcccagcaccatttattgaagagactgtcctttccccattgtgtgtttgcagcatctttgtcagaaatcaactgactatgaatgaatgaattactttttgggccttctattctagtccattggcctctacttctgttttatgccaacaccatgctgttttgatttcaaagttatcttctaaataatcaaatttaatacaatagttaatctactatcactatagactagattttatatgatatgtatttttaaatttagtaatcattgttttcatttccccaaaatctggttttcttagtatttggaacattctgatcttattttacattatttaaatactactctcattatttaatagaatatttgtaagccttcttgtttaaagttatttgatttgagtcctctaatgaccacactattgagtttcagggtaaattcctatccattgtaactcatttaatagtggtaatctctgggtctgtcagtagttgttttcacatgtcaattttgtcagtctcaaaaaaatagagaataaaatatgaaagcaacacaaacagtaaaaacaaaatataaatataaaaagattcaaacttattttcttttgatgttttgagatttcaagatctagtgtgaatgccatagtagatagataggggtttaggcaaagaaatacaggtgcaatttcagagaaatttatttttgtgagtcaaaagccaatgttgcaatgtgtcttagttattttcagcaattttcacagtctcctggatacctctgtgcaaagtctatatgacctctatgggattctttactttgaaggttctagaacttagctaaaaccctgccattcatctccgcaaacccctgccactgctccaaagtccatccttttattcacagttcactctgaattaggagatgttatagggattctagagaaattgagatgggaaaaattgaggaatttgtttacccattctgctggggctccctttcatagtatgtattctctcatctgtaacatttattgacaataagcttggaagtgtcatgtaaatgaatggaatacctctctatttattggtgttatagaacggcttcacccttagtaaatgcattcatacttttagtgggaaataaagagacttttaaaatatttatggtttcaggatatcatctcattctgtgtattcaaattccaggctatattttctaaactgaaaatgtaccatacaatttttggtataaaattcttccatgccacccaacataaagagaaaactccttgataacatggtttctatcttttcaaagtcatctctcagaatacaacaaatgctcactaaactctatttttgtatttttttatttttattttaattttattttatattttcgagaccgagtctcactctgtcacccaggctggagtgcagtggcacaatcttggctcactgcaacttccatctcctgggctcaagcaattctcctgcctcagcctcccaagtagctgggactacagtcgtgcaccaccacacctggctaatttttgtatttttagtagagaggaggtttcacgatgttggccaggctggtctcgaactcctgacctcaagtgatccagcttcctcggcctcccaaagtgctgagattaaaggcatgagccactgctccaggcttaaactctacttttaacagttcatcatagttgaacctactgtgatgaactagatctactatgatctttcatactcctgtatttggcttattcagcctgaaatatatttctccattttttttgcctaagaagtatatttctgttcatctttctagactcagctcaaatataatttactctgtgacgtctcttctggcccttctaccagatttggactcccatacgcctttttttataaaactcctttaatagtcctctaatatttttgtatgtgtatttgttccatatgtttcaattttcaccctgcataaaacgtcatatggtggtcaaacaggggggtcagaaatcctaatatttcctctatcctaatgtttccagcctattttatgaactacatagaaccctagaagtattctatgagttctgcttatggcactcctcagagctctatttttatcattatacaattaactaatacaaatactggatgctaaaaacaaaaggtgcacattttaaataacaataaacaaataaataaaacattttgaatgcaggtcttatccaaaacagtgttttccaacttgagagttatcatcaaaatatttatttgacaacctcatttcacctcttctagagtcttcttctcatttctgtgtacatccttttcccaaattccaaatcaattacttggagctcttagttcattatttagttactttattactgttattcctaactctactatgtgcctcacaccttctaagtattttatatgcattaatctatttaattggatgaaaacaatatttaaatgttggtgctactattattcacactataaaaataaggaaacagaggacaaaaggggagatattttgtccttataagtctttccagattccctcaaatcatattattataatattactctagtatttgccattattaattacagtaaaatattgtcaatgttttattattatataattctagaatttgttctaatgttgccttatattacacagtgctttatcacttagcaaacacttttacacacttgcttatctaattctcacaatgacatggtaatacaaggaacatcatatccacgtgaaggatgaaggatgaataaactgaggcctggagaggttaagacagagcaaatttgcaaatttgtatcaaagccctttttttttttttttttttgaggtggagtctcgctctgtcactcaagctggagtgcagtggcctgatctcggctcactgcaatctctgcttcttgggttcaagtgattctcctcagcctccccagtagctgggactacaggtgcctgccaaaatacctggctaatttttgtatttttagtagagatggagtttcactatgttggccaggcttgtcccaaactcctgatctcaggtaatccacctgcctcggcctcccaaagtgctggaattacaggcgtgagccaccttgcctaacccaaagtctttattttaggccagaacaccatcttatgtttaaatttggcactacagtaagctagataatggctcccaattattactactctcttgtacctggaaaagtaaatgttaccttatttggaaaaggggactttgcagttatgattaaattaaagatcctgagataaggagattatccttgatttacctggtatgttctaacaactattgcatatatccttataagagggagacagagatttttatatacacaaatgaaaaggtgatgtgaagataaagaggcagacatttaaatattgtggctttgaggattggagttatacacacccacgagccaaaaactgctggcagccccagaagctgaaagaagcaaggaacaaattatcctatagagccttcagagggagtgtggtccaaccaacattttgatttcaaccaatgaaatagattcaaacatcagatctccagaagtataataaaataaatttatgttatttacagcctctaaatgtgtgataattttttacagtgccataagaaactaatacaggcatttactgaaattaatacagatctaaactgattagcctcatgatgctaatttaatcagcagagttttatcttagtttgggctaaagtcaaaaggttaaaataaatataacaaactaaaatttctatgaatttaaaataaatctcttattttttgatttcacaagaaacaacattaacaacaggcaacttgttgctattattctgacccaatttccggctgcaccaatattcacccagtcataatgtacatgagatgcatatataattggcacctctcttttacagtgtcttgctggccttttttttttttagctttctccttctctatatgatttctatgtcattccaccattcacctcgcttgtaatttagtcctcaagcttcctaagacaattacctatacttccaaacttgcatactatgtgattcccatcttttccatacttttatatcacatgatactttaaatacttccattcccattgccttatttcttgtttgctggaatttgtatggggtcttagattttacagtttactttctttgctgagttttacttatcaaggtttcatagctattgctatgaactctttcaaatagcttatcattataaaaaattcctacatcatatttccaacagagttgtacagcataatttttctaatacagtttacatttctgaaaatgtgagagagatgcagtgcttttatttgtaacaatcatcactctgctgatggaccacattctgtgagtttgtaccagcatacttttatctaaattgagctgacacagcttctgaagtaatttttgaaggaccttaatttctcacaactctctttttacatcctttgcattcaattacttcctaagttaaagcaaggaaacatcagagtggaatctgtattagtaggaccaaatcatactctttataatgcaatgtctgggcctggccattgggatctgttggcagtagtataacagtcaagctaatgatttagtgttccagttcacttcagtttaggggattgatagctaagcagcaggaaatcatatttcagagctctctgcatatctgcaaattcaggagtggttcctgtaaagcacctgcctacattttagtcatatattcgtttatttatatcctgactagttttaaaaagaatttaagacagcttgtagatataaaatacatcaatagaggatgaaacctaaaaaaaaaagaaaaaacagattgatcattaagtcaggcacattatgggtgcaccacaagtttggcactaagatgtctaagcaggtcaaatggaagataatcgtagctcagttcagtgagctcagctgtttttcatctgaaaactagaaagaaatctctcccaaaggtcttcaagaaaaaagattctgtataagaaatggacaagtgccttacatgagacaccaaaaacttctagagggccatttactgagtttgtaaatatgtccttgatatcaaaataaagtatcaaccgataaaatgctattccaagagaagttgaaaatttggttggtataattcagctataccaccaagaatattacagttcaaacaacatatctgactcttcaccaaccctttgcctatgtttttcctgctgtttttgttagttgcaggtaattttttattatataactacctatagatattatatatgaagggtgtgtgttgatatctacacacccttcaaagcctagtccaagtattccctttaggcatgttacattgtgtataagagcattgaatatgtagtcagaaagagcttggttgactctttcatgtgaaagctatgtaagcaagttactttaccaagccttggcttccataattgtaaaataagactaaaactctatatcataaaattgtcaatagctttaaatttgataatgcaacataataaatattcaataatgatactttaacttttgttagagccttttgttagagaaattctgccaccagctatgaagaagtaaactaccacgcttgttgtaagagagtcacttgactaggacttggggttgatctttaggaactgagggcaaccagtagccagcaagaaaactgaaacctcagtgctacaactacaaagaattctgccagcaaacaggaagattagaagaggacctcaagtctcagataagattttagtcatgcacaacaccttattttcagtctggtaaggagagaaccctcctaatcagtgcccaggtttctgacacatggaaactatgacataataaatttgttttaagctgctaaatttgtagtaatttattgttatacagcagtagaaaactaatacagacatattagttaacctttatgaccttaagttatctcattgtataatagagataatggcattcatcatacagaagtgttgtgagtgtcgattataattattaattcatacatatttgtaaatagtacatactataaaatctgagatggcattgtcacttttacaactctatgatgcttaggaatttcctttgtactctggtaatttcttcatggctcttatctcccctacaatatattgtgagctagtgaaagggagagcttctaccttgggtctctttggagccgaataaagaattcttataaaattagtgataatgatagaaatcagaatatcggttacctctataggtgaaggaagatacagactgggaaggggtaccaaaaaaacttataaagtttggaaacattctgagtaatataaaaattttcaagctgtgtacttagtatattttatagattttctgtatttaacttatactttaatttttgtaaatgctgttcaggtaacagattgatggtaatcacagtattattttaatggaaaatacaatttctattatgcttgatttgcaataaactcaagcacatttgacagaaaatgaaatgggtatgtaccaagttttccagagtgaaagtgacagtagcagttgcagtatactttcaaaaatagcaagataactcattttaaaatgacatgataacatgagactcctgggagagggtttcaggacttaagcttttcaggtgacacttttcaggtaaatggcttcagaatagacctttctaaaacaaagaaaaatttttttaaaaagtaaaaccaaaattataaaagcaattcatttggtcctatttcatgacctacatattcctatatttaaagcattcaaattttaccagcatttaaaaaaaatgaaaccacatatttaaatggtcttcatgaattgtttaattctgataagaaaaatgaaagacatgatattcttggaacatcagagcaaatggtaaaaatagcaaacgggcatgtgcttacaagactctctcttgaaaccacattgaactctcattggcagtgtcagcaggttaattaagaaatctcttaggcatggcacatgttcaatacagattgacattacctgggacatggcaaatgcttgttcatcaatactcacccaactgattgacctgagttaaaattagaaaagtgccacttacttcaaggattaaatgcctgcaaaatcatcgcatggaagaatgagagacaaccatttgaggaatacaggaagataaatagcattcagtgtcagactgttgaaatggtctgttcacttcagtaagtctaaaggatgttttagaaagcagcagagtagacattttcatgacttcagtctcaggaaataaggaaagcccttcttttatctctaactttcagacttattctcagagcttcaagggatttaagacatcaccaaatccaaactcctctatttgtagggggaaaaaaaaaacagcacagagatattaaactgcaggaagaagagaggattaataagagacttgtattatagtgtattatattaaaatgaaaataatggttgtattaaggaaaatataccagcatgttaattaattttcagaattataaaataatactgttttatggaaaatcttattaaaatttttgaaaaactattttcagttcccctttgaggtaataaaatatgtctggtcactgataaatctctgattgaataaaatacagaagacaaagagtaaatgcattgtcactgtataatttgtgaccaaaagagagacagcagcaaaaaacgtaagtagagtctgagcaggtttatccatacatttaactgctcttgtcctattctctggctccctgaaaacagacattacttcttgtgccaataagaaagtcactgtacataaatgaagttagtgatagcagcagactgagaatctgcaattaagaagtcacctttggaaaggcctggagagaaatttaagtgttcatgctgcaaagtactagatcatgaaaggaaaaaaatcagatataatataaaaggcattaaactgatcctaagtgattggtcactcgttactgctgcatatatctattgtttcttcctctaggttggacatagtcaatgtcaacatcttgattgttcacaaatctacgaggcctgcataaatccacctgttggcatggttaccagaaggtgatttaatctgcgtgccactgattttaataagcaagttaactaaatagattggctgaaaattggaacaatttagccacttactacttagattgctctctctactgcttggataggccaaggagtgtcaagttttcccagagggtagttggcacagaagcagatgtcaccataagtgactttcctgacaccatggcacaagctagtagaaaagctaggatccaagcaaggtcttgggatcccttacccagggctctttctaccctgtcagttatttactcactctgtcaaattcactgccacagtgtataatttcagaatatacgtatctaacagtataaatatatgccagaggcagatcaagtataaccatttgttttttccagagcccagctcccgctctatttcataacagctcggtctaagcaacattgtcttttattttccatcacaccaccaattcccagttagagactaatttacatgaggatgcaattcccttattttcaatattaccccaaatctcagaatcctgaagaaaagtctctagttgctaccatccagtctgatacaagcatctgcattcgatgtcccaaaccttattgcccttgacttgtctgcaatttgcctgccctgtgtcatgttaccacccgagacatgctccttgataaacagtagctaataaataatctcaagcaattgtgttctcatgattttgccttactgagagccagaaaaaccaaggcagtctagctcaagctttttattatataaataaggaaattttagcccaagaattttactcttcatctaacatcctgaaaacagtagaattaagaactacaacttaagattctggacacctaacagaatgggtattttttctacctcaaatcatgtcaattaagctgtcattatgaagaactggcctaaaacacacaaatcattctgacatgatgtcagctaatatgattctttgaatcttcaagtggaaataaaattaatccacaggagtatagcacattaatgtgtaaattatgcactgttgtgaagtgtgtaatgtaataaagaactaaaacaatgttttactttctaagcactgcacatatttcaaaaaaagaatatttgatttcacacaaaattgaaaaccatttcaatttgccacaaaattgaactataatgtcgagagtgtacttgggaaaactagaatgttcacataataagttaaatctgggttatttctttgcaaaccctttttcagaaaaattattttctagctaaagaggaaataattgttttgacaagttccaccagattcattgacagataaaatttctttggtctttgttttggtctttgataaacatttaataattattgggaaagtgtttaatttcttcattaaaagtggttatctaagaaattagtagacagtgaaataacaagataaaactgtgttataaaaatagtgaagaaaatttctggatgaatgtaaaagttattgacttaatacaacattatggcaaactcatcatcttttttttcttaatctgataagctactgctattcttatttgtcacttgtaatgttattaactttgtcccagtcattcactaaaaaatttagtcttattcaagttttctgtttgctgaccatctcctatccaaagagcaaccagttcctattgcgtctacattttcaatgttttataaatgcacattgtactttcccttccctttatcacagtctcagtgcaagtataacttgtatttgcttccctctagactaagtcagtaggaatcatccggtacctggctggaagagtgatgttctgtgaacgaagtctagtctttgtcattgttctttccttaaaaaatatttatcactcccccgtgatactagggtatggctcaagttccttactattgcatttaagagtttctatgatctgagctaaagctttctttctgtccttgatggtatctcattgaggtctccatgctctaaagtaatgatatctaatgatggaaatgtttgtatctactctagccaatatggcggctactagctccgtatgtctcctgagcactcagtagacatactgagcatatgtggctgatgtaactgaggaactgaaatctggatttaatataaattgtatagaaatatgtagctagtggctactatattggatagttcagctctgaagtagtggttctcaaacgttagagtgcattagaatgacataaagggcttgtgaaaacacggattgctagactccattccagattctttgagcttaacagataaaacccatgaatttgaatttctaaaaaagttctcaaattgcgctgctggttggtctggaatgcaaattgaagaatcactttcctagacaagtttaaatccttgttgtctcttgaacaaatccaatacatggatttatatctgcataggtttctgtctgtaaagctacattattccttgctttaaatttacttacatgcctgcttcataaaataataaattacttgaaaacaaagattatgtccttgtcatatttgcaagacctaaaatgtcttatacagtcatattaacataaacatagaaaggggattttttgattgaaatataaaccagttggttttcaaaatactaaacagtaaaactgatttttttcattctaaatttaaattgtaattaagtaaagaaatcagttataaaaccatataaaacactctaaagttaactttaaaatttggattacataaatttgaggagacatttatttccattaagacacctatataataatacttcaattgcataagtaattatacttctgaagtaaaaatgtcaaatatcacagagatattagaaaaaggagttaatttcaaaaagtatgaaaagctgttaaaaaataaggcaaatctacctctctcaatggatatttcaaacatatgagaaatactttttagcaattttcaactttgtctacataactcagttctttaaaaaagtaaaactagctcacattttctgttgaaatgagactcaataccaaagagagcgaggtatcattaaaatgaagctcaaggtgatacaaacatcaggagaagaaatgtttccaagatctcgcagcagtgtgcctagttaagaccagacaattagttccttgctgtgataagccaccttcaaacctgcaattcgaaagaagccacctatagagaagtaacttctacttctttttaaattatagtaagtcaccaaattatttttcttcaagccatcaaagaagtttgctcagaacatttttcaaacaaattcactctacagtattagaaactcaaaaatgagtgactgtttcattaaccgaatcacagttttcccattttcacactaatagaggccattacatagacactaaggaatgtggttaatgaataaacactcaaaatcatagcacagggaagagccttgatggcatcatctggcctaaactgaacattatctgttgctaggtaaccaaagataataaaaaggtgtctgaagcaggccagcaaatgaaaaccagcctcagccaatctttaatgtcagtcctgctgccaccagtaccattaagtttgtaggaggtccaaaatcaaaatgcagcagcaaacttgaagaggcgaagtttctcttaccccatgatctaatgtccacctttctataccaataaaaggtgaggctgacaataaattctctaagaaaaaaaaaatccatgctccttgaactctgagaaagtaatttctaatattttatgacagccattctaatgttcattcagcaaatatctaaaagctttaaataaattcggtaagtgttctaggcagatggcttgttttgattgatagtatttttgttttgttttgctttctgttgtttttgttactttgatttttgttaatgtaatttattttcccttttttcacaccataatcccagcactttgggaggccaatacaggatgattgtttggacccaggagttcaggaccagcctgggtgaccagcccatctctacaaataataataataaattagctgggtatggtgctgtgcaggtatggtaccagctactcaggagtctgaggtgaaaggatggcttgaccccaggaggtggaggctgcagtgagccatgatcatgccactgcactccagcctgggtgacagagcgagaccctgtcttaaaataaaataaaataaaataaaatctctttaggaataaaatatctacctgagcaaatcaacaacctaaacgggttgctaattttaatgttgaagtttctgggatcttaaatatgtgtgacatggaagccttatgagccatttcttccacttgttcactcctttaatcaattggtacttcattagaggctatataggaattcaaatggtagaaaatgttaagtaccttgctttactatctcagagctatttccagtcctccatggctccctgggtaaaaaccaggagttctgttaattctagtttttacttcctttctacttatattctactgcctgtagcgtccatagcataagcctcttgcagaattgctaatagaaagacccacacatacttccgattgccagttcaatttgctcaggcagagtcttctcatcaccaagaaacatcaggttttatagtgggcagcattggtgggaggcaattcagtatttcaggaatagggatgtataacatttttcatgctcatcaaagaagtaataagttaaaaattcagaaacagttctatcaatattaaacatttgtgtgtctaccttagctggtttggcaattacttttctttctgtttgcaatctccttccctatcttctcatgattaatgtctgtatgtcttttaagaccaaacttaggtaacgttttctgcaaaagcctacctatgaacattagactggatttatgtgaccagtctctcacttagattgtaaagtccttcaatagagattgctcattattcctcttgggatcataggtatctaggaatattctcatcacataagagatgttcaaataatgtcagatgaactgcaatgaactggactttcaatctaagtaggtgatcctacctcttatcttactgagaagcatgaaaaagaaaaatgtcccccctgcttcaatgatacatatctgttgcatcacactcttttgcaaagccttgttctatagcctatacttattctatccttttcttctctccgagagaaacaagtctgtcctcttttccaaaaataatacctatgctccttgggaactcgttctataaatgaattgcatagcttttttctaaaaaagcctcactcttctcctgacccatttcattggcctacaaacacattcagtttacttagcctaaaatcttcttgagagaccttattatgcccttaaattataattctcttttttcatttcactcacacatttttccaaataaatctcctgatcagtaaacaatcaaaattatttgtcagtaaatgaggatagaaagacgggacatacagagaagctgatttgtaactataaaagaataggtgtgctggtagaaggcaataaaatattctatttatataaagactagcatggcactaaagctccactttctcatcaaaccatcactcattgaatatttgatttgttgcaactcagtaggcactaactctatatgagaatttaccaaaaatacccaaattctgactttttgtgggaatcttaatttcatgttagaaatcttaattttgaagacatatggtatatgtaaacttcctctgaaaatacttttctgctatgttaaaaagttttgataattttaatttgttgttgttattgtttggtttggtttgatttgctttagtttggtttgttgtgtggagttcactttatgttaaaataggcatgatttaattgaagggttagtgaagatggatggtgaatggtagggatggagaaggggaagaagattcaaactttctctatacaaacaatattgagacatatctgtcactaggaaatgcttattgctacaggagcagttaccaaacaaataaattcttgtgtcatcaagcaattaaattcaagttgaaagaaattacatttatatttgacattttaactctctctttgtgaactgagagattacttaaattacctcctaagacctcactgtgttagattattcaatccaaacttatgtatggcaacctgtgtcctcacctttggttaacatcttaccacacggactaatagtcttggtcatgtgacttgctttggctaatagaatataacaaacaaatataatgcagagatattttaaaatgctctaccttggttgttgtgttcttgctgttcttggaatgaatttccatgtgaacaagacttggctagcctaaaggagtgagcagttgagttaaagctttagatcaatcagctcccacatgattataaatatatgaaggcacccaggcaaaaccagaactcttcagctaagtgcagcccaaatcactagccaataactgagtactttcgtctgaaatttttatcttataataattgtcactttggggtaatcacagcattctgtctgagacaaattaattgtgctaatgcactggtagtaaacacaatgtttagtagtaatatattagctgtgcatacttaaagcaatgaaggattaaatttcataaagtgcaagtacttataatatattgatttatcctggaagttcttcaataacattgaatttataaataagacaaattctagaatacaaatatgatcctctatagtaaccattctttatttttaagtgtggatatcatatattccattacctctaccctgttgcataaatatttaatatataaaaatacagcattatttaatttgccatatttttctcattgtcagcttttaaatgcatactgtttaaatgcctaatattcttgactatttgaggctgcatgcaatatttgtagtaagtaaatgcaaactaatggttgacaaaaatcacaatttcttaatccagataatctttggatatgcataaaacaatgaaaacctagaattatttatgggctataaagtactgtaagctacaacatactgtaaagattcttacagtactttataaatcccatctgccttaaagaacatctatttaatattcaggtttcttcatctggtagtttactgtatatattacatatttattcatttataaaatataatatttatctaaaatagagttcatgtctaaagattttagtttacacaatgactacaaagctgcatgaactaggacatgtatttgccctaaatttaaagttctacatactgtcaagctctacctggctaagtcattattgttcttctgccaaaaacaaaggtgagatatgccaacataaatgcgaagatactgcaacatattcagttagtatcatctcttgaacagcaaataatttttgcaaaaaaaaaaaaaaacccagaaacttttacgaagctggcataagggttgttaaaatactatttatatatacagaaggcagatttcatcagatcttcaagttattaaaacatcttcatgcagaataatttgatcttgtttgtttttattatgtttgtgttaatgtgttttatgttttctctgctcttcagacggttgtgtgagatgaagttgtgacaactggataggcatggagctgagtgccaaaagacaaaataaaacaaatagagccaagacaagaagcgcagatgaattccaggagttggaatatggccaagaatcaaaatgtatgttagtattagggtttatataatcagcaattagggtttatataatcagcaatgtatgttagtattagggtttatataatcagcaatatcatgggaaacaatgagccacagtcaaataacatcctagaatcaattacaaagaaaaaaaagaactttgagggtttttgaaatttttgctgagtgactaataggttctgaatagtatgttcatacttagcctagattatgtcatttaatccttaccacactcttgtgaggtaggtattgttgttttcactttatcaatgaggaaagaggcacagataaattatgtgacttgcctaaagatcactaactttaaatggttgaaacatgataaaatcccggtcatgtaagagttgaaagcctgtcctttaaatttggtgttgtggtgagacaagaggagcctaattgctgagctaaacttttgcctctgccccagaattattttattagcattcccgatatgttaatgtgtttttgcatttttataaaggaatacctgagactgggtaatttgtaaagaaagatattttattggctcatgattccgcaggtacaagcatggcattggcatttgctcagcttctggtgaggcctcagggagcttatactcatggcaaaaagtgaagcaggagcaggcatatcatatggcaaaacaaaaagcaagagagcaagaaagagaggagggaggttctaaactctttaacaataagaacttgctgcaactcccatggggaaggcaccaaaccattcatgagaaatccgtccccatgacccaaacatctcccgttaggcccacctcaaatattgagtgtcacatttcacaatgagatttgaaggggacaaacatccaaaccatatcacccagtctcactagcactttattaatgactcagtctttaaaatggccactgccactatccctggcactggtttgtaaattaaaaatagagtggtggcttctctgtctaatgtaactctctagtaagcttgaattattttaatctatctatctatctatctatctatctatctatctatctatctatctatctatcatctatctatccatccatctatctatctatccatctatcatccatctatctgccaacacaaaaagaacaaatcatgaaataaatgtttatttatttgcaatgctttggctaacaccacccctcagagtgtagtgaccagcagtccaggaataccttggtcgtcccagcgcagtggactccaaaccttggggagccagagaacaaagttggggctggatacaagtttcccattgctaaagctttcagtccaggagttgggaactgagcactggccccctaaaatccagaaatgaagccagtctactgaatctaccttagaccacaatcaaaccctcaaggtcatcaaataggataaaagaaaaaaaatccaaagtatagaaacctcaaagattgaagaaacatcagcccacatagctgggaaagaaccagcacaagaactctgaaaactcaaaagccagagtgtcttcttttctccaaacaaccacaccacctctccagcaagggttcaaaaatgggctgagatagctaaagtgccagaaacagaatttagaatatgaatagaaataaagaccactgagttgaaggagtacattgaaactcaatgcaagaaagctaagaatcacaataaaacaatacaggagcttatagacaaaatagccagtatagaaaaaaaattgtaacttacctgatataggtgaaaaaacacactacaagaatttcataaggaaatcacaagtagtaatagcagaatagacgaagcagaggaaagaatctcaaagctggaacactgggtttcagaaataagacagacaagaataacaaaaaaagaatgaaaaggaatgaacaaaacctcgaagaaataggagattatataaagtgaccaaatctatgactcattggtgtccttgaaaaacacaaagagggtataagcaacttggaaaacatatttcacaatattatccatgagaccttccccagcctagctagagaggccaacattcaaattcagaaaatgcggagaaccccagtaagttacttcacaaaaagaacatccacaagagaaataattttcagattctccaaggtctaaacgaaagaaaaatgttaaatgaagctggaagaagaatcaagtcacctacaaaggaaaacccatcagactaacagccaacttctcggcagaaatcctacaagctagaagagattcagagccaatattcaacattcttaaagaaaagaaattccaacccagaatttcatatctggccaaactaaacttcaaaaatgaaggagaaataagactcttttaagccaagcaaatgctgagggaatttgttaccaccagacctgccttacaagcacttataaagaaagcaccaatatggaaagaaaagaccattaacagcactacaaaaacactcttgttgttgttgatgttgttgttgtttttgttttattacactttaggttctaggatacatgtgcagaacatgcagttttgttacataggtatacacgtgccatggtggtttgctgcacccatcaactcgtcatctacattaggtatttctcctaatgctatccctttcctaaacccctagcctccgacagatcctggtgtgtgatgttcccctccctgtgtccatgtgtactcattgttcaactgccgtttatgagtgagaacaagcggtgtttggatttctgttcctgtgttagtttgctgagaattatggtttccagcttcactgatgtacctgcaaagcatatgaactcattttttcttatggctgcatagtattccatgttgtatatgtgccacattttctttaaccagtctatcactgatgggcatttgagttggttccaagtctttgctattgtgctgcaataaacatacatgtacatgagtctttatagtagcatgatttataatcctttaggtatatacccagtaatgggattgctgggtcaaatgataattctagttccagatccttgaggaattgccacactgtcttccacaatggttgaactaatttacattcccaccaacagtgtaaaagtgttcctaattctccacatcctctccagtatctgttgtttcctgactttttaataatctccattctaactggcttgagatggtgtcttactgtagttttcatttgtgtttctctaatgacccgtgactatgagcttttttacatatgtttgttggtcgcatcgatgtcttctttggaaaagtatctgttcatatccttcacccactttttgatggggacgtttattttttttcttgtaaatgtgtttaagttccttgtagattctggatattagccctttgtcagatggatagattgcaaaaattttctcccattctgtaggttgcctattcactctgatgacagtttatattgctgtgcagaagttccttagtttaaatagatcccatttatcaattttggcttttgttgccattgcttttggtgttttagtcatgaagtctttgccatgcctctgtcctgaatggtattgcccaggttttcttttagggtttttatggttttaggtcttacatttaagtctttgatccatcttgagtttatttttgtataagatgtaaggaaggggtccagtttcagttttctgtatgtggctagccagttttctcaacaccatttattaaatagggaatcctttccccattgcttgtttttgtcaggtttgtcaaaaatcagatggttgtagatgtgtggtgttatttctgaggcctctgttctgttccattggtctatatgtctgttttggtaccagtacaatgctgttttggttactgcagccttgtagtatagtttgaagtcaggtagcatgatgcctccagctttattccttttgcttaggattgtcttggctgtacaggctcttttttggttccatatgaaatttaaagtagctttttccaattccatgaagaaagtcaatggtagcttgatggggatagcattgaatctataaattattttgggcaatatggccattttcacaatactctttcttcctatccatgagcatggaatatttttctatttttttgtgtcctctattatttccttgagcagtggtttgtaattctccttgaagaggtccttcacatcccttgtaagttggattcctaggtattttattctctttgtagtaattgtgaatgggagttcacccatgatttggctctctgtttgttgattattggtgtataggaatgcttgtgattttttgcacattgattttgtatcctgagactttgctgaagttgcttatcagcttaatgagattttgggctgagacgatggggttttctaaatatacaatcatggcatctgcaaacagacacaatttgacttcctctttgaataccctttatttctttctcttgcctgattgccctggccagaacttgcaatactatgttgaataggagtggtgagagagggcaaccttgtcttgggctggttttcaaagggaatgcttccagcttttgcccattcagtatgatattggctgtgggtttgtcataaatagctcttattattttcagatatgttccatcaatgcctagtttattgagtttttagcaggaagggttgttgaattttgttgaaggccttttctgcatctattgagataatcatgtgttttttgtcattggttctgtttatgtgatggattacgtttattgatgtgcatgtgttgaaacaggcttgcatcccaggggtgaaggtgacttgatagtggtggataagctttttgatgtgctgctgaattcagttttccagtattttattgaggattttgcactgatgttcatcagggatattggcctgaaattttcttttttgttgtgtctctgccaggttttggtatcaggatgatgctggcctcataaaatgagttagggaggagaccctctttttctactgtttggaatacttttagaaggaatggtaccagctcctctttgtacctctggtagaattcagctgtgactctgcctggtcctggactttttttggttggtaggttattcattactgcctcaattttagaacttgttattggtcattcagggatttgacttcttcttgatttagtcttgggagggtgtatgtgtccaggaatttatcagtttcttctaggttttctagtttatttgcatagaggtgtttatagtattttctgatagttgttcgtatttctgtgggataaggggtgatatcccctttatcattttttattgtgtctatttgattcttctctctcttctttattagtctggctagtggcctattttgttaatattttcaaaaaaccagctcctggattcattgaattttttgaagggtttctcgtgtctctatctctttcagttctcctctgatgttagttatttcttgtcttttgctagcttttgaatttgtttgttcttgcttctttagttcttttaattgtgatgttagggtctcaattttagatctttcccactttctcctgtgggtatttagtgctataaatatccctctaaacactgcttaagctgtgtcccatagattctggtatgttgtatctttgttctcatcggtttcaaagaacttatttatttgtgccttaatttcattatttacccagtagtcattcaggagcaggttgttcagtttccatgtagttgtgcagttttgagtgaaattcttaatcctgaattctaatttgattgcactgtggtacaacagactgttttttatgattcccattcttttgcatttgctgaggagtgttttacttccaattatgtagtcaactttataataagtgtgatatgatgctgagaagaatgtatattctgttgatttggggtggggagttctgtagatgtctattaggtctacttgatccagagctgagttcaagtcctgaatacccttgttaattttctttcttgttgatttgtctaatattgacagtggggtgttacaatctcccacttttattgtgtgggagtccaagtctgtttgtaggtccctaagaacttgctttatgaatctgggtgctcctgtattgggtgcatatatatttaggatagttagctcttcttgctgcactgatccctttactattatgtaatgcccttctttgtctcttttgatctttgttggtttaaactctgttttattagagactaggattgcaacccctgctttttttgctttccttttgcttggtaaatattcctccatccctttattttgagcctatgtgtgtctttgtacatgagatgggtctcctgaatatagcccactgatgggtcttgactctttatccaatttgccagtctgtatcttttaattgggaatatttagcccatttacatttaaggttaatattgttatgtatgaatttgatcctgtcattacgatgctagctggttattttgcccaatagttgatgcagtttcttcagagttttgaaggtctttacaatttggtatgtttttgcagtggctggtaccagttttttctttccatatttagtgcttccttcaggacctcttgtaggacaggcctggtggtgacaaaatctctcagcatttgcttgtctgtaaaggattttatttctccctcatttatgaagcttagtctggctggatatgaaattctgggttgaaaattctttcccttaagaatgttgaggctgggcatagtggctcatgcctgtaatcctaccactttgggagttcgaggcaggcagatcacaaggtcaggagattgagaccatcccagctaacacggtgaaaacccatctctactgaaaatacaaaaattagttgggcatggtggcatgtgcctgtagtcccagctactcaagaggtggaggcagaagaatcacttgaaccagggaggtagaggttgcagcaagtcaagatcacgccactgcactccagcctgggcgacagaatgagattccatctcaataattaaaaaaagaaaaggttgaataatcgcccccactctcttctggcttgtagagttccttcagagagatccactgttagtctgacggacttccctttgtgggtaacctgacctttctttctggctgcccttaacattttttccttcattttatccttggtgaatctgaagattatatgtcttggggttgctcttcttgaggagtatctttgtgatgttctctgtatttcccaaatttgaatgttggcctgtcttgctaggttggggaagttctcctggataatatcctgaaaacacttcaaacttggttccattctccccatcatttccaggtaaaccaatcaaaggtaggtttggtcatttcacatagtcccatatttcttggaggctttgttcatttcttttcactcttttttctccaatcttgacttcacactttatttcattaagtttgtcttcaatctctgatatcctttctttagcttgattgattcagcaggggctcatagataaaactcccatctccctgggacagagcacctgggggaaggggtggctgtgggcacagctgcagcagacttaaacatttctgactcctggctctgaaaaaagcagggaatctcccagcacaacactcgagctctggtaagggacagactgcctcctcaagtgggtccctgacccctgtgcctcctgactgggagacacctcctagcaggggtcgacagataccacatacaggagagctctggctggcatctggtgagtgcccctatgggatgaagcttccagagaaaggaacaggcagcaatctttgctgttctacagcctccactggtgatacccaggcaaacaggatctggatggacctccagcaaactccagcagacctgcagcagagaggcctgttagaaggaaaactaacaaacagacaggaatagcatcaacatcaacagaaaggatgtccacacagaaaccccatccagaggtcaccaacatcaaagaccaaaggtagataaatccacaaagatgaggaaaacccagcacaatgcagctgaaaactccaaaaccagaatgcttctccttcaaaggatcacagctcctcaccagcaaggaaacaaaactggatggagaattaatttgacaaattgacagaagtaggcttcagaaggtgggtaataacgaactcctccaagctaaaggggcatgttctaacacaatgcaatgaggctaagaaccttgagaaaaggttagaggaattgctaactagaataaccagttcagagaagaacataaatacctgatggagctgaaaaacacagcacgagaacttcgtgaagcatacacaagtatcaaaaacactcttaagtacagaccatgatactatgaagcaaccacattaccaattttgcataataaccagctaacatcatgatgacagcatcaaatacatacatataaacactaaccttgaatgtaaatgggctaaatgccccaagtaaaaggaacagaatggcaagctggataaagaaccaaacccatgggtatgctatcttcaagagacctgtctctcatgcaatgacacccacaggttcaaaataaagggatggagaaaaatctaccacgcaaacaaacaaacaaaaaataaccaaaaacaaacaaaaaacagaaaaatgctgggattgccatcctaagttcagataaaacagattttaaacaaagattttaaaaagacaaagaagaacattatataatggtaaagagtgcaattgcacaaaaagacctaatcattctaaatacatatgcacccaatgtaggagcacccagattcataaagcaggttcctagagatcttcaaagagacttagactcacacacaataatggtgggagacagcaacacctcactgacagtattagatagaccattgaggcacaaaattaacaaagatatttaggacctgaattcaacactagatcaaatggacctgatagacctctaaagaactctccactcaaaaacaacagaatatacatccttctcatcaccacatggcacttagtctaaaattgatcatataatcggaagtaaaacacttctcagcaaatgcaaaagaactgaaatgaaaacaactgctctctcagaccacagtacaatcaaattagaaatcaagactaaaaaattcacttcaaaccatacaattatatggaaatgggataacatgctcctgaataacatttgggaaaataatgaaattaaggcagaaatcaagaagttctttgaaaccatagagaataaaggcataatgtatcagaatatctgggacacagctaaggcaatgttaagagggaaatttatagcactaaatgcccacatcaaaaagttagaaagatctcaatttaacaacctaacatcacaactaaaagaactagagaaacaagagcaaaacaacctgaagatgataaataaccaaataaccaaaatcggagctgagctgaaggagactgagacatgaaaaaccaatgaaaagatcaacaagctcaggaacttcttttgaaaaaaattaataaaatagactgctagctagattactaaagaagaaaaaagagaagatccaaataaacacaattagaaatgacaaaggggatacaccactgaccccacagaaatacaaataaccagccaagaacattatgaacatctctaagcacataaactagaaaatctagaagaaatgtataaattcctggacacatacaccctcacaaggctgagccaagaagaaattcaatgcctgaacagaccaataatgagctttgaagttgaatcaataataaatagcctaccaacaagaaaagcccaggaccagagagatttacagccaaattctaccagatgtacaaagaagagctagtcccattcctattacaactattcagaaaaattgaggaggaagggttctgccctaatgtattccatgaggccaacattatcctgataccaaaacctggcagagacacaacaatacaagaaaacttcaggccaatatccctgatgaacagtgatggaaaaatcctcagcaaaatactgacaaactgaatccagtagcacatcaaaaacttatacaccatgattagctaggcttcatctctgggaggcaaggttagttcagtgtatgcaaatcaacaaatgtgattcactgcatgtaaagaactaaagacaaaaaccacattatgatctcaatagattcagaaaatgctgttgataaaattcaaaccccttcgtgctaaaaactgtcaataacctacgtaatgaaggaatatacctcaaaataacaagagccatgtatgacaaacccacagacaacatcatatttaatgggcaaaagctggaagcactcccttaaaaattggcacaaagacaagaatgccctttttcaacattcttattcaacatagtattggaagtcctggacagagcaatcaggtaagagaatgaagaaaacgcattcaaataggaagagagaaagtcaaactatccctgtttgcagatgacatcatcctgtatctagaaaatctcacagtcttaacaaaaaagctccttaggctgatgaataacttccacaaagtctcaggatggagaatcaatatacaaaaatcactagcattcctatacaccaaaaagagacaaggtgagagccaaatcagaaaggcaatcccattcataattgccacacaaagaaaaacatacctaggatacagctaaccagggaggtgaaagatctctacaaggagaacaacagagcactgctcaaaaagaatcagagatgatacaaacaaatgaaaaaacatgccatgcttatgaataggaaaaatcaatgtcattaaaatggccctactgcccaaagcaatttatagattcagtgatatttctattaaactactaatgacattcttcatagaactagaaaaaaaactattttaaaattcatgtggaaccaaaaagagcctgaatagccaaagcaatcctaagcaaaaagaacaaagcaggaggtatcatactactaaaccttaaactatactatgggactacagaaaccaaaagagcagggtacttgtacaaaaacaacacacagaccaatggaacagaataaagcagaaacaagaccacacacctacaaccatctgatcctcaacaaacctgacaaaaataagcaatgggggaacaattccctattcaataaatggtgctgggataattggctagccataggcagaagattaaaactggacctcttccttacaccatatataaaaattaactcaagatggatgaaagacttaaatgtgaaacccaaatctataaaaagcctggaagacaacctagtcagtaccatctggacataggaacaggcaaatatttcatgacaaagatgcctaaagcaattgcaacaaatgcaaaaaattcaacaaattgggtctagttaaacaaaagagcttctttatggcaaaagaaattatcaacaaagtggacaacctacagaatggaaaacaatttgcaaactattcatctaacaaaggtctaatatttagcattataaggaatttaaattcacaagaaaaaaaccattcaaaattaaacaaaggacatgaacagacttttttcagtagaagacatacatgtggccaacaagcatatcaaaaaacctcaatagcactgatcattagaaaaatgcaaatcaaaaccacaatgagataccatctcacaccagtcagaatgactgctacaaaaatatcaaaaaaataacagatgttggcaaggttgcaaagaaaagacaatgcttatacactgttggggggggggtggtgtaaatttgttcatccattgtagaaaacagtgtagtgattcctcaaagacctaaaaacagaaataccattcagcccagcaacctcattactgggatatacccacagaaatataaattgttctatcataaagctacacgcacatgtaggttcactgtaacactattcacaatagaaaagacatggagtcaacctaaatgcccatcagtggtagacgggacaaagaaaatgtagtacatatataccatggaatactacgcagctgtaaaaaaaatgagatcatctcctttgctggaacatggttggagctggaggcaattatcctaaactaatatacaaacagaaaaccaaatactgcaggttctcaattataagtggtagctaaatgatgagaacacatggacacataaaggggaacaacacatactgggggctattagagggtgaaggatgggaggagggagaggatcaggaaaaacaactgatgggtactaggcttaatacctgggtgacaaaatactctgttaaacaaacccccatgacataagtttaccaatataactacctgcatatgtacccttgaacttaaagttaaaaaaaagatatgacacaatctattccttgtaagaagttaatgatatatacaaatggcttaagaatatgtagttctctaagaggaatcaaatattctaaaatctatatcccagtatatatgaaccaaatattttttcatattagtaatagcaggaccatttaataaccaggtttacacatgttagaagcagagctaagccatgactgaggaaacatggtgaaatacaattttggggcttagcataaagcctcaatacagcaatggttcaataaacattcactattttagtgttttatttggccgctaattagtaaagatcccaaggaaagaagtatttcccaatggagggtgtattagtctgttctcatgctgctaataaaaacatatccaaggctgggtaatttataaagaaaagaagtttaatggattcacagttccacatggctgaggaagcctcacaatcatggcagaatgcaaaggagaagcaaaggcatgtcttacatggcagcagtcaagagggcttcagcaggggagctcccatttataaaaccatcagatctcataagacttattcactaccatgagagcagtatgagggaaactgcccccatgattcaattatctccacctggccccactcatgacacatggggattattacaattcaaggtgagatttgggtggggacacagccaaaccatatcagaggggaactttacacctcttatgtgaaagaaaaatattaggcatcccttttttgttttcagaagagatcaagagaagagcaatctaactaagccatggcaagtatttactataaaagagtgatgaatataatgtgatgcagaaaataaagataaagtgtttctatgagaatccaaaaagaagcagttatttcaggatggaaatattaatttattttatcttagttatatcttagttcagtgttcatttctgagtatattttaagatcagccctagaagactgatccatttaattaggaaggtccttaagttacatggactgcagtactgttggtttcagatcctactgaatggaagcaacaccccaagactcctgacattagttccaaagaaggctatcacctacaaagtactatatgatttagtgccctatgggttatcttggtctgcttgaatacttggaaccttacattccagttattcctttgcaggatactcctacacagaacccagatgctgtactgtgagaagcccaagccatatagaaaggctgtgtgtaggcaatccagtaggtagtcttagcttaacccatcctttgagtcatcacagggcagctgccagacatgagtgaagaagactacagattacgatagcccggaactattttaatcttcccagcagaagccccaaatattactctatattcacagtgtcctgtctaaattcccagccatcaaattcataagcataataaattgctgtggctttatgccacaaagtgtgggtggtttgcaacacagcaatagacagatagccagaataccaaggatgtcaaagtggcttgtaaagggacatcctattactatatgaaaactaaaatactgcaaaagccctaggcaggcatacactttcattgtggcattattgataacaaggaatagatacatttgtaagattaaatgaggcagaaatgatgtatacattaataaaacagaaaactatgcagccattaaaatagcataaaatgaagacagcaatcaggaacatgtgtatgttcttaggttaagctaaaatagaaacaccaaataatgtacaattaggtgtgcatttgttaaaacatatataatatttatgaagagtactaaaagtctgtgcaaaagaaaacttctgctaacattaagtattaaaaatttgaatgatgttgtaccagatttttaaaatattttatagagttatgttttctataaaagtgtatataatatacaggtagttccacatttcataaagagtttggtaattaattcttccaaactgggtggggccacagcagaaaaaaaatgaagaaatgtttgctcttttggattctgaagggcagtattgcgtctaccagatatgaaagagagagagggttatttcagcatagttctgcaacatacacacagattccttcagtggttggatttgggtcactgacagaatcttgagtcaaggtcagaaactgactgtcatatcatgcaaacacagaacatctatgtattcttccattttaaatccctccagtgtctcgcattttctatgataataggcacatcctctattgaaggaagtctacattctgtggaaaaatttatgagttctgtgatttaatgagtttgtcttttctagtaatgtttacaaagctgaagttcctgctttgtttcctgctgggagaaaacagcttttcatttttaccattgtctgcaagttctgcttgtatctgtcagtttaaaaatatttaataatctttttcagaatttatattgaactaaatttaaatatcagagtttatgaggctgagaccatatagtccatttctcagaggctagaagctgctgacactaacagagttttgcaagtaaataccagcagtctgattcaacttcaaatttgccaggaaaacatttcagttagagtcttctgttagctctttgaatatcatcgtctggcaagacctggagataaacccttgagacacaaacatgggataggatagtccctgaagtaggtccagattatgtctgatcctaatctgtgccaaaaccaaacaactgctcctgccttcttaactccttaaggtctgacctaatggtgccagatggaaaagaatgccagttttgagagagggtagcaggttcaaacagggacattgtacacatgtataacagagcagccatgagaaactgcacatgactggttgttcctttcccatggtgccctgagagtttatgagctaaaacaggcacttagaattgaattattaggtaataaactctatctaagatttcatagtgtcatgtgccatacttaactttataaaaattagggattttattttcattacaacctctttgttcatattcaagagttaatttcttcattttgttatagtaccaaagccttgaaggtcatcaaaaagaagttaagatcaaaagtgaaaacaaattaaggaacagaaatattaaaaataattgttataaaccaaaaacgatattattttacgccaattgcattgccaatcaaataacatctctagggtgacatcatattctcttcattttgtctattaaatttcatatataaagtccactttcataaaaactctagaagaaaacctagacatcaccattcaggacataggcatgggcaaggacttcatgtctaaaacaccaaaagcaatggcaacaaaagccaaaattgacaaatgggatctaactaaactaaagagcttctgcacagcaaaagaaactaccatcgagtgaacaggcaacctacaaaatgggagaaaatttttgcaacctacttatctgacaaagggctaatatccagaatctacaatgaactcaaacaaatttacaagaaaaaaacaaacaaccccatcaaaaagtgggcaaagaatatgaacagacacttttcaaaagaagacattcatgcagccaacagacacatgaaaatatcctcatcatcactggtcatcagagaaatgcaaatcaaaaccacagtaggataccatctcacaccagttggaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttggcccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggggcacagatgaaattggaaatcatcattctcaggaaactatcacaaggacaaaaaaccaaacaccacatgttctcactcgtagatgggaattgaacaatgagaacacatggacacaggaaggggaacatcacactctggggactgtcgtggggtggggggaggggggagatatagcattaggagatatacctaatgctaaatgacaagttaatgggtgcagtaccccagcatggcacatgtatacatatgtaacaaacctgcacattgtgcacatgtaccctaaaacttaaagtataataataataaaaaataaataaataaatagaaacaagttgaaaatgaaaaaaaagtccacttaatttgcagcatcttatccaaaatatttaatgtataaacacaagtatgaaaatctcatatatgtgtgttaagtgtaagtagttgtgactaagctttacaattaaactttacacacttgaataatattcacctttttctttcaattccagaatttctttatgaaattcaaagagtcttaaaggaaaaaaggagaaatacatgactttttttcttatttcccccttaaagcatttacaagcaatgctgtttccttatcattatctataatcagtaaattttaaaaattaaactgtttctatgataacttcaataacctaattagttataaaaccaacagtaatgtaaaggatttgttatataaaaggctcataattctatgggtgcaaattatattgaaaaaacgtaatcatttggcaccttttcctcatcactttttggcagttgggagggaaaatcttgtaccatactgttagcctgctctgactgatctgagcagtaatgacctattaccgtgctaatctttccctttatttctcaatctgatagtttaggaacacaactcgaactgagtcctgctctagctatgtcaaagaaataaaaacaccagattcaagttaaattagcttgtaattgcttctggtttggaaatgacaatagcctgtggcctttgattagctttagataatttataaaactcttttatatgaattactctattttctccttatatcctttgagtgataggttttccataatagccaaaagctcaggagagttaacttctcagaatcaaataatttaaaagcagttgagccgatggaatagattttatagaatgcaattgccctttgtatgttaaacaccatggttattatggtgacctctgcctctaacgctgaaacaatgaatcctaaaaacaaggttttccagttccatggatgacataattctcatcttgccctaaaagctgacacttaagttaaaaaacagtaacaatgtatttaaaagggattaaaattagtgactgtcaagaaatctaacaacattataatacaaatttcaccaaagttaaaaaaaatctaaaactcagactaagagttaatataactttattttctttattttcatggacagaggaaaatccataagaagttatgataaaatgctgactttggcttacttgtaaaaatcaataaaaacatttaattgtcaagagtaggggatattttgatgatataagcttccttacttccacagatttaaatgtgcaagacttttaggacaaaatgacatttcattatgacatagttcccttacactccaacagtatgctgaatgccatgctatataaacattgaatgctaatgaaggttacaaacaacgcctttaaaggaaaatctcatttccagaaaagggagatatttcttatttaaataaaggctttctatatgaggcttgttagccctgatttaaatagtaattagctgtttgcaattagtccactgatgagtttatcaacctgagtattttccttattttcatttagtaataatgtcataatagcacatgcatgcaaaaggagtaaaagaagatattgcttacattattaaacaattcagatgaagagtagtggtttagtcttgatgagttgagaactgctctgggtcagaaaaaagatacaggtgcaagttatattgaaaaaacgtaatcatttggcaccttttcctcaatcattttttggcagttgggagggaaaatcatgtaccatactgtttgcctgctctgactgatctgagcagtgatgacctattacagtgctaatctttctctttatttctcaatctgataccaccaatagttgaccattaaagttgttcctttgtttcatgaactaccagatgttttacaagttttcctgtatttgagatatggcatgttccagacatgtggtatgaaaaactggaagtactggagcaagaatcaataacagagtcagactcaaattttctatcagtggccttggcttgagaaaacatccacagggagtttctgtgataatagcaagagcaaaagagctccttgaagctgcataaagttaggtttctctcttaccccagctggtttctatggccagaggcagagataactatttgatatttagattcaaaccttttctgatacccccatttctgtgataggccagaaggaagttaaacaactgcattaattatttaaagacgggccccagatattctcacttgtatcaatgccactgcttccaaagagctctgcagccattattgagaaacttagctgggctatttttttttcttaataacacatctggaagatgttgaaggcatagttaaatagcttagataaatctcaagttcgttcctgatattaattgctcaatgagcagcagattctgaataggtatgcacatcctatataacataatcaagtgctgtgtggagtacaaaactttttctcttatcacaatgactgcttatttcctcaactgggagctacatgagtttaaaacccttaaaggttttgtagtgtgctcatcactacctaataattagtgttttattaggtctgtgcaggttgcaatttgcaaaaacccactaaattagcttgtagaaaaagaaagaaaatatttttagaatgcaaaattgtcttataaatccaaagaatccagaagccgaagaatccagatttagtcagacctcgaaaagaaactgtaaccaggaacacaaatcccaacagcaccttcctgtctctcatgtctgcctttccttaagactgcgtcaaaattctagctcatagaataccacttttccttactacacgtccatgtgatagacagaacaaagctgactatatctttggggtttatagctcctctgttgaaaagaccagctatacttcattatgattccatgtgcctgcaaggaaattctgactgcccatacttagtttagttactcaaccctaagtaaaccaagaatggagtgaggttatttaattgtaactatttgtggggtatggttcctaacatggtagtagagcaactgggaaaataataataataatgataatatcaaaggttacttgacaaatgctcttagcctttaaaagaaaaaatatagaccatgatttctaattacaaattaatcagttgggtcatatagtaccactgaagaagtggttgaagctctgtgttacgtgacttttaataccttctttagaaatggttgagttaccttatttttaaaaattacacagttaataaaatcaaaatgataaggagactgtgcttcactgttcatttattcaaacattgatatttcctggaggtcacaaaataactaagtattattacaaagaataagaggaaaacctgaatttagctagagctggacactgtagttaccaggaaaggcctttttgagaaaataacattcaagctaagatctgagaattaattgaatgaagagtagaggcaagagaaacacaaacaaagggaatattaaatgtaaaattcaacaaactagaacaaacaatagtaaaagctgttaacattaaatctaagttaaaacagtcaaccagagagcacactgaagtacataactgaggaggaaatatgatatattaccctgtgccaaatggttgtttaatttttaattacattaaattaccacaaatatttaattagacacaggtggtaacatagcatcccttttttgttctcacttctgaaatagtatactgtgagttttttgtctgcaatctatatggatatatacatattcatggagcgctagtgagtgtagatggaacagcctgaaagaaagctttccaagaataaaaacattccgatattgataaacaactgccagattcacagtttccagtcctgtgcacagaccagctgtgctgttagttataacttctggcatgagtataaatcttagcttcatttcatccccagagattcactacttgtccaggcaagttcaacaatacatgttttgaattacaggaagatggcaatggtggcagagtttttgaatctccctaaatcccctccaaaagagagaaagggactagaattttaaaaccaaagcccacagacaatattaacaagagaaaagggtgaaagtgtagccataaccccacaaccccaaatatgagcaggtgtagacaaaccgtgattattaaaggacctgggtgatatctgtagcaatgcgggaaaaaccagaggccaaagaccccaactaacaggtagtgctcagtaaagaatacagtgagtcaggctgagaacctcagtggatattccagctcaagagtaattgtaaagtgaagacgcttaagatttactctattagcaaatttcaagtatatatacaggattgttaactatagtcagctcgtggtaatcacttcactgtgtgtatgtatatcaaatggtcatgctgtataaatatatacaacttttatttgtcaattatacttcaataaaactggagtaaaacttaaatgttttcagaaataaaagaacaattacaaggggtccctttgaatatctaaaggggctggagccatcacaatgccttgagtattcaaaactgaccacctgaaaattccctttggattgtaccctcacattaaagagagtcaccttgaaacagaattcaaattaagcatgactttaaaagtgtgcatgaagagaagagaaagttcagaaaaagtagcgaagggacatagagtctggagatcttacaaagaggttgtatttctaaatatatattttctgaacaggtggctccaacacctagcataattcccagcagatattgaaattgctataaaaacaaaaatcctttataagaatgacaattatgatgcctttttttcatactgaatgcattttaggtcagtcccttaatttctgcccataaaagaaattatctattcaaatagctgaacatttttaaacttataaaatatctcttttataagatagaattttgatgctaaaataattgagtatagcatagaaaacatcacatcacagctttcttatttcctttgtattcagaactgaacctgtgtttgtgggaagttttaactaattaattagctgaacataataaaaatattactctaaaactgataaagaacacagtctaccaaaaaatatgcattaaataccccatgtctgtgcatgcaacctaaaggatattccaaacaaagtattctaaaatgatatttcatacaaaattcatactggaaatggctcatttaactcattctaaaaacagcctaatttggactaatttggagaggcccagtatcctctagatcttcaggcaggtttcaacaatccctcatacatggtttaaattaataagtgcaaagttgcagacacccttctgacatacaattattttatcctacacttagtatttaaagaagtagtggctgaacggggagcagaaaatttaatttcttgagttgctgtggctttattggactaaaggtagcagtgattgtactaaatagattttttaaaaagctcttttctgagtaccattctcatagtggccatgctattacattcatacaattttagtgcaatgcttggattgtaatagcctttggacacctgtgcattgtagtgcaagatgtaacacattattatttgtgacaccccctcaaatgccaatttactaaactacagattgctttctaggcccaataaatctttacaaacctatctaaagtggatgtactatactcttttctcccttcctccattcgttttgtgcagtaaattatatgaagtggttattatatcatggtttttattaatctgaaattattgttcatatttaatgacatttgaggaaaaagtaaggatatattcattaatccagttgtcatagtaattatattctcagaaatgtattattattgtaatcattatcacttcttatttgggcagcagttcacacatttcacatataacagtgtggttttgtatttgtttaatcctctcaaaatctctgtgagatacagagagcaaacggtatctatatttcataaaagaacagtgactaaaaattttcatgatttacccacagtcacgctgacagtaaatagcagaatctgaatttgaatttattcttgctgattgcaagatcggtgcttttttcactgttcctaactgcctcaaaaaaaaaaagagccatatagattattagataagttcttcagtgtgcatatttcaatttagctgtggtttactttgcctctgtggaaagcataaaatggaagaatggttaagaggttatttgcaataatccaggagagaaacaatggtgagttgaatgagagtaatagagttggaggccatgtctacaaatgttttcaaaataaaactaacaagatttgctgatatgggaataaaaaacagaatgatatcatgattttttatctaagcaattagaagaatgcgattactgtttgtttagatgggggacagtgggagatatgtgttttagatatcaagtttcaggagcttaggttttgagcttgttaaatttgagagatctgttagacatccgagtgggtacactgagtagatggagaagtgggtaagtttgaagtttgaattatatgttgggctggagatatgcctagcgattcataaatgtatagatattgtttatatttatacataagtgtacagatattgtttttaaaaaactggatgaagactgtgaagacaacatggtttcttaaaatccaaatgaagagtatatttcaaaaacgtaaaagtttttaaattttttttaattttaaaatgaaagcattaatttttttaagttgtagcaatcatcggtgttaaagaatgcttatacacggagtaaaattaaggccaagaattgattattgtctcttgcagtagagttctttatgtgtttaacaagagctattgttgtgtgtctctgtgtgtgtgtgtgtgtgtgtgtgtgtgagagagacagagtttcgctctttcgcctaggctggagtgcaaaggtgcgatctcagctcactgcaacatccactttccagtttcaagcgattttcctgcctcagcctcccaagtagctgggccttccaccacacctggctatttttttattattattatttttagtagagatggggtttcaccatgatagccaggctggtcttgaactcctgacctcgtgatcctcctgcctcggcctcccaaataacaatagctattttgattgagtggtaggtgccaaaaactggagtgatttccagagagaaaaagaaatggaatcagtgattacagaattttttaaaagaattatttaaagtatttctttaaaattttctgtaattcttttttgttttgctgtaaagaggaaggagaaacagggtagaaactggaggagaataagggtcaagaaagtttttatttgcttcttttttaaggcaaaatgacagcacgattgtatactgatggataatccagtggagcaggaaaaactgatgctacaagggagaaaaaagaattgttaaagcaaagtctttgaagaggcaaaaagggatgggattcactgtaaagtagaggttcgtatgatataaaaacatgaactgtttctcaacagtaatggaagaggagacaaagaatctggtctgatataggcaggctgacatgcttagtggtaagatcatatggaaatttccttttaatgacttcaattttataaatgaactagaaagcaaaaatgttatctaagagagggcatgccagaactatactatttcatttacaatagtttcacagtgtgttcctccaatatttttatattttccacagtgcttttgttctatttgctagccacagttcttagccattttttttttttttttttttttttttttttgagacggagtctcgttctgtcgccaggcaggagtgcaatggtgtgatctcggatcactgcaacctccgcctcccaggttcaagctattctcctgcctcagcctcctgagcagctgggaccttaggcacctgccactgcacccagctaatttttgtattcttagtagagacggggtttcactatgttggccaggatggtctcaatctcttgaccccatgatctgccctccctggcctcccaaagtgctgggattacaggtgtgagccatagtgcccagcccatatattattcttttaaatggcctacagtatcagcctttcagattcaaacaaaggaaaaatagaattttgactgaaattaaatgtatgaatttgaacataatcagcagcttaacaatatcatgtctttctagaaaactgacctgtctctccacttattccaggcttcttttatgtcctctaataaaggtttatatttttctattttcagttttgttcgcatgttgtcaaattcaattctcaatattttatatttttgcttttattttggaatgtgagctatccttctcttatctcatcctatagcatttaagactagactggatattacttatacaaaggaaggtaattcaatttctgccaactggtattcttgtgactttatccccacaaatttctctctctgcagctgaaaaacacaaactcaataacctctgtaattaaaaaaaattaaatataaaaatatttacattattcctattgtactgactagacaattgagtctcaaagacgataatttatccaacataattgtgtgaataatgacaaaaaaacacccagttttgggaaaattacaaatgcaatttctagcagacactgcttggttatctagtgttttgaaataaacaactccaaaacttcgtggcttgaaataagcattatttatcttattacagttgtttgggttgataatttagacagagcttagctgggatggcttgtctttgctccatgttatgctgacttgactcactcatctagttgcagttaactggcagggcagctggagcctggctggtcccagatggccacacactttgtggctggtagttgcctggcactcataaggtgccttcattttcctccacctagcctatccagcagactatcttgggcatcctgggcttcaagaagaaaaccgcgatgtaccagcacaagcctctgcttgtgttcatatgtgcagatgacccattagacaaatcaagtcacatgaccaaacccatagtgattatagaaagaacctataatgagaaacctgattcatttggagttactaatataatttgttctagcccttagcagaatatttctacattttctagaaccacagtataaaatttcaactggtcagagtttaggaagcatgcatagtaagcctagtgaggtaatttgtggggattcttactttcagttttgaggtataattagtacacaaaaaacttaaaaagcaagaaaaaagaatgcaacttttataggtgattaaatatgtttattacctgggttatatttagttgttttagtttaaaatctttactctcatatccctaattttcctcctatcaatctgctacagatgtctgacatttcagcattagatagcaaatcatttgtgttaagaatttattccttataaaacaacatacatatttaggaaatagactcaacataaatttatcagaaaatttcccatgggactgctagccctcagtacctacatttggaataaataaggatttgtgctctatttaagggaaagaatgggagatcataattttcggggtaagattgctgctctgagataattcttgactgaatatcacctttagaagtccctgaaaagtcaccaggatacaagggaagggagcaaactttgaagacttactttatgtttcagtgagtctcagagtttaagtttcaaagtagacaatccttcagcaactttacctttgattcatgtaattcctatgaacttgtctcctatgcatttgctatcaaaaatagcttaataaaatttttctcgccaaaagtgtttctccttgccgcatttggattttcaattcatggcagtttttaatggtgagaaatacattctaaagaacggacatttctaacactggtatttagattttgtgtactcacagaaaatttctgttttcatttcctcatttctacaaaaagaaaataagattatttctatccaatttcaggtaaaaggtataatgatgaagcttatattattctaaaactgcctcaagcttcttgaaatagtgacattgcataaccatactattctacctttagtcctacatggtaatatgaaataatgacccaacagcaagaaccaaatagcagattataaattagggtcagtctaaccctctaacattaagacttatcatttatttcaattaccattagtttaacacccattatatatatattaatatgtttcagtctctatgattatattttattttcttagtattgatgcagatatagtcaatacttccagagggaaacacttatagtcaatatattaggtctaaaatgagaggagcaagatggtggaacagaaagcttcgctgatcgtctaccctgcaaggacaccaagttaacaactatctacacagaaaataataccttcataagaaccaaaaatcagtttaccactcacaggacctggttttaccttcaaatgattgaaagaagcacaggatatttaagaaaaaaaaaaaaagtcctgaataaccgataccacccctctttgaccccctacctgcctcctccacatctgtggcttggtgcggagagcatctctgggcactgtgggagagagaacacagcaattatgagtcattgaattcagtgctgtcctgttagaacagaaaggaaaactggatcaaactcagctgacccctgcccatggagacaacatttaatcgagagagcactagccacagagtccaaacttgagtgcctacaaaccttaccatcaagggctacagcattctgtgtctctgagtaaacttgaaaggcaatctttggccataatgactgaaaattttaggtgagtcctagtgctacactaggcctagagacagtggactttgggtccatggggggacatgacatatttagacaccagctgtagcagccaagggagtgcttgtatcaccatgctgataaccccagactgcacagattaaggcttcaaaagagaccccttccttttgcttagggagaggagaggagggggaagagtggggaggactctgtcttgcatttaggataccagctcagccacagcatgataaggaatggtcaaagtaatgaggctcccgttccaggccctagttttcagatgacatttctagacacatcttgggccagaagggaacccactgccttggaagaacagacccagtcctggcagcatacatcacctgctaaccaaagaacccttgggtcatgaatagccagcagtgatacccagatactacactgagagccttaggtgagcctctgagactagctgacttaaggtgagactcagcacataaacagctatggtagctatggggcaaaactgcttctgcttgagaaaagcagagagaaaagtgaagacgactttgtgttaacaccttaggtactagcatggtcacagggaatagagcaccaagtgggttcttgggttccctgattccaggacttgacacttagatggcattgctgaaccagccctaggtcagaggggtgcccaatgccctgaagagtaagtctcaggccaggcagcagaattcatgagaagcttacttaagagaccttgggccttatgtgagcattggtggtagtactcctcatggcctggggtggcagtggctatgcggtgaggcttttttccaaaaacctctttgcttttggaaggaggaggcaagagtggtaaggattgcatcttgtggtttgagtgacagctcagctgtagtaaaacagaacaccaagtggacttctaaggttttttatatctagttcctgactcccatatggcacttctgagcccacccagggccttcggaaccacactgctctaaaaaaaaggacacaggcctggctggctttgacatctgctgattgtagagccccaggaccttgagtgaatgtaggcagtagccagggagtagttacggcaggccttgggcaagacctagcactgtgctggcttaagatctgaccagcgcagccatagtggtagtggccacaggggtgcttatgtcacttcatccctaggtttaggtgactcagaacagaagagagagagagagagagagagagagagagagagactgactctgtatgtttaggaaaaagtaaggaaagagaataagagtctctacctggtaatccagagaattctcccagatcttgcccaaaaccatgaaggcagtacctctactagtctgcaagaatcaccgagatattgggtttggggtgctcctaaagcagatacagctaagatcacaacacctaagtcctttcaaacatctgtaaagctttcccaagaaggatggctacgaacaagcccagccagtgaagactacaataaatacctaactcttcaatgcccagatactgatgaacatctactagcatcaacaccacccaggaaaacatgacctcagaaaatgaactaaataaggccccagaaacgaatcctgaagaaacagagacatgtgacctttcagacagagaactcaaaatggctgtgttgagaaaactcaaagaaattcaggagaaggaattcagaattatgtcagataaatttaacagagattgaaataataaaagaatcaggcagaaattcttgagctgaaaaatgcaatgagcatactgaagaatgcatcagagtcctttaataaaagaatgaatcaagcagaagaatgaattagtgaacttgaaggcaggctatttaaaaaaacacattcagaggagacaaaacaaaaaagaataaaaaacaatgaagcatgcctatgagatctagaaaacagcctcaaaagggccaatccaagagttattggccttaaagagaaggtagagaaagagataggagtagaaactttattcaaagggataataacagaaaacttcctaaacctagagaaagatatcagtatccaagtacaacaaggttatagaacaccaagcagatttaatacaaagaagacattctcaagacatttaataatcaaactcccgcagtgcaaggataaagaaaggattctaaaagcagtaagataaaagaaataaatagcatacaatggagcaccaatgcatctagcagcagatttttcagtggaaaccttacagaccaggagagagtggcatgacatatttaaaatgctgaaggaaaaaaagcctgccctagaatagtatatctagcaaaactatccttcaaacatagagaaataaaaaaaaagctgagggattttatcaataccagacttgtcctataagaaatgctaaagacagtacttcaaccagaaagaaaggaacataaatgagcaataaataatcacctgaagatacaaaatttactggtaatagtaagtacagagaaaaacacagaatattataacactgtaactgtggtatataaactacctttatcctaagtagaaagatgaaatgatgaaccaataaaaaataagtataacaacttttcaagacatagtacaataaaatataaactgcagaaggtttaaaagggagggacaaagttaatgcatggagtttttttagttttctttttgtttgtttttttaagcaaatagtgttaagctgccatcaggttaaaataacggattataagacactatttgcaagtcttatggtaacctcaaactaagaaacataccatggatacataaaaaataaaaatcaaaagctaaatcatatcaccagataaaatcaccttcactagaggaagacaggaaggaaaaaaggaagaaagacaagaccgttaaactaccagaaaacaaataacaaaatggcaggcgttaagttcttacttattcctagaataacattcaataataatattcaataataacattgaatgaaaattaaattcttcaaccaaattacatagactggatgaatggatggaaaaacaagacccattgatctgttgcctacaagaaacacactttgcctctaaagacacacacagactgaaaataaagggatggaaaaaagatattccctgccaatggaagctaataaagatcaggagtcattatacttatatgagacaaaatagatttcaagacaaaaactataagaagagacaaaaggtcactatataataaacgggatcaattcagtaagaggatataatattttaaatatacatttatgcaacactagagcacccagatatatgaaggaagtatcataagaactaaacagttaggccccaatacaataatagctagaaacttcaacactctacttttagcatctgacaaatcttctagatagaaaatcaaaaaagaaagatcagatttaatctgcactatagactaaatggatctaatacatatttacagaacatttcatccaagaacttaagaatacatattctttttttcagcacttggatcattctcaaggatagatcatattttagttcataaaataagtcttaaaacattcaaaaataaaataatatcaagcatcttttctgaccacagtaaaataaaattagcaattaataaaaagagaaattctggaatctatacaaatgcatgaaaattaaacagtatgttcctgaatgaccaatgtgtcaatgaagaaatcaagaaggaaattgaaaaaattatcaaaacagataataatggaaacacaacatagaaaaacctatggaatagagtgaaagcagcactaagagggatgtttatggctgtaaatgcctgcatcaaaaaagagaaaaaaatttcaaacaaataacttaatgacacatcttaaaaattagaaaagcaatagaaaactactcaaaattagtagaaggaaaaataagaatcagagtagaaataaaataatttgaaatgaggaagacaatacaaacgtcaacaaaacaaaaggttggctttttgtaaagataaaattgacaaatctttagccagactgatgaagaaaaaaaagggagaggacccaaataaataaaaccagagttgaaaaaggaaacattaccaccgatactgcagaaattcaaaaaatcattagtggctaatatgagcaactatatgccaataaattgggaaatctagaagaaatggacaaagtcctagatatatacaacctatcaagattgaaccaggtagaaatccaaaacctgaacagaccactaacaagtaatgagattgaagtcataataaaaagtctcccagtaaagaaaagcctgggacctgatggctttgttgctgaattctaccaaacatttaaagacaaattaacactaatcctaatccaatgttctgaaaaaccgaggaggagagcgtacttccagactcatcctatgaggtcagtattaccctgatgccaaaaaccagacaaaggcacatcaaaaaaagaaaattacaggccaacatttctcatgaggaaacatgctcaacaaaatactagcaaaccaaattcaaaaatacattaaaaagatgattcatcattaccaagtaggatttatcccagggatgtaaggacagttcaacatatgtaaatcaatctatttgctacatcgtatcaacagaatgaaggacaacaatgatatgatcatttcaattgatgctgaaaaagcgtttgataaaattcaacatctcttcctgaaaaaagcccccaaaaaaactggctatggaaggaacatacctcaacataataaaagccatatatgacacacctacagcaagtatcatattaagtgtggaaaaatagaagccctttcctcttagatcagaaacattgcagggatgcctaccatcaccactgttattcaacatagtactagaagtcctagttagagcaatcagacaagagaaagaaataaagggcatgtgagttggaaaggaagaagtcaaattatccttatttgcagatgatatcatcttatatttggaaaaacctaaagactccacaggaaaactattcaaactgataaataaatttagtaaagttgcaggatacaaaatcaacgtgcaaaaatcagtagtatttctatataccaacagtgaacaatgtgaaaaacaaacaattaagtaatccaatttacaatagccatacataaaattaaaaacctaggaattaacttaaacaaagaagtgaaatatatctataataaaaaccataagcaccaatgaaagaaatcgaagagaacaaaaaaaaatggagaaagtattttatgttcctggattgaaagaatccatatttttaaaatgttcatattacccaaaacaatgtacagattcaatgcaatccctaccaaaatgtcaatgacattcttcacatttttcacatagaaaaacaatcccaagaagacccagaatagccaaaactattctaagcaaaaatagcaaaactggaggaatcacatcacctgacttcaaattatactacagagacatagtaaccaaaacagaatggtactggcataaaaacagacacatagacaaatggaacagaatagagaacccagaaacaaatccacacacatacagtgaattcattttgacaaaggagccaaaaatatatactggggaaacgatggtcttttcagtaaatgatgctgctaaaggtagatctccatatgcaaaagaatgaaactagatctctatctaccaccatatacaaaaatcaaataaaaatggattaaagacttatatataagacctcaaactatgaatctactacagaaaagtattgagaaaaatctccaggatattggtctgggcaaagctttcttgagcaataccccacaaacacaagcaaacaaagcaaaaatggacaagtgggatcacatcaagttaaaaagttctgcacagcaaaggatacaaccaacaaagtgaagagacaacccacagaatgagagataatatttgcaaactattcatctgacaaggattaataaccataacatataaagagctcaaatgactccataagaaaaagtcaaaaaatgggccaaaggtttgaatacatatttctcaaaagacatacaaatggaaagggtgctcaacatcattggttatcagagaaatgcaaatcaagactacagcaaggtgtcatctcaccccaattaaaaggcttttatccaaaagacaagcaataacaaattctggcaaggatatggagaaaagggaaaccttgtacactcttggtgggaatgtaaattagtgtaaacactagggagaacagtttggaggcaggttccacaaaaaagctaaaaactgagctaccatatgatctagcaatcccactactgggtatatattcaaaacaaaggaaatcagtatatctgccctcttatgttggtttcagcactgtttacaatagctaagatttggaagcaacctaagtgtccatcaacagatgtacggataaatgaaatacggtatatatacacattgtaccatatgtaccatatgcatatatgtaccatatggtacaataatagtactccatatggaatactactccactaaagaagactctagattgggagaaatgtaggggtgatgccttcaaagtgaaacttggtctcacccttcttatgctatttttatttagttttttggtccacagttccactattatggtagtattagtactaccataatagtactccatatggagtaccattcagccataaaaaagggtaagattcagttatttgcaacaacatgaaagaacagaggatctttatgttaagtgaaataagccaggcacagacagacaaacattgcgtgttctcacttatttgtgggatctaaaaatcaaaacaattgaaatcatggacatagagagtagaaggatggttaccagaagccgggaagtgtagtaggaggctgggatcaggggaagatggggatagttaatgggtaaaaaatactagaaacatgtatgaaacctactatctagtagcacaattggatgactatagtcaataataactaattgcatatcataaaataaagagtgtaattggattgtttgtaactcaaaggataaatgcttgagggtatagatatcccattctctattatgtgcttatttcacattgcatgcctatagaaacacttctcatttatcacataaacatatacacctactatgtacccacaaatttttttttaaatttctaaaaaaaaaaaaaaaatattaggtcttacaattacccattagtaaaaataaaggctagaaaactaaacaaatatttatttatttgtatttcctttgataagcattagtaaatggatttagctatattctgtagggaagagagagaaacaaatatttggaaagcagccaaattattgatacagtatcaatttttttatgtgtctttcttccttctttccttcttccttccttccattcttctgttctttttaaattgtgatgcatttactaagttgggtaaaggaaggcagtgggaaattaattatttcattaagtcagaaaagcagtcatttcaatgcccaaaagcaattagtgaaagttgccagaactggaagaccatcttccttggtctgattgactttaaaagccagtatgggatggcaaaggtcaattaccagagtagtgaggaaagaaataattaaagataggtaggcaagagaaagtaccaaggaaagctggctgaactgagctatgcccaagatggaaacttttaggtaagcatgtgaaatgggaaacagttggaaagctagatgggtacatggtattgcagggtttgggggaagactagtgaggatttaggcctgattgtccggctttagttgttttaatggatgtgcctgctgatgagcccaagcctccagataataattccagccagaaggaagctgaagagctgtaagaaaacattgcacgacccatgatcttgggttcacctgagacagattttggagaaagaagggagcacagaaagagtatgttactttcaaaactacaacaattcgaaagctatttttttaattgccaagaaaaaaataggctaccagctgtttcttcccgtaggaattgacacaagccaactctcaggagtgattttccaaagaaaagaactggcccagcctaatcagaagtttatcaaatattcaactttactttttaaaatatgttttagtgctacagatgggccaaataaaacaaaacaaaaaccctgcaattattccttacagtattaccctattaacagcttgattattttaagatctaatcttgagttcttagaggcagcagttaatactgtttggagcaaaagttagaattaacaaaaaatgagtttacatagaaaaagatagtatattcaagtctctgaaaacccccaaataatctatagaaaacacatttataggatatatttgcatcatcttttctaatgaagtgtcccataatagaggttgaatggttggcaggactgtcctaatggtgctttcatacaggagggacttgtaagtagtccttgtgaaagtcccttcagtacaagtctaaagtgcaggcattcttagtaacccagacagatctgtctctgtgatgtagtcctttgaacttactttgcacaagaccaatctatgcacttcagaccataataccttattgagcattcattaattcagaacagcagacatcacattattccaatgattaagtactaacactcccttgcattgcttcccttgtctcatatccatacccatttcaaagtaattaagaattcagacttggaattgtgactctcccagtgagactcccagctctgttactagcagtttggtcataagcaagtttcttagtctctctgtgatcaagctccttcatttgtacaatgggactaataatggcttccacttaagcatattgtaagaattaaatgagctaatgcatataaagcacccaaacggtgtctggcagagagtaacgatagagaactttgagctctcattagaaaaatagtaggaacccatgctgttttttcaacagaaggttgtttggtaagtataaaatagaagatccagggcagaaggtggtgggggtgatggtggtcagtggtggtgttagtgatggcactacacttaattttggaaagttaaattaataagtttgcttttattttcaaaatatagggtcttccttagtgaagcagtactcactaaataatctggcaaatcttcaccttctgaatcgaaattttctaggctatccacttttctctctgaatcattctttctttagatgtgttaatatcactgattacatgtaactcaagtgtgatttccttaggtcttagagacattatgtatagatcaaattaatccaacttttagttttagaagtacttttatagcctgcatcatatcctgtaagacatcagatgggatgctacagaaaaccctggtgatgtcctgctccctttcatctcttctcgtgtgtaggcaactcctggtactttggatgaattccaccttaagggctcttattgctcttatacttatgcctaaacgcttaaaataattatgtattaaagttactgttggaactctgccattaagtatgtcgttgtgtccaatcagagtaatcataggcaaaaccctatttgtcacctgcaaccttctaaatctcccttttagccatgtctttctcactctcctaaatacctatccaaacaacaagacatcagcccatttttgtgggctgaaaggatttgtatgggcagaaaggattttagatgctaatgatttaaaacatttttctccaaacattaacaggatgtatccggccattaaaaaaatcaaccacacatcctcaatctatgtgtttttacatactaatgatatacatatactattatgtatgtatatatatcatttactttaaaaatgaacagtagaccctagacaattaaaagaatgaaataaccagatgttaacagaagtcttaacattttaattatacatgccaatgaatcatattgcacatcccccaaggtgaacatgccccaatttagagagcattgcttaaagaatatggtacacaccatactgaaactcctaattttaaaagctaaaaagaattgaagatggaatttgatataaatcatggtaggggatgatgaggcactgcctcattactgtccaaaggagtagaagtctagtttcccccatttgacctctgttgacactcctcattactgctaggtgagtgtaggagtccagctccccacaaagactccaatgactccttgctggatggaaaagatagcaatgtcttgttattgctccctgcatggcttccattgacaccacctgggtgggggttggtctcattattgctgtgtggtggtaaaagacctgactcttcactgggccttctcttctacaaccccagtggcaagacagtgggatgcctcattattatcagatgggataaaagtctgtttcactactcagcattatctgacaccagcctgggggaagacaggagcacctcattacagcagggtaacagttgaagtctaggattctcacttagcctttgcagacatggttggggatgaaattatgttttattttttttcctgtggtgcttgttattatctaaaattgttctgtcttgcttgtctacccctttcttggtcctttgacttgaaagcaaaaatttttgttcacgctatttgtgtctgcacgtggtggcatttaccaattgcctgcatcttcaactccaagtctgagttatctggaccaacagaaaatccctgggaatttaccaccatgctggttcttgagttccaaagttgagagtggtttgccttcttcctgtcacctttcggagccttcttagattatttcattatataatggtgagcgttttacttgtacttgaggaaaaaaagtacagctcttcatatttccaaaattagtaatagaatttgttttctgtaagatatttaacttccttgagtatcagtagcctcattaacacaatgaaaatattacatctatcttgcagagtggttgaaataattgcagaaaacttttaaaaatattatcctgccatgttatataattgcaaaggaaaaatgtgtaaaagatgtccctaacaatgctagttttgtgaatcaacatagtgttatttctgtgaaatactgtgtttgcctttctggactgccactctagccccccccccaaaaaaagtgttaattgcttgaatgaatcaggtagtattaaagaaaaaaggtggcagcctggagcatggtatattctagctatgacggaaagaaaggaagaaaaacaaagaaaggaggtattcttcaaaggaaacagtgtgcagatctttgtggtatttctgtattactgccagcaatggtgcccagaggtacaagcagcatagctcatatgcaaagctgagttggccactcccagaagcacggtggaaagttcagactagcttgagtccctagaaggccaacctccatgcccagacttagaccccaccctaaggctctgtccagatagggagatacacatcacagtgcctttcagcaaatgcaaaggtgagagttacatcacccagatgttcaaaaagcatcctggctctgcctcaaagcccattccaactctctacccaagcagggaggcaaacctcaatcatgcatttctaccaagcctagcagctgggtttggccattccaagcagcaattccatctaatcttgcaacccaacctgcagccctgccaaaattacagaactcaaatagtggtgctggccatctagggaatatatcctgtgccccagctcaccagacgtgatttcaacacccagtcagtgggtccagtgaacagcagagcccagccagcagccccatccaaccccagagcaaaggcagccttccagagagctagagaacctaacagcaagcactacctgcctagtgttattaccagctgacccatccagaataactgtctcaacttcatagtaaaggtctttccctgcaaaagaacacctgtgaaggatggaggacgtggctatctccccaaatgtgcagttacaaatgtaaggtgtcatggattacaaataatcaaaattatgagacctccaaaatatgctaatgaagttccaacaatgtagacttatgaaatgcctaataaagaattcagaatagttctctttaggaagttcaatgaactacaaaaacatacagatagaaaagtaaataaaatttgcaaaacaataaacaaaacaagaagtttggcaaagtaatataaatggtattctaaaagccaaataaaaatcctagacatgaagaacataatgactgaataaattaattaaaaagacagtgttgacagcaagctcaatcaagtagaacaaagaatcagtgagatgaaagacaggatatttgaaattatccagtcagagaagaaaaaaagaaaaaaaatgaagaaaatctgaagaaattatggaacaccatcaaggcacttaacatttatataagaaaaacagccagaaagtatgtttataaagagataatagccgaaaatttcccaaatctgggaaaaggtgccaacatccagatacatgaagtacagagatattcaatcaaattcaaccaaaaaggagttcaccaagacacataataatcaaactgtaaaaaactcaaagacaaacaaaaatatctgcaatcagcaagagataagaaacatatgacatgcaagcgtgtcccaatacagttagcagatttctcaaaagaaaccctgcaggccaggagtcagtggaaatctaaaacaattaaacaaagtagcaaaaagcagaatagtggtcatcagaggctgggagatggagagaatagggaggtgttggtcaaaggatacacagttacagttagaaggaataaatgataagtatttcaggtgatgaatatgttaattaacttgattcagtcattccatgctctctctatatatcatatcatcactgtttaccacataattatatacaattataatttttcaacaaataattattttaaaacataaattttatttatttaaaaaattttattggctgggtgtggtggctcacgcctgtaatcccagcactttgggaggccaaggtgggaggatcatgaggtcagaagatcgaaccatcttggctaacacggtgaaaccctgtctctactaaaaatacaaaaaattagccgggcgtggtggcgggtgcctgtaatcccagcgactcaggaggctgaggcaggagaatggcatgaacccaggaggcagagcttgcagtgagctgagatagcaccactgcagtccggcctgggcgaaagagtgagactccatctcaaaaaaaaaaaaaaaaaaaaattattttaaaactctatttatttaaaaaataaataaataaaagagataactactaaaagagcaaaagagcattggtgaaacgggataatattaacaatacagggtttctgtaaagactaaataaattaagaaatgttaacatatgatttaaactaaattttagataaatgctgtgtgattatatttaatactagcagtagtaatattttaaaatatttgtaaaacacattattaggccttccttttataactttagagctggttacaccccaaaacaaaagagtttctcagtttggtttctcagttacctcagtctggtttctaaaagtaatttataaatcatttaaatctttaatgtaatctcaagaaaatgttaaaaaatagaatcacattcataacgtgaaaaacaaaaaaatactttaaaattctccttcccatctttcacatacttcagcagtctctggaatctcctgttcattccccaacacttgttatatatttatttatttttctacacaaataatactatagtttaattgtattcttctccaattcccttcaggagagactttataaggtaaaggagaggcagtatgttctcttctgctcatttagtattgcctcttgcatcatgcacctcacccaaatcccacagttttttcattgctggcgttatgaagcaagatatattgcaaatttcatctcacaatgaggcaaaaatcctactacagttgaacagacttttagagagggaaaaggtagatgttggtgtagtgtaacgtatataagcacaaactagaacatgataagctgagtacaaattttggctttactactttttagctttgtgtcttgggcaatttacataaatgtattttttctaagcaacgtcttctgtaaaataaggggaataatagagtcgttaaaagattaaatgaattagtataaataaatacctcaatacctgtcagagaaagtgctaataaatatatatattataatgtttattaaatcgttgattcctttaaatcacattgacctagttgtgcactttttcttcatttgccctgaccaagtaaatcaaacacatcaaagactgtgtatgaaaaacttgttttttttcctatgaacttatgcatacattgtattgaaggcaatacagtatatagtagtaattgtgtgcgatatcttatgtgatagaatagccactgaaaaataaaaaaaaataaggccgtcacaggataactggccaagaagaagttgggctatcagtaagggaagatgagagcttgtcctgatgcctcccctactcctccgcattggaaaagggtaaacactgctatcgcccatagtactggtgatcaaggttaccagatatgatttaagggcatttctgtacaacaaaaaataaaattgtattttcttatcaatgtgatagtgtgagataataatttaatttcaatccatttattaattgtctatagagtcagaaataacctccatcacaaaaagccattctcaacaaaggcagcaggcagaaattgctcacagttgttctcagtgatgctcagattactcaagtgaattactggaaacaatggatactgacaagaaaaggaaaatgactggagagaatagaagttgatagcactgaaataaaaaccttccaatggggcaggtgtatgtggaagtgcatgtctttgcatatttccccaaggagaggagtaaagaatggctttggctgtgagatgcattttaaaactgtaaaataagaggatcatgtatcaaatcaaattgtgttggcctggaaacatattacatttttgcatgattttgctttccctaccattattttcatatgtattaatttactttaatattcctcctataacatttatccccttaatagatatatgatgatgaagatagatgataggcagagagagaggagagagaaactagttttcaaattgtttgttggtgctgactcaaaagcacaaacatccaaactcctcatcacttaaaatctgtagcaaatcctggaaataactgtgaatattttctctcataatcataatttctgaaatcttttgtaatttacattgtgtcacattattctaggaccattcattcatgacatctattgtctaaccactcaacatttccataagtccatttgttattgtcagggcacaaatgaaagccttgtattggcacaagaaacacccatgccaagagaatgttgttacctctgttcccagcgcatggctactagataggactacttaagcacagaacactgaaatagcaaatataaaatgccattgtaaaatgagctctatttatgtgtgcatatagaagggagagaataacatgttgttagaaagatgaatgagatgaaagaataaaattaaattagtaattcaatttagtaaatactaattagtaaataagtaattacttatttacttattagtaaattagtaaataagtaaataaggaattagtaaataaggaagcaagacatttaaaaaataattttaaattaaatccttggcttacaagaaaatataagttgtttttaatcacaggaaaatacctgtatttgagaatactttttgacccagatttttattacattctgacaaggcaagctcaaatgtttaaaacatactgttacttctcatagctgactgatgcatgaaccacatcaggttacagaaaacgagtttcactatttggagcagatgtatctctctcaccctagtttccaggttgctgtcattttctaaattaccacattatgccctagatttaaatgtgttatgaaaaatctgccataagtataaaatgtaagctaatttttgcaattataaatgttatttcattagttgagatacattattggacaggaaaattattgtactgtctttttgttttctagagcacaattcacttagcaatttaggaaataatctcctttagaatagaatccattatggtaaatagttgacatcatttcaataagagaaagtaatgctaccaaagatgtatagattttctatattgactaagaaaaagtactctaaccaatgtcttgttatgtaacaactacattacttctgctcaattgtttgaaatgaaaatgtcactctgggatcccagcatactttaagaataagcagctctgcatctcagatcagctgcacacttaaaaatgcgctctccaagaatagcctgcagtctatgccaattgcaactaaacagacctggacatgtcactgttactgatgtgacacctgcctcagtgcccctgtttctgcattccttcacagcacttgcatccaggaagattcaagtccttctctcattctgatttattttgctgcaggattaataacaacaaacacatatggaatacttatttttatgacaggcactatctaaatgctttgtatatgtgaactcacataatcctcacttaatccctttgaggtaaaaactattattattctcatattacaattacagatgagaaaaccaaggcacagaaaactaaatgcattgctgaaagtcactcagccaaggagaaatggagccaatatttgaagttaggcagccgctgttcagagtccactctcctaagcattactctctgctgctttagacatagcatggccagagaaaacatgggacattcagttaactatcagtaaaatataaaccaccagggataggttacttttagcataaatatgttccaaatattacatagtgaatacctataccaaaaaaattttatttgaaattcaaatgtaactgagtgccctgtattttatttgctgaatctggcaaccccaggaagactgtcacttaccctgacttttctgaataatgttccttattccacatggtctacacaaccttcactagtggcttggcaattaccaaggctatctcctaatccatcaccctaggttgctttagctgcctgcaaaaatagcaacactttagagtaagttctcaatattgtagatcagtggttggcaaactttctctgaaaagagccagatagcaaatattttaggctttgtgggtcatacaatctctgttgcaactattaaactctgccaatgtagcaggaaattcatagacaatatatgaccaaatgagtgtggctttcttccaataaaactttatttacaaaaataggcagcaggctagatttggcccatgagcactaatttgctgattcctgctatagactcttctggcagattctgtgaggtgagttccctgtctgagaacaatcaacccaacctaaagacaccataggaacataagatctctctgcaagtcatcttctgtttagtgaaagaagtcttcagtgagaaattgctcttcagtatcttccaaaacagggcctcttcttttcaccatctgtggtagtttatcctcaatgatggccaccaagaatttttttcttgtatctgcatactattccttccttcaagaaatggagcctatttcccttcccctagattgtgtgctgaccctgtaattttcatcaaccaatgaaataaagcagaagtggcactgtatcagttcaaggcatagccattcagaggcttaacagcctctactttcactccgtgagagccctgagctaccatgacttctgcaagagatgctaagatgccatattgtcttaaaaagtacagcaaactcaacatttcctgtatgggctgaaatgtgttcccctgacttcaaacttatatgttgaagccctaaccctcagtaccccagaacttgactgtgtttggaggtaagggctttaaatatgtgatgaagttaaaatgaggctattagggtgagcactaatccaatctaactggtgtcccaataagaagagaaaatgtcaacacgcaaagaaacaccaggggctctcatgcaaagagaaaaggctatgtgaggacacagtgaaaagatggctatctgtatgccaaggagagaggcaagaaactaaacttgctggtattttgttcttggactttcagcctccagaactgtgagaaaataaatttatgttgtttaggccatctagtctgtgctattttgttatggcattccagcaaactaacacatatgccaaaccttcccaactacaacagtacaacttaatttggaatctgcttctcctttaatactatttagagcagtagtacataggactctggccttatattttgcttctatctgttgtccatttaaaatccagccactataatatacttgtagcatacacaaataaaaattccatatagattaataatctaaatgtgaaaatctaaagttttaagcttttagaagagataataacacataaattttatcatctcagcagagggaagaattcctaaaataactcactaataacacaagcattaatgaaaataatacatacaattgactatatcaaaataaaatatttgtgtgaaaaaatttaccataaacaaaatgaaaaaaagtcatatacttgaagaaaatatcagtaacacatataattgataaaggaacaatatgtggataatattaaaaactcatacaaataagaaataagattaaaaatccgattgaaaaataagcaaatctaataaattagaaatttagaatagtggaaatttaaatgtataataaaataaaactcatcccactagtaattcaggtattacagtattaaccacgtggtatactatttcaactaattagattaatgaataaacaaacaaaaataaagtgagacaaatccaggtactggtaaggatatagtttagcagaaatacacaatacactgttaaggagaaaataagatgtcaataaatacagtgaattttaaaatatgcatattctatgacccagcaactatactcttgacttaacaatagattatcaatttaattataaattgaaatgcctaaggagttttctatttatttcatctttaatacgagtacttaaaccctaccccaaaaacaaatgaataagaatctctgagggtgaggctcaagcaataatggaggtattgcaatctgcagccagtgtagagaaacacgtcctagaaaaaattccacatggatacacaaagtgacagctataatgatactcattgcaatatggtctgtcataggcaagaattgaaaacagaccaaatgtactttgccaggaagatggattaataacttggcatagtcacatatggaatataagagagtagttagaattaacaagttagattttcataatacaacaactaaataaacctaaaaacacagttttaaataaaagtacattattcagaactatatatctaagagtattagaaatttaaaatatgtaattagtacaatctattacttgcagctacctaacatacggggaaattttcaaaactttttgggagtgataaatactaaaaagtcatatagtataacactaattaattctgaagaaagagaggagggaaacattggggagaatgaatatcaagggagctttttgttttactatgtatttaagatgtcacttaaagtcaatactaaaaagaagcacatgtgtcaaattgttgagatttgattaaactgggtagtggtacatttgaaatatttcaaaagactgaaggaggaggtgaagaatggaagatggaataagacactttgaaagatgctaatctttggaaattgggccaaggataaatggtacttgaatcacaaaaattgaacataaagtcatttaattttattttttcatcatctatattgtttaaaaattttgtattttatctggagctcatcctgcatggagaatcacagtagaacttcaaactacatgccctaagaatgaactttttgggatctttcatactataacaccaagctccctaacaccagtgcctatgataactataaactacctaaactgagctcagtaaatttgcatgtctgtgtgtgtgtgtgtttgaaataatagtttgcaattaacatgtctagtaaaatcaaaattgtttgttcataggtgctttagcctatgccttctacctttaggtcacatttttggtgaaaagtcattcattgttttttaacatcataataaacttccccattcgtggtctttgttactcttgttattttgcatcttatggtctttatgttccatctgccttcccatcagaaatgttgatgcctcaataaaacctatttgcttcctagttggctggtgcttcttcgtttgcaacctagttggctggtgcctcttgttttgtaatattttaggttgatcatatttttgttactgaactttttttttttgagtcaaggtctctctttgtgcccaggctggagtgcagtggtgccatcttagctcactgcagcctcaaacccctgagctcaagtgatcctcccacctcggcctcccagatagctgagactataaccatgcaccaccacgacagctattttttaaaattttgtagagacaaggtctcactatgttgccctggctggtcttgaattcctgggttcacacaatcgtcccacctcagccttccaaagtactgagattacaggtgtgagccacagcacctggcctgtgactgatcttttgacattgtattgtaatcactgtttgcatcattggctcccagactaaattgtgaatcccctgagagcaagaaccatggttgcttcttgcgcaggatgccttcatctgctgctcgcagatacccaggagccaagatgaattttcttctttggccaacctgaatattcagaagtgtcttgtgaatgccccctcaagtcagctcccacctacttttcattagtttattcacttttttagggcaacttatattttgtccacttctccttgctttttctttcataggcatttttgtgacctttcctttgtcttattccaaaatgttaactctagttcctacgataagctctctgagttctgaaactccatagaacttgctcataatctcagatcatgcgttcattatagcagttatgtctttatatactcatgtttgatctctctttctagaggacagaatcctcccctttcccccgcatatcctcaatgatccagcatttctcaaagtgccaccctgaccacgtgcatcgaaataacctgagggtatttttcataaaacatatttatagcatcctttccagaatctccaggtccagaatctcaactttgcatattaacaagtaatctaggagatggctataaaacacaattagcatacaggataaaaggaaataactaaccttttaaaactatttatttttgttccaagggttttctacattttagcagatttaatgaaaaaggtattactatcctgaatttatagatgagaaattgagaattagaaagtgtgaaacatagtctttggaggatggccagggtttaaatctctaattaattactcaacagctatgtgaattagggtcaagttaccaacatttctgtgcttcagtttcttctttcaaagtaggaataaaaatggcagctatcttgtgcaagtgttaggagggctaaatgagatgagaaagctgtgagaaaaatgccgaacacatgatagtcctcagcaaatcttagcttgtgagactactgaatcccacactaagcgatagtggaattggggtttatcttggaccaggactcggaaacttattttaaaggactagagagtaaatatgttaggctttgcaggttacatagtctgtcttaagtactcaacttcaatcctgtatcaggaaagcagccattgacaaaatgtaaaaaaaagaaaaaaaaagaaagaaagaaaatccgtgtggatatatccccataaacttcatttatggtgagaaatttatgcattgatgtactcttcttaggagttactagccccttaaagccatgagtttgtaattatccttctttttataatcatgcaatttattacctatttcctgctaggtattacaaaattctgagctagccacaggcactttgcttaatcaaatattcataaactaaaaaaaactttatttatggacactaaaatttgaatttcatataacattcacatcattaaatgttgccatgattttttaaatcattaaataatacaaaaaaagtattcttagctcccaggccattcaaaaacaagtagttggccatatttggacagaagactatagtctgcagaacccctaccttcacatatcagatttgaaagcttttgatacctcatagttgcctactaaaccttgaatgcaatggctattcagttatttaattggttaatacaagatgatttccaaggtttctgctcagtatctgaatgccagaaagaaattattaaagtggaatcccttatcacttcttggttttgtatcctttgaaactacttaaattctatctcaacttttaatttgttaatcccctcgtcttcctacctgcatcagccccttttcctgttatgctcaaatccacatccaaaaatcaagatgatgatgcattataattacctttataactttgtcaatcactttttctcgccttcaattaatccacaaaagagaacttttagagactaagtctggcattgtctaatcggactggagatttgcttcttttaggcatattgattgtacagcttgccccactttttgagatatccttccattaaattctagtcaagacattaaaagcaggatctgctggcaacaattactggtgaaaccagcataatataataaaaagcttatatgtaggatgaataagtataaagatccaatgtataacataaagactaaagttgataaagttgtattttattagggattgttgttaatcaagtagattttagctgctcttgtcaccttaaaaagtaactgtgaaataatagatatgatagtctgcttcattactataaccattttgccatctatatgtatcctataacatcatgttgtaagcctcaaacgtatacaataaaatttatgttttcaaaaaagtcttatgaattaatttagtactatgtaacccatactggggaatggacagacagagggatagaacattaacaagacatatggttgccagaacatcatttggctattgttagtccatttaaataatatttggataattctaggttaattattaaatacagatgtgattgagacacttaaatgtaacagtacacaaaagattacaattagttctgaggcagaaaaaaaatgcagcgacaccttaacaagtcagatatgacacacattttaaaaataaacttcagaactagaccttggggcactcttgacgtccccacagccctgcgcccctcgtcccttttcatgtctcctggaggtcggcaagctgcagttgcagcaatctcatttaaatttaggtagttgaattttttagaattaagttttatatgttttgagcaataaattgtcttaagatatatattttaggttacttccaagatggccaaataggaacagctccagtctacagctcccagtaagattgacgcagaagatgggtgatttctgcatttccaactgaggtacttggttcatctcattgggactggttggacagtgggtgcagcccatggagggtgagccaaagcagggaggggtgttgcctcacccggaaagtgcaaggggtagggggatttccctttcctagccaagggaagccatgagtgacttacctggaggaacggtacactcctgcccaaatactgcacttttcccatggtcttcgcaaccagcagaccagatttcctcccatgcctggcttggcaggtcccatgcccacagagccttgctcactgctatgtcagcagtctgagatcaacctgggaagctggagcttggcagggggaggggcatctgccattgctgaggttgagtaggcagttctatgctcacagtgtaaacaaagccacagggaagcccaaactgggtggagcccactgcagctcagcaaggcctactgcctctctagattccacctctgggggcagggcatatctgaacaaaaggcagcagacagcttctgcagacttaaacatccctgcctgacagctctgaagagaacagtggttctcccagcacagcgttcgagctccaataatggacagactgcctcctccagtgggtccctgacccctgtgtagcctgactgggagacacttcccagtaggggccaacagacacctcatacaggcaggtgcccctcttggacaaagcttccagaggaagggtcaggcaacattatttgctattctgcagcctccgctggtgatacccaggcaaacagggtctggagtggacctccagcaaactccaacagacctgcagctgaggggcctgtgtgttagaaggaaaactaacaaacagaaaggaacaccatcaacatcaacaaaaaggacatccacaccaagaccccatccgtaggtcaccaacatcgaagaccaaaggtagataaaaccacaaagatggggagaaaccagagcagaaagactgaaaattccaaaaaccagaacacctgttctcctccaaaggaacacaactcctcaccagcaagggaaaaaaactggagaatgagtttgatgagttgacagaagtaggcttcaaaaggtcagtaataacaaacttctccgagctaaaggagcatgttctaacccatggcaagcaagctaaaaacctggaaaaaaggttagatgaatggctaactagaataaccagtgtggagaagtgtttaaatgacctgatggagctgaaaaccagttcgagaactttgtgaagcatacacaagcttcaatagctgactcaatcaagtggaagaaaggatatcagtgattgaagatcaaattaatgaaataaagtgagaagacaagattagagaaaaaagagtgaaaataactagacattttttaagttgaatgtcagcttttcctcttattttagagaaaagatgagggtacacttttccatgaacaatctgaatctctgcttctctgggagcattgtgctgtcatttcagcagtgccattaccaacccattaataggtcttttgattaaacttctgtccctgaaaattcccagtgcatcatccaaaaatcaaaagccaggatgattttatacctctgaaatatcttgattttgttagcacagaatatttaaaaatggcctctgcctgtctcattagacatagccttaaatgagtagcttttatatgataatcataatgaatactaaaacctcagcaaggaattataaatacacctatgtctttttcttcacattttcatccaatgtaatagaaggattaccaagaaaaacactgaaatcaacatttaaaaatttccttttcacggcattccttctgtagtctaaaaatcactgggctaggactcaaggcctaaattcaaatcattgttccatctcctgttgggccctcatttactatgtttttatggggtgaccaactttaagtgttattattgatatcctagaatattttgtgataccttcattaagcacctcatcttaacatatggagtaataattcctctactcattttccctagtcatgttacttacctatgaataatcttctgtactcccctgactttctgtccttctgtctaattaaagagcaggtaaaggaagtgttcctgaatgatactaggcagaaaggatgccggactcaacatttaggctgatagatgtaaaaaaaaaaattagaggtggagtttgttattctcagtcctgactgaatgccatctgggtcaagatggaagaacagaaacaataaataggccaataaatattccaaatcctaacgtcctctgcagaactttttcctgaattaactttattttgaccaaaagtgtcttatcctctagacacatggccacagctcctcaattcatcctgctcaattaaccaagcatctgcctacaataagcacaatacagatgacatttacttcaataccttgaattatagttgaatcaaccataatctctgaatcttcaggggcaaaaattatgtttgtttcatctttgcattcatgtcatattcattgacatatcattgatcatcaaaaacattttgttggctgaatgaataaacatatcagctcacccattcagaccaataaaaactatttgactgactaattcatgatttgactgaactgccttgctggcttgattatttttccctaaacaagtcagacagagtgttttgatctggtgtgcgtatttagacaaagactcagaagatctgagctagtctctggcccattctaaggagtactggatcatgcctaacactgtgtctacttctctcaaattcatattccttaccattattacaaagttaataacgggaatacaaaacagatcattacatttcctgcaggcataataaaggtgcctattttcatgcctgtaggcaggtaactaattactatttcatttttcttctgagttcttcaaaatataccataggctttactttattggtttttggtttccttgttacagacaaaatgtttcagtagcatggatggaatgaaatttgcccaaggacaggcattagaactcaggtgtcctggttttcaattcaatgtttcttcctacttaaaaaaaaaaaaataggaaaaatctgctttttctacaaccagagatgcctgaaataaaacagtggattttttaaaattttatttgaacaattgtgctaagctgagaaattattatacgtggaggctcatgattcctttaaatttcaaaatgatttcaggtttctcaatatttataaaactggcattattattctcctcttgctttttaaataacaggccaaacaaaacataagattatctctctccatcgacagattatatgaccctttctaggaaacataaatccataataatcaattaatgctaatattgtaactttgcatagagctttgtttgttataagtaatacaaaagtattaaacataagggtatagtcaccatggtttatttatacatatggcaaaagagaaccatatacatataaataaacccctgtgaccaagacatagctgacatatcgtagctaaaccaaactgctattttgagccttgtctttttctgacataatccaggtttgacaaatgaccagatttattcacaggacttagttttgtttcagaagagcaaaacatcttcaaaatgatatattggcatgttttcagaaactacagactaaaattgaaatttataaattaataaattactgttttataaatcttacattttccaagaaatgatttaccaggatgttgaggatctggaatccctcatacaatgacactttcattgtcatattttaacctctaaaaacatatcctatttcagctatgcagatttgaagatggtcacttagtattctgccttatttttagaataagtttcagtaagtttcttcagggatgctagccataaatatatacttcaaagtcactgctattgattaagaaacataacgtcttatcagaaagaatagtatgaggctgtcatccaagaagaacttttcacaaactaacattccacaaaaattggagccaaactgtgaaccaaccacctgaatccaggtggatccagcttacaaagtcactgcttggctcttgctgccttctcagcactgtctgctttctgtttcctccatatggagttaataagtgctagctagtaaattctggatgcaaatcagagtaagaggagattatttttcaccttgagcagaagcatattcagtaggaagccagtaggtattctgacacaccacgatattataacttgtccaacctttattagggcacccagagcatccagctctgactggaattagctgtgtgaccttggattgatcacataatttatctgaacagtttatccatctttttctatgcataataatgcctacttcctcacagaattgtgttattaatgcagtgagctaatgcagatgtgatctgagatatccccttatcgactaagacagatccgaaagttagggaaacaaaacttacttacaggtggagagttcagggctcagctggtatggtaaattcctaaattcctaaggctataagaaaagtcacactcttgctaaactccccacaaataggagctatcagacccctcctagttcttatatacaacccagattgctacaattatgatgcttggacagagaactggccttacaaacagtcctttctgataagcaactaaagatcttaagacagtttcagccaacttattgaggctctccacgaactgcacattttagtgctaaaaccctgccccaaagtgaacataggacatgcattacatatatgtttacccattgcacgtgcacttggctgccatcatgaatatgtatagcttttcccccaaatctactgaatgtatatgattctattgtgtgatacaggccctgtgaggcatgaaaacccaaactgccccttccctccttgaagagaaatcaccttccagcacctgctggagattgtctcttcccagtttgcaaacagttattgccaaataaagctctcttttctactgtttagccatcctggtggtcttttggacaacacaggtaaaactgctgtacaaggataaaggtgttatgcaaacatctaggtgatagtttcctacagaatactgggttcagtttccacatatatccctcaagagaaagtgaaagaatacagaaattaaaagctctgtgataactttgacattttctaatgtaatatatttctttcataaacaaagaaacagagacccagagtgattaaattctttatctaaaaatcacagaactctacagtggtataactgacagtaaaatgcaaatcctttgatgcccacatcaatgcttggttaagatagctcatcctagcctcatagtccagcatactttgtttccaaaatattgacatatttttgtaacaataaactatccttcatatagcttctctgacatttgataggaataaagtcaacttcataagcaaattaaaatcaagaaatgtgttgtacataataaatacaattttatttgtcaattaaaaattaattttaaaagagaaatgatggaattcgggcaccaaaagaaaagggagagattaaaaaagggtagttaaaagtttatcagaatacaagtactactgcatcacttttcagaaacacaacaaaatacaagatcagtacaaagaaatgctcttctctaagttgtagccaacagatgacttacagaatttgtttttcttatctttgtggatcatgataaaaatttatttattcagcctgtaaaaagagagatacctaaagtatatgaggaaggcagtcattatctttttaattctgtgagtttctgcccagaggtacttcccactcctacatatacacataggagtatagtgaggggactaaatatatggggagattttcagtacagctatcctgttagtctcccttctgtctctcccacagtaaataaaacacaaatgctattatgtttctttatcaacacaaatatatctagagcaactaacaaaaatagtctataatactggagatattttttcctttggtggcatgagatcgtttttaaatgttttcttttcctcactttttcttttccctagataataccttctgttcaagtatgtgattccatgtcttaaaatacagagattataccatgtgattctttaattattaatttgtttgttatagtgttaataatacccaggccagagatattcaaacaattccatgctgccagtataagcataggaagtgatacattctctaaattgatttatacccagaaacataatgtgagcaattcagtaaatcccactgggaattctgaagctaagcttttgattgtcaatatgtcttagaaacaagagttttcatatcatctattaaaatatcatgtaaacatcaatgaaagtaaatattatacagtctaaatttttccaaacaatagaatgagagaatatttttgtagacctttaagtcatacttcaatattttagataagattaaaatagtctattttagccagaaatttaagccacataattacaaatttagcactcacatattaaacaaaggaagtggttaatacatttgctgttttacattaaacatgcaacttaattcaagtaaattgaaaaatgtacattttaatgtcatcagtcaattttccaggtcatttcatttctaacatctttcttagtgacatttgtgttactctgtcttgtttgtcatctacacatttatctcaaaggtgatattctggcataggagagagtgtgcagactgtgggaggaaacatatttgagtttaaatcacagacctaacacttagtaatggtgttaccttgaaatacaatgtttcataggtgttacctaagaaatacaatgttactctatttcattgagcttcagtttcacatcttgaaatggggataaactaccaatttcccagatttgttgtgagaattacatgacatgaaacactgaccacagcatctgacaaaacctacataaaggtgctcagtagggggaaccataattgttacctccttcactgtgtcatgtcatgggcgttaaaggatgataccttgttccttgttggaccagctaaactcatagcatgtcacctttctaaataatggttaaattgaatacaattaagcttctcagctgacagagttaaagtactctagagttatattggttaagaagaaaatgttagaacaaaatagagaaacacaaaaacacgaaagagaaaacactacttaccaataataccaaaagtaaaagtacaaacttgctaaaagcaaaaggaagtaacatatataaactcaggtatatcatttttgcctacacatttaacagacattttctaaaattataaaacacaaaataaatgaaactatgacaaagtagacacacacacagtgctagggacatatggtcaagccttctaaaaaacaagttgaaggttttatatatatatatatatatatatatatatacatagagagagagaatgtgtatatatgtgtatatatagagagagaatgtgtgtgtatatatgtgtatatatagaggatgtgtgtgtatatatgcatatatacatagagagagaatgtgtgtgtatatatgtgtatatatagagagagagaatgtgtgtatatatgtgtatatatagagagaggatgtgtgtgtatatatgtatatatatatagagagagaatgtgtgtgtgtatatatagagagagagaatgtatgtatatatgtgtatatatagaggatgtgtgtgtatatatatagaatgtgtgtgtacatatgtatacatatatacacacatatatatacatatatcacacacacaatatgacataaatgctgtgctagcaaattttatgtgtactgtttgaatcatgggatgcccagatatctggttaaacattaattctgggtgtgtctgtgaggatgtttctgggagattagcattgaattggcagactaaataaagagaattgtcctccccaatgtgggcaggcactatccagtccactgcagatctgaatggaacaaaaagatagaggaagggaagattctctagttttctgcctgactgcttgagcttcaggtgctgccagtgcttctagtttgcaggccctcagattcagactggaatttacaccactgactctcgggctctcatgctttcaaagtacaacactggcttttctgcgtttccagctagcagatggcagattgtggcacttctcagcttccataaatcatgtgaaccaataccttataataaatctctgtgtgtgtgtgtgtgtgtgtgtgtgtgtgtgtgtgtgtgtgatttgtgtgtgtgtcccactggttgcgcttctctggagaagcctgactgatacaaatatcttcagacttttgacctattatctaacattttgaattattctctaagcttttctaacattttatttctaaaatttgaaaactgttatattaatggaaaatctccctcaatgcataaattgtcacacaaaggtgataataacttatgcccaacaatggaagaatggtacagtaaatttttcattattcattgattatatatttaatgaaacttacatttttcagaagccattttaagggctacgaatacaatagtaaataaggcagagaagtccctgctgtcatggaacttatattttcaaagagaaaagatagaaattatataagtaaaattatttattataggactaattactgtgaatgtaattattttgtgaaggataatatgatagaaagttggggacaaggaggaagactaatatagattaaatgatttaggaaggttatgtttgatttgagacttgaataacagtcaactaggctgctctgtgaagttctctagaatacaacacaatcatagaaaatcatagaaaatatacagaaaatggcataagcactttttagaactataaaaaattcattcttatgtagaaaaaatgcattaaaatggcaaaagtagtgatatcaatatgatgaaggtatgggtaatttttcctttatttacattttttagtctaaaattatattattttatgttaaaaatggaaaaaatgaaaatataattaagcataccaaagaaaaagtcacaaatctcatcaacaacacttttcatatcagagtaccttgtatatagcattttaggcaaatacatatttattacacattgtttttaattatagtatagtaattataaatacataaacaaataataaatagaatcatcaaatatcttattagtcattattaatcctgttaagatgttgttagctgattttccttctcttgctattctactccaaattcccacaattatcctctaaaacactaacaacaaatacatcataatttgcatcctgtacttgtgaatatttcatcaacatcaccttctggaaaggcatcttgcaagaaagcaataagtgcactttcaagatgatctctcccacacatatgtcatttcacatctactctctattcctctcttgctgctacaccaaaaatattggaaataaaaatatcagattcttacgaacatgcataaacctacagggcatgtctgtcagaatatcctcacgtataggttacagcctgtctaacgtctgttcaaaaaaaaaatgcaattagtttctggaggtccaaagtcaaatacattgtcttagaaagtagttttagagcaagccacaaagctctctacttggtaatttaaatgactgaccgctcaatttatgagcattcccagcaataaaattcagcctgaacttactaatagcacattttatatgacaacgatgacaattacaacctatagttactgcagtcgccctttggtctagggaaaaatgacagtattaattatacacacttgccatttatcagacttaagttggcaggtgattgagctcagcaccatctctaacttgacttctacatttaccattttctaatccactgaaacgaagataattagaatagagaaaaatgagtggctccttctttcactgcctttatctctgatttcttatacagtatagttctttttttttttaatttctacagcaacacaattgttttattgatatgcttcatttgaatgtttactgtatattcaaatcttgatattaaattacaacttccagttacaatgaactggaagataaaatcaatcaaaaaagtaatttgataatatatgtttatgatccatttattgtgaagctcagaaacaaaagaaaaatctgccattgtggatacaattatgtaatagatcagtaatcttacctgtttttaaaatatataactttaataaaattgacttgattctctctcttaactgagaaagttactgacaattaaaatacctagtcattcataatggaggaatagaaagagctaaatgtgactaatatagagacagtggaaaggcaaataaagctactgagataggaaggagtagtaaatgtgagggctcttacatatgccgtagtacaggattagaatctcattaaatgaagagttaataaagggctttaaatgaggggtgataaaatcttagcaactctgcattgaaaaaaaaaaagaatcaaactttacactccccaaattcagctcaatttcagtaatatatgtaacataccaaaatttccaaagggaatccccacattccaaaaactttcaagttttattaaagaacaataaaacatcctcatatttaaatagtaggattttatgcttcttttttttttatagtatgtcataataataaattttcatttttaattttcatgaatctatagtaggtatatgtatttatagggtacatgacatgttcttgaatcatattaaatttatgccactttgtttaaaatcttgccattgtttactttctaaactccataacaaaaggtataatatttcatactgtagcaaggtgtcctgtagcacacaaaattttggctgtatgcaactttcacatttttattttataacttatttttatgtttggtctatttggggatcttgggtccttgttacatgattttcacttctactttatgttaccagtatattgagaactaaaattattttaaaacacggaaagctatctaaaaggcttgctgtctattttaggacataaaaatgtctcttgaacggttgtatttttattcaagcacgtctttataatttttatttaatcaggtatctgtcttattcaagcttcctttttttggcctctatgggcttttcagatacacagtatgccatttaagatttatgacgattataaaatcatgcttatctgcttctgtgttcagggctctacaacctcttctcagaaggcttaaagaattcctacttactgaactcttttagatgcattccttctgaatcttcacaaaactctaagaaatattatccctgcttttgaataagaaaaaattggggcttagaaagtttaagcaacagtgacacctgaaattagtccagaataagcaaccaaaaggtgtggctagaggtgtcataaaggtatagataagcagggaccctcaaccactgctatttctttctgaccctgtaattaccagtccaaagcacctgacaggataataccaatccagagaaaaccaaataggtaggtcttacagatttcccatttataaaggcagtatgttatactgaaaaattaattataagtatagtggagagtatggtctgacttatatctggaatctaaaaaagttgaatgcagaaacagagaatagaatgctggtttccatgggctaggcggttggaagaaatgaggagatgtttgtcaaaggacactaactttcagttatgagatgaataagctctagggatctaatgtacagcatggtgactacagttaataacactgtattgcgtactcgaaatttgctaaaaatgtttaaatattcttaaatattcttaccacaaaaaaagggtaaccatgtgaggtgatcaatgtgttaacttacctgattgtggtaataattgtaatatatatatatatatatatatatatatatatatatacacacacacaccaagtcatcacattgtacacctgacataccatattatttgtcaattatgcctcaataaagctggaagttttttttaaaatacatatattcaagaaaactgggaccagaactaattctatagttgcttcccacaaaatctttgggaagattaacttaatatccttgtacctcagtttcttcattcacaaaagtgataggattgaattatacatcctataaagtctctttatttcttcagttcttaatgcgactgtgaaatcctatactgaagtatgcagaaaggggatattttcttaaaactttaatcagtaggagccctactcctatgttaaagttgccagtggcagagttttcacaatgtaagcagcaggactcgatcttaaatttttaatagtgtgaaaactggcacgggagacagaggtgtgccctaaaccactcctgcattgttgaggtaggttgaatctgtttgggggactggtcttgtcctttttctgagaaggactaattagttgagcattttggttaggcatatgtaagaaattccttatacaattttttgaggaaaatttaaaccagtgaatatggcagactgccacagttactacttgagattgtcactacgacagatactactgttactacttgagaccatcattacaagactgaacgaagggggactaacgcagaaatgaaaacttaacacaaaagaaattgttttaaaaaggggggccaggggaagaagaagagagctcccttcttctagtgagcaaaggcagccgcctgagcctctacagccccttgtatttattggatagaaagagcagggaggaggaggtaactattggtcagctgcttgatcgatcacaggttcacatgattgctaacaggcttcagatttgcctaatcacaagaaacacttgtgcctgggttgtgactaccctcagcattccttctgggcaggagatgcagtttgtcagtttgccagcgccctgctttcatgagaacagttttctgtttattcatatagcctccagtggtatactgagttgatcacgaccctcactcttttggcctgcagcaagtgaagtagctaactgtagatgcttcagattaagattttaggtatattctgtttaaactctgtacaggcaaatcttctcttttgtatgactgtgactttagataaaattgtccctgaaaatatcgtttgttctgggaacagacatgaatgcacagaaggcatgcatgttggttcccacattctgtgcatacataaacaagacacacatgcacagaaggcatctttacagaagaacataccttccttgaacatatgggctttcaaggagttgtgagaccagagtcagaagggacttcaaggcttttttttctcttcacttcacatcaaaggtagaataaaaggccaagttagtgtattctgtttagtagattttgagtgaagagcacaaccttttagaaggtcctattgattttgcctagaacttggagaacagagtctaatatctctataattccctatgataggcagaataatgccccccacaaagatgtctacttcataactcctgaaagctgtgactgttacatggcaaaagggacttagcagatatgattaagctaaaaatcttgagtaggagagattatccttgctctgagatcaaaaatagcagagcataggtaccaaagtgagaaacttcaaaattaaggtttccccatcctgggaaagattcctaccacatggcatccggccagaggttaggtcccttttttttttttctgttccaccaagactacagtaaagttttgggaaacaccaaagggaattgagaaagcaacaaacgctgtaaatacatcgtgaggtatacgagagttatccagagaaacaaagacaatgggatatatagacattgatattgatacagataaaatgagaaattggttggcataattatgaaggttgaggagccccacaatctggttgtctgaaagctggagacccaggaaagtttggtggtgtagttcagtcccagtccaaaggcatgagaatgaggagagttgatggcataaatctgagttcaaggaaggagaagaccaatatcccaactcaaaaagtcagtcataaaagggaaaattttcccttcctctgtctcttggcaaacttttattagatcggatgatgcccacccatgctggagcagattcaattaaatagttattgtgtcacctggtggaagcattcctccctatggaaccaaaacctctaggccaacagagcatataacaaagtcatgagaaaacagaaagcaaaaaagttgctagtgggtaactaggaataatagtggtgccactctcatttccaccccttgatgcccggttcagtgaattctagttaggggagaaattgtaccatacattggatcttgattcagagcatatatagcctactggagaagcttgccccagtcctgcaaaataacatcacccagtgggtgctgtgagtcttcaaaaggctttctactgctctgtcaaatcagctgctttaggatggtggggaacatgtaaagaccagtgaattccaataacaaatatatggactcaacatagatgtccatcaacagtgaactggataaagaaaatgtgctaatatgttaggggtagaaggtatccaattcacatggcaccaaaatgttagacgtggtgaatatcagaatgactgatgggtctgaagcaacctcaattcttgcctcctctgaagaaacaattcaataaggggcataaggcagaaaaagagactgaggcaagtttcagagcaggagtggaagtttattaagaagctttagagaaggaaagtacacttggaagagacccaagtgggtgacttgaaggacaagtgccccatttaaccttgatcctaggactttatatgctggcccacttctggcatctcacgcccctttcccttcattcttctctaagagtgaccacccacaatgagcttgggaggtgagcatgtgcagtgtatttaggaagctgtacacatacccaactgaggctttcttcccttttctggtggaatgcctccagtaggtcatactctaccattttatctcttaatgtgcaagcctgagctcacttgtcaaattactgagatttttattgaaagttgattaccaatttcaagtgtttttatctgtttcagaaattgcttctccctggtgcctgcaattaattatcactttagtgtgacaactgtggaccatcaggaaattgcatctgcctggtgctggctgcctattatcatttttagagaggcagtgtgataattgtcaaaccatcattggtcgcctaacattgatggtcacctgacattcctgttgggtgtgcagggtgccctctgctcatgcctaactacctgtaacacatacaccatggaatactacccagtcataaaaaaagtgagatcatatcctttgcagcaacgatggagttagaggccattattgtaagtaagaaaatgcaagaacagaaaaccaaataccaaatgttattacttataagtgggagctaaacactgaagacacaaaacacaatgaagggaacaataaacactagtgcctatttgagggtagagagttggaggaaggtagggatggaaaaactacctttcaggtactatgctcactacctgggtaatgaaataatctctacaccaaatccccataacacacaatttacccatgttacaaacctgcacatgtgccccctgaacctaaaataaaagttgaaaagaaaaaaaaaaagaccagtgaattccataagtatgggtccattaccatacttcttttgctgtgaagttccttgatcagaagtaatgcgatgtgaaataaccatggaggtagataaggaatctttttaagttcacagatggtggttctgttagaaacattgcatgcaaaaaaggcaagtccatacccagagtaagtgtctattccagtaagaacaaaagtctgccccttccatggatagaagcagtccaatataaacaattcgtcatgagatagctggctgatcactgtggaaattgatgccatactggagactcattgttggtctccgctgctggcagattcagcactcagccatggtcatagccaagtcaaccttggttagtggaagtccaggttgctgaggccgtacataacctctgtctctgccatcatgaccactttcttcataagctcattgggtaatgacacggtggcttgggaaacagagcaaaaccaattgtcctatacaaataggcattccataagtgaaagaaaaggacaattattattacttctttttttgcataaaagggaaagagacagttgtctccttcttctccataatggcttccttaaaaatataatgagcctgagtctttacctccaccctttggtatctaaataaaatctctctaggagccagatactcccatttgtctcaggttttgtgacctgacaacgtctccaaggtctgaaagttcatttttttctgaaatacaaatacccataaagatagctttttagtccctcaggcaccctgaggattaacctagggaccagtcccagctgtaactatttagcctgcatagaagatataaaaggtattataattttttgagatcagagcagttaactagacaaatggctacaatctaattattatggtatatgaaaagtaaaatacttctgagggacatgaacacaaatactccctacttattttatacacatttccatgtctcaggtagctagggttttttgcagaagcactgagaaatccaagcaattttttatttttccaccattttctacccctagcctgcatctgtttgtttttaattttaggtttgggagtatgtgtgaagatttgtcacatacataaacacatgtcggcggtggggagttgttgtacatatcattacatcacccaggtacccaggtattaagctcagtacccaatagttattttttctgctagtctcctccttcctgccaccccccggccccaagtagaccccagtgtctgttattttcttcttggtgttcataagttcttatcatttagctctcacttataagtgagaacatgcagtatttggttttctgttcctatgttagtttgccaaggatgatagcttccagctccatccctgtttccacaaaagacatgatctcattcttttttatggctgcataatattccatgatgtatatgcaccacattttctttatccaatccgtcattgatgggcatttaggttgattccatgtctttgctattgtgaacagtgctgaaatgaacattcacatgcatatctttatggcagaatcctagactgcatctgaatcacctgaagggcctgtgaaaattcagactgctattccctcctgacccccaagcacaaacttctaattcagcaattcagaggtggtgtctgagaacctgtatttccaccaagctctcaggtcatgctgatgctgcttgtcaaggaccacactttgaaaactacttatttataccagtcataagtggcttcaggtttcatggagactgaaatttataaaaacttaagagccacatttagtttataaatgcaaggctagatttaggaaccgaaatgggcctttgcaaatcaggtaccataaagctttgactccattactccacagtaaatgttctgacaatgatgaaatacaatagaggctttaaaaattacctaatttacataaattttgtagatatacctgagattcattttgacaacataaataggaaataataacattcatgaaataaccactcatttacttgaagaattttaaagaaattatgaatgagaatcatcttgctctttagtaaacaaatgagagacagatctttatctttggtcaatggaattttcctgattgtacagtgtctaaaaatatttacacatcattggctggaaaactattacactggcatagaagaaatatcagcagctagtggctcaattgagggcacttgaatcttattcacagtatgaccatgcccaaaatattgaccttttatgaagctatatttcttttcactataaccaggctcaaatactattttagaataacaacattcaacaagcggttttgagctttcagtttaccagtgtgagcttctaacatacccccattttctaaaaatgaaagatgaaaaaaagctgtatgtcattttccccaaaatggtctctcttacataagaagaaaagatcatagaaatcattctttaaatcatttatgtttttaattttagaggccagttaaaacagaaagaaaaatgtattgaaatatgtactggtatttatattatttttaaaagcatatttaacatgtcttctaataaatcccaaccattctacagaaggtctcaaaatgtctttatacttgtaaaaatatcagctgaaaaatcagcttttttttttttcctgcccaggtctcagaaaaatgtcttgcaaaaaacaagctaacctcacctcttcaaatgtttcctgccaaccccattgatttcatggagggcccctgggttcggagaataaaaagcaacccagatggttttaaaaagtatgggatctgactttaaagtgtctaaattagatgagtgagatgcatcctaccctctacactgaacaaagaacaaatcaacacaaccatttcatgaaacttcaaaagcctgcagctttcactcaagctacaggttttcccactacagaatgaaagctacatgtgtccagttatggcagagttctagaataagaaatggacagaaaaatcaatttattgaacactctgacccaactttgaagtgcaatgtagcaaaagcattttagtacaaacctataacaaaggtctctgatcagcctacagaatgtctttgggtgtaataaggagcaaaacggaaggggatcaggaattagtgattatctgactggtttgacctacacagatgtcccagattttaatccaagccagagttaagctgtttgggtttttattttttatctgaaaaattctcccccatgaaaacagaggcagatatattcttgtgattattttctgcccactaagattacgtggttttaaagtcctttcaaacagtgattgaactggttgtcccggtaaacacactcagactgtgagcatccccatcagacctgaacttcctcagaggttaagattatattttattaatctatctaaaggacttcatatttcctggcacacaaatgggggagagtaattatttaaaacatgaataagtaaatacataaaatattgactaaattagaatgagaagagtaacatgcatataaaattttaaaattccagaataggttttttttcagaatggttgacaaataaatgttgtatctatacacagtggaatattattcagccatttaaagaatgaaatcctgtcatttgcaactacacagatagaactggaagatattatgttaaataagccaggcacagaaaaacaaattttgcattttcccactcatatgtaggagataagcttttttataaaatttgaactcaaggaggtggagagtagaatgatggttagcaggggctgggaaggagggcagggagaaagggataaagtggggatacttaataagtacaaaaatatagtcagacagaatgaaaaaaatctagcattcgattgcacaatagggtggctatagttgataacaatttattttatattttaaagtaactaaaagagtggaattggaatgttcctaacatgaagaaataataaatgcttgaggcttgaggtgatgaatacctcaattacccttatttgatcgttaaacattatatggctgtgtcaaaacatcacatgtagcccatatatatatatatatgtgtgtgtgtgtgtgtgtgtgtgtgtgtgtgtgtgtgtgtgtatatatatatatatataactattacatgccagaataattaaaaagtaaaattaaaaaaaaatgaaacataagttccagaacagtggaagatgatcaggataagttctctagtctctgatttttattattctaataatcaatctgaggccccttcaattgcagtcataggcccgggaaaatgaaaaagggagtaagagttgatatgcaattgggatgtaacaaaacaagttcatttgtttgcatgttggttaaaatccttgtaagcatttctcaaccccagacatttctacggatttatcttaaagtgagtttgctgtatactttttacctcagtatcttgaaccaaaaaatattcttaaaatgtcccggttgggactgacaaactcattttccattcaaaaggtgtgaagtttttatgtatgcacagacgtatttgcacatacatacacacacatacatacatacatacatgcatagttgaggttaagaaacaaacatgagagagaaaagggaatagaaataaacaaacaaatagaattttaaaacaagggaattttgaaagactcactgagaaaagtttcctttattatgccttagattaataataataataaggtagtttattccagggtttataatattataaatttcagaaaaacctggggctctatagttggatccgaaaaagcatccttactataaaaagcataatcagtgttcactggagtagtctgctattaaaaacaatttgagacttgcatttctatgatcattatgaaaaacagactaaaaacaaatattaagaaatactttattggtctgacctcaactgattttcttacttggtgcttctgagaagtatttatttatttatttagctatttattgctatgtgtatttgaacaaggtgtctccaaatatttacgaagaaaagcaatttagatttgttttgttttattctttggtaaatatagatgtatcttcataatgaagtattagaatattagttggcataaagaaatgtaatcagcattaactaaggatttgatattctcattgctacctaaccaaatgtttactgtctgactttgaacgtcttggtgtgtgttgattcagtaagattctagtgccttggcaagtagagaactgttggaaaccacacagtctgtatgtcagtcttttacaattgatacaaatagggccttccttacccaagagaaaatttaagtatcatttgtgatactttatgatgttctcataatatgcatgcagtactttaatgggattaatttaagggatttgtttttagttttacacttatcttaagttgtgttataaagtatgcattttcagagagataatcataattaaaagtttaaggcataatcatgatcaaaaacacttttggtataagaagaatactggataaaaattaagagaaaaaatatgaaacagaaaaactctttgttttcataaacccatacagctttctaaggagagttgaccttagtaatgaaaagattatttttttgttgaacacggagctggataagaatttcataggtgggataaattgttctctataataagaaagcagaatttccaatgccctggagaaatccaggaggcaaagatgctgaagcccagggagccaagatacccttctcccacatactctatcccatctcctcccctaacacacctgccatatgatgtgtgggagttaaaagagattttgaagagcaaaaggattttaagccattttctatgtgatacatgatataaacctccttgtctatatcatcatcagaaaataacacatttcgcaattaatgttcccattttattggtttctctgggggtatcccagagtggaattgaggtggcctttgacctctaagttttatgtgtattacagaaactcttacttgattttttattaaaagaaactggttataaattactaatagccatgtaacagatgtaaacatgcttgagccttacctgacatttaattgaatattgtgaacatgtataaacatactcaagtgtacacataccaaattttttaaaagaccaatgcaaagtgacaaacttaataattcatatcaccatgcacaagttcaactatatgcataggaagggcaggagaaatttcattccaaggtctgggcaatgtcaaagtaacctgtcagaacttcttaatgcattgatagtttccaatgtgtaaaactgtgatatatcaattttaggtctctctattttaaaatgatttttgagacaattcaactatatttgaaaatgaaaccaagacttttgtggagtccctcaaacatggacttgctaagaccagaatttgaaacaactttgctcagcgatgcaggcaatgaagggtattgcaaggcatgctaccttctcagagagtataacccactgtgctgtggaaatcagagtcttgcttaaaagcacaaactctgaagccaaactgcctgtatttaagtctcagttctgtctcttgctaaacatgtgatcttaggcaagtttctcaacttcttagtgcttcaatttccccctctttaaaatgaggataaaaatagtacttacggcatagggttgaaaggattcaatgaattaacatgtgtaacgcatttggagaagagcctggcacattttaaacactagatatacattcttacttgattagtaagtcatagtcactagcttcaagctctacagggacacttactccctttcctctctccttggcctaggactaaggtctccagggtaaactcttaatgtttttcagtgccatggagagaaagcagttatagggactgctaccacaaaaagcagagggcaaaagacactttcagagaactcatcaaccttaatcttatgtaatttacatttaagctatcatttagagataaaactattttaaaagacaagcaaatgaaattacaatttagttcacaaagctactccagagtcaattcatcctactagagaattactaagtgcagaacatcttattagtatatctcgtttaatatgcatacaaaattacatattttctgcctctttggaaataagctatcttccacccagaatttatatggggtgagcatgggacccagacctgactagtcaatagtacaatcccccagccacaaaggtaagttcagagttgggcatgacacaaggcctttcagaatcctttctggggcctttgcaaccagggctatcaagaaatctcatctatctgctaattgtctacctctgtcctaaccgtagactggaaggacttgaagcaaccaatcaccatcttttccagaaaccttgaaaatgtttcttcaaaagctgaaattattttttaaaaattcactgatatataaacaagatgaaaattatgattgagaatatgtgaaaattttatagcatttatgcagaggaattgtgatacatgttagcagttttctccactcacaatgcagttttaaaactactaatacaatattcggtccaaagcaagcatcaagaaatagaaaatcaccatatgcagatttttgatgaacatataacacatttagtttccattatattgtgatgtgatgagttcattatgtattggtgggaaagaaactatagctagagacaaaaaatggatctcttcagtgagttggaaatcttacaaaaatgtacactgaaacgttgttctaccctcctgaaattcatagaaattagccattcagaaaggaaagtactgtgtaaatttgtaccaattcaaataaaagagtagatttcataaaacaatcaggacaattgacctagactttataaaatagcaacactaaggtcactaaatataagaaactttatctacatctttttactagaagcattctagagttctctatttcatcactttgtgctttttaaaaagatattcttcatctgaaactattccaatgaatataatattttaaatattcaaagtaaaaatgataatgcatatatatatatcaaaaataatggactcaagatgtataaatgaatatacataatattagagaatgtattttactctctcattaaaaaaagctttcaaaaagtatcatagattattacagattgagccctattttctacagtttttataatataattttctctgataatctaaagttactgtaagataacagtatatttaattattcgggcaaagactgttggtacatcttagtctgataattgatactctgtattcaatgccatattcttccattaaactagaacttgcatctcaaatcaagagatatgtactgtaattgctaacacagtcatcaacattccaggattttggaattttagtacattagctttcacagtgaatcttctttatattatggtataatcactacaataactaaatgaacttttacttttgagattttaaaaatcaaacattttccaaacaagtagtaagatgtgatgaataaaactagcgtaaaacttagtaacttggttaccagttatatcttttccacttatgagctttacgagctctgtgactttggagaactactttaaattctcagaacttccatttgcttctgtgtaaaatggggcaccaataattacccagacaaactcacaaagtggctgaggaaatcgcagtgagaaattatatatataaaaatacttagtacatccagtatttcacatatgtgaggcacccacacagtacttgacacataaggaagtttccacaaatgggagtactattgtgtcattacacagatgtaagagagaagcaggcagtggaggatgagagttcccaaaattgctatggtcttatacactctgtttcacaagttgtggtctgtcctgcctcacaaaattggtcaaggtttcccatatcattactgctaatcctgtatgggaaaaggtaggaatataccagatgaaaaatacaatgtatacctatctttgttgtttcccatatgcttcatttgagtttgagtactgtagctcttaacagcttataaaaatgccttttattccccttttgcagtgataacatgaatagttttaagagctataaaaagttttaaataaaacatgtaggcaaaaataaaaggcatattagttgaaaattattttgtcacatatattaaatatcattacaaaacatttccataatagaaaaacaaggttatgtggaacagtgttttgtccatctaattgttacgttttcatagtctcttttttatccctacgatatattaaatctcaatccatgagccatcagaaattccttcaaatccaaagaacctgaagaggaaagggaaataacatggttaaatattcgcagccttatatcattttctcttggttgaatgttctcgtctaacaaacagaagctcactgagggcaaccttggtatctaagcctagcacaacaccttgcaaatagaaggtgttactatttgttgataaatagagtaaaagtttaggttgttatttgtttttgttttcatggaggttttattgttttatttttaatttatacagcagagaatacaactcattattgaccagatgaacaggaaaatcatgtttcttctggaaaaccacaccagtgctacagtgaggcaaatgtgtgtgaagtaatggaaaaaacactaactagtgtccaaaaatctggggttttgtgctcattctcaattgatgtgtctcctcaggcaagtcacttagcttctgcatagatctctattttatcacctataaagtgaggttaaagccttccttatctaccccacagggctattgcatgtaggacataattgagatcatgtatgttaaaggactttataaactacaaagtgcagtgacaaatggaaatgagtctaaatcttcatctgctccctgatttagaacaaacatgatttgtcacaagcaaaggtctattatcaggcaaaatacattttatagattgggacacacctccctcttttaagtcagtggagtagaggttatacagactttcttaccatatcctaagacactgtagcacccagaaacttgatttataattctatgtagtaatggagttacgtgatctcatattactcagaactgcaataagagtttagggtgcatcatttcctggtatcctctcaatttatatttatgtactcttctttgtaaacagagaaatgccagccaagttaaagtaaattggggcccggcacggtggctcatgcctgtaatcccagcactttgggaggctgagtcggccagatcaccagaggtcaggagttcaagaccagcgtggccaacgtggcaaaaacccagctctactaaaagtataaaaataagccatgcatggtggcaggcgcctctaatcccagctactcaggaggctgaggcaggagaattgcttgaacccgggaggtggaggttgcagtgagctgagattgcaccactgcactccagcctgggggacagagtgagactctgtctctaaataaataaaaataaagtaaattggaaccgtaagcaaatgttggtctgaatatgctgctacaatgttgagggagaagagttccagggagccgattttgttggctttgtaatgcagcacccatcatcctgcttctctgtaccctctcattcttatggctttcccctcaaacatctgggaagcagcaagtaacaatgcccccgacagtcagtttgagttgatggagctctctcaaggacctgcttgctcatataagagttctcaggcagttcctctggaagtttcccaagaagatatgcatttcacatctacttactgtctgtctgctagatgtcaagcactgtactaaatgtgagaagacagacatagaatgtgacacagcatatgctcagctgaccagtttactataacgtgaaataataatcacggttaatacttactaagcacctattaagccagtcattttgttaaaggtagttagctaggcatgagcagggcaggagagggctctccccaaaccaataaaaatgtggggcgatggtttggcaattttcgcattgcctctctaaaaataataattcggcggccgggcgcggtggctcatgcctgtaatcccagcactttgggaggccgaggcgggcggatcacaaggtcaggggatcgagaccacggtgaaaccccgtctctactaaaaatacaaaaaaaaaattagccgggcgcggtggcgggcgcctgtaatcccagctactcaggaggctgaggcaggagaatggcgtgaacccgggaggctgagcttgcagtgagccgagaccctgccactgcactccagcctgggcgacagagtgagacttcctctcaaataataataataataataattcggcacccagggagagacaagctcctgacggtccacacctgttaacattagaagtgttcattgaatacaggccccccagggaagaagcttcttcttgggcatgcgtgttaagagacataatgaccaagtatgacgttccaggggcacgcgccactggaaaaaggaaaaaaaagcctcagatgggcatacctgtaactccctaaatacacacgtgctgaattccaaagggtaaagaaagcactgtccatgcgggaagcccaccctaagggaagaatcatgggaaagaggcggcctataaagtcttaggatcaaggttaaaggctctctttttctttgcccttttttgctatcttttttctctctttgatcttcagggcgcccacttggacctcttataagagctcttttctttctttcctgttctgaagtattttttaataaacttccactcctgctctgaaacttgcctctgtctgaaacttgcctcagtctctttttctgcagaatgttcctcagttgaattatttcttcttgaggaggcaagaactgaagttgctacagactcatacaaataggccaccagtaactctgggtaacttggatctcttccaccagcaataattttaccaagatctttacatgcattaaatttttcaatccttgcaataatctgatgaagtagatactgttatgattcccatcttacaaatgagaaaaacaaggagcagaggtgtaactacaaagttttccatgtttagaaggggttggagctgtaatttaaaccagagtatatacattcttaaactcagaagcctatggagtgtaactatctctcccttcaggcaatgtccaactttggtcctcaagggaatctggccacagaatacaattcatctacatgacctccatggaacacaaggggatatatgccaatcaaaagaaagggaagtaacattttgagtacctattgagagctgtgggtaaaacaacggtccaggtttgatatcattttctctattttacaaatcaatgagcaggggctcagacaaattggccaatctaattctaacaatcaggtctcttacatcacaatgtgatgacaacttctttcaaaaccccacatcagtcataaacaatgatgtaaataaaactctaatgagaaaactccagttacccatcgaaaagaattaattatattcctcaaattgccgcttttacagcagagctaaaagtatgttttagaaatgaattgagtagacatgcacttgctccttggcacttgaggaacaaaatatgtcacaaatgaggggcaagtgaaaactttgattttagtcatttctatagcttttctattttctgagcgtaaaccttcccgaggactctggatatgcttaaataagtctactagtctctagtactgccacttgctcattctctgtgtattctcgggagtgtgccaagcttcagcaaagaagcagtcaagcttccaagacaaactactgcataccaaagacactaatgcccaatctctacaggctctataccactcaggggaacagaaagaggcagaatcctacccaaattgttctattaaaaaggttttaatgaaggatatttacaaaagtgtggccaagattaaagaaacccacaagagaaacccagaaacttgcagcagaagaaagaaagcaataccatccattcccgagcctaaaggagcaagaataagaaatcgttttacattaataggatcccagtgagagctggatcatggaggaagggccccagtcagactgatagaaggacacaaccacagtcagagacatagaaccaaagagaaagagagcaaggaaaaatacatttcttctctcctttccagtcctctcacctgccattgccttccattggctaaacaattagccagctggcaatagaacctgaggagaacataaaatgtatagggtgggagagctgttgggggtaaacagcatggctccctaaaaagagcctggttattagaacactcataacccaaatcctgttcctttagtctcagggaaattaatctcatcctctgtagtcttcagctccacactgaaaattccatctttctgacctacagggcgaagctagcctctacctttaggatcaatgtctctcttcaccaagaagactacctccttggtggctcttaaaacaaaaataagttgtaaattccctgtggcacaaggaatcccagaatagaaatacctattcttttatcttagtgagtaagtatacaagtgtgagtgtgtttagattgagatgtgaattaaaatttttttaaattttcctagagaagtgagaataagacaaattgatatctctcaatatgttaaaattgtcctgcagaagaagtttcacagaggaccctatttacataaggataaacagttaaacctatacatgaagttagaaacccatatggtagaatataaagaaacacacaagggaatgactacacagttcatatgctccactagcttcctgaagttgttaaaacatgaaaagccgattcctagcactctcaggcaaatgtcttacatggagagttttgttgattgacttttttgaaatacttacattgtcctgcagagttggtaacaacttatcattttatgtgttttattgtttgatcaattggcttttaccagtattttgaaaactatcaaactctgatccaaggaattttaaaatgttttttccttcttattctctattctctgtaaaaatacacacacagctgagatactatggtcaaagcataactggcatttgtgactaaagtactgaatccaaatcaggagtgagtgcaagagaaaaaaacaaagtttccatgggctgtcaccaatatcagggctgaattctccagaattttaagaattaatgaccttgaatcattgcaagagttttattttcaaatagatacttaagacttaaaattatagattatgtttctatgaataaaaagtgaccttttatggcttcttttccaaaacttcactactttattattccagtggtctctcaccccatgagtaaaaagtctttaactgtgtgctggcattatatttataaatgatttatgagtgattaacatgcataatcatttgctaataatatacaaaggaaaaatattaatttagggtgggagctatcatacacacattctagtgatttttaaatctacatataaaataatgtttcttactaattttaattaggagggaggcaagtatgtcaaatcctatgagatcgctatttatttatctcttaataagaagctgcccaatagcttataccacaattgaatttgtgagctctgcctttttttcacgtttttgtttacttatgtttcattgcattctttttttttctgtataggaatattttcaagtcatttgcccatacctgtgaaggttaatttagttagtgatatgcaatgatttgtaagtccactcagtcaggcacatatgagttttaatagatcaccaaatattcactgactgatatgaatatcactacctaccacaaactcccaagcacacaaaccaaaaaaaaaagagagagagcttttgtcatatttcaaatattaacatatttttaagtgtatatatatagttgattcttattatttatggtaattatgtcttgtaaagtctgaatactacttcagcaaatactgaaccattgctcttatgggaaatgaaaggttaggttcctgtaagtctctgtttacagtttcaccaactaatcaatacataaccttgttttatgtgtgtttcatttaaagacaccttatttactatatattgttgattcattaacaactgaattaatggccaactcattgaatccatgacaacacacctgaaagaagcttatctaacaaacaacaaatattttctctgtaaggcacaccacagcctgcttacacttaggaacaacacacagaacttcagcttttacattcaggggccattttgaacagcaataaccaagaaaaagcacaaaagtacaaaaacatggcacgaaaaagactgcataaagtacatttgctgatagtatgagagctgaaatgagaaggctgagcattgcgttgtttgaatttagctgggaatggacaagtcaggcaactcaaaatttttgtgactctgtacatgtctgcaaataaccacaaaagcacttcaagtgttgattatggggttacaaataagaagatatgattctatacctagaaaatcctatagtctctgcccgaaagctcctagaccttataaatgaattcggctaagtctcaggatacaaaatcaatgtaaaaaatcagtagcatttctatacaacaacaacatccaaactgacagctaaatcaggaacacaatcccattcacaatatccacaaaaagaataaactacctaggaatacacttaactagggaggtgaaatagctctacaatgagaattacaaaacactgctcaaagaaatcagagatgacacaaacaaatgaaaaaacattccatgctcatggaaaggaaaaattaatattcctaaaatggccatatcacccaaagcaacttatagattcaatgctattcctatcaaactaccagtggcattcttcacagaattaggaaaagaaccatttcaaattcatatagaaccaaaaaagagcttgaacagacaaggcagcaatcctcagcatcacattacctgacttcaaactatactacaatgctacagtatccaaaacagcatggcattggtacaaaaacagagacatgtaggccaacggaacagaatagagagcccagaaataaaactacacacctacaaccatctgaccttgacaaagtaaaaaaaaaaaaaaaaaaaaaaaaaaaaaaaaaaaaaatgagcaatggggaaaaggactccctatttgataaatggtgctggaataactggctagccataagcagaaggttgaaactggatcccttccctacacatatgcaaactcaatgcaagatgaattaaagacttaaatacaaaacctaaaactatataaaccctagaagataacctaggaaatgtcattctgacataggacctgacaatgatttaatgacaaacacaccaaaaacaactgaaacttaatttgacaaatgggacctaattaaactaatgaaagaactactacacagcaaaagaaactaacaacagagtaaacacacaacttacagaatgggagaaaatatttgtaaactatgcatatgacaaaggtctaatatccagaatctataaggaatttagtcaattcaacaagcgagaaacaaacaacttcattaaaaagtggacaaaggacatgaatagacgctttcaaaagaagacatacatgtagccaacaagcattaaaaaatgctcaatatcactaatcattacagaaacacaaatcaaaaccacaatgagaaaccatctcatacaagtcagaatggccatcattaaaaagtcaaaaaataacagatgctggttaggttgcagagaaaagggaatgcttatatactgctgattggaatgtaaattagttcagccactgtaggaagcagtttggtgatttctcaaagaactcccagaagaattaccattcgacccatcaatcctattattgggtatatagccaaaggaatataaaccattctaccctaaagacacacacatgtatgtttattgcagcactattcacaagagtaaaaatatggaatcaacctaaatgccatcactgatatactgaataaagaaaatatggtacatatacaccacagaatactatgcatccataaaaaaaaaagaatgagatcttgtcctttgcgacaacatggatagagctggagatcattatcctaagtgaactaacatgaacagaaaccaaatactgcatgtccttacttgtaagtgggaactaaactttgagtacatattaaaacaaagaagggaataatagacccaggtcctatttgaaggtggagggagggaagagggaaaggatggaaatactaccaatcaggtactatgcttattacctgggtggtgaaataatctgtacaccaaacctctgtgatatgcaatttcacatatatgtagccaacaagcaacaagttccattggtctgtgtctccgtttttgtaccagtgccttcacatgtacccctgaacctaatgtaaaagtttttttttatatttttttaatttagctggtaggtaaatccccaaatacagaatccatacatgatgacaactgaatatatatattgaacttttatcaaggctaatataattgcagttcactttgaaaacccctatactactctattagtctccaacaggtgtgaatgaaaaaaaaaaaaacctggatagttgctgcaaaacatacctccctctctctttcccctccatatatcatctgattactcacattactgtgcatagtagggtttgttatttcacgtagaaaaaaaaaaagaaaatttgattaattggggactgcagaagggatagtggatagaggttcaatggattatataaaattgttttcacatagttctcccacgtttagaagagagtgatttctgagagtgatggcaaaagtatttgctaggacggactgtgcaatgagacatgctgggcaaagaatgaaggctggaagcacagaggagctttccagagagattttgtcaactctgcgtacagagccaagtgataaaaatggtgtaacatggccaggcgcagtggctcacacctgtaatcccaacactttgggaggcagaggcaggcagatcatgagatcaggagacagagaccgtgctggctaatgtggtgaaaccccgtctccactgaaaatacaaaaaattagccgggcacggtggcacatacctgtaatcccagctacttgggagcctgaggcaaggagaatcgcttgaacctgggaggcggaggttgcagtgagtagagatcaagatggtgccaccgcactccagcctggtcgacagagtgagactccgtctcaaaaataaaagaaaaaaagaaaaggtgtaacattggagaaaaggtcgtttttgcctgttccatctatttctgctgaaactcagcagaacttccacactctgaagactggatgtttgggagcatctggaataagcaccttggaatgaacattggctttgtcgatgcagacagggagagcagggaagctaccccgagtcttcagtgagatgagtgggagatagaacaagagcagaaaagcaggtaggaggcaaagtggtaaatcttggttttccaaattcatacctagacaggtaatcctttgaggacacccataaataattgtaaacacattgaagttgatgattttgtgacaaccagggtagtgggagtttgtgctatcattatttggtctttcaagtaaatatagggtttgtcgtattcagaatacacagagaagtttgtctctgatttgtcatggagttggatcaggactgagaacaggtctttagagttgccaaagagaatctcatgttaaatattgaaaaagttcttttgatggatgttagatcaggcagtaaaagtcacactgctgagaaaaatgaagcttgcaaatgacatcatttcaagaaatttggtaaagccaagaaagacacatctattgactaacgagaattcatactcagaaggaaaattgtacaaattaaaattaggacattctaaccatgtctctgaatgacaaacagcaagttgttgatagataagctgaggttaaaaatgttaggaaaacaaaataaaggaaataattaacagattgccttatattttaagtataagtgtgtgtgtattatatatatttatatttttgccatgttatttgttttttccttcccctcccccacagctttacagttataattgacaaataaagattatatatatttacatatacaaagtgatattttgatttacatgtatacattgtgaaatgattaaaataagtgaattaatatattcattttctctcatacttatcaatttttttgcagtgagaccacttaagatctactcttttaccaattttcaagtatataattaatacattaatgctaattatagttaccatgctatacaatagatctccagaatttatttaaaaaatggaatgcttcacgaatttgaatgtcatccttgttcaggggccatgctaaacttctctgtatcattccagctttagtatatgcgctaccaaggcaagcacaagtatatatattttaaacttggtaaaatttcacaaggacggatcatttatgtattcactcattcaaacaacattcacagggcactaatctgtgctagacatagtgataccaaagtgaatgaaagagacagaatccccaccccattagagttaacaggtcacagagcaataaagagctatgtgcaatgcagtgtaaaaagtgttgggatgtggaaaataccaggccttaaagcaaataggaaacatgcctatctcatcctggagaatcaaggaaagcatcatgtaggaagaaacatgtgactggacaaaggtagggctgatccaggcatgaagaacggaaaagaggactctggatagcaaacatacagtagcttggaggggtgaggccaatgtgtacaagaatagcaggacagttgttgtttctgagaggaagagttctaggattgaatgataagagatgagttggaaaagaagcagagggcatgcaaggccttataaactatcttaaggtatctggacatcattcaaaatgcagtgaggagctcccaatagcttttaagtagggaaataacataatcagatttgggttttagaaaggtcactgtctgcaacttcatcactgcagttttccatttaggaatctttggtgaaagtgatccttcatttgaaagctctacatgtcagaagcatattctggctcagtgtgtattttgcttagggactcctcatcatcaacccattaagagtggactaaagaaacaaagccaaggagacactagtgattaacaagagccacacttaaattcccaaggtccttaaatactacaggagaatcaaatgtgaataaattttcctgatagattgctacagtaaagcatttttttacgttcttacagcagcatgatgccaagttttgcaaatttccattatatgaccctgatcacaaagtcgtccttgagaatgaaacaatacagaaaaggcaaaattttataatacattggccataaatggatcttaaaaagaaaaataacaatgtcttttttgagttaagtctttaggacattttctaatcctggggcactgatcgagatccttagatgtagtttcctattgtcttgactatgtagtcctccatgtcctgctaatatttttttcttattaactgtttgatacatggaaatcaatacgggcaactcacagaccttcagaaagccaaaactacttgctgggattttttgtaactattcaaaatttttcattattcctacagtcctcctctagaaagtttcttgaaaggttttgttacttagggagctgcgtatggacaggtacattttacgagactttgttatctcatttacatcacaattatctccctggtacattctcttgtccctccctttccccactttgtcccctccaatacacacacaaaaaccaattttacagagaactcacaaagagcttagaataaaagtatttctgctacatttcattttaaatcatctgattgaaacagagaatagtaatgaagttatccttataaaacataatatttcttctacttctgtattgaaggttgagagccacagatatataagtaaccaataaaaatttggacaggaaaatgatgggttagcaacttccttaggctgtgttctggaaatgtttacatatatacacatatacatacatacatatacacatatacatatacatatgcatacacacatatacatatatacatacacatatacacataacacacatatatgtactacatatattacatatacatatcacatatatgtgtatatatgtatgtataaatctatatgtatgtaggtatatacatatatacacacatctactttttctaatttcctgaccgttccattgaatgcttcacatgttcttaccttaatctttaggcctaattttgataattgtcatattatgaatatatgtatttttttgcgttaggcctggagacttttagttatatgtattatctatagagagactgacctaattgtacttcaacttcaataaccattgcatttccctaagtagatgtaagcaacattttaaaagggcccctttatcttaaagaagtagatgaaacgctggtaactgtgtaataaaatttaaataacctctatggaggcattattttgttacataccattttgagttttaattgaagaaaacagctgactaaattgttgccaaaaacattaatgggactattgttgtttgatgaaatttcattcgtgtgtgtgtgtgtgtgtgtgtgtgtgtgtgttacctacaatgtacttgttttcctctttttcttctgtaaaacatgactgagaacacataaaatcagattggaataataatattaataacaataataatagttaccatatatttgatgcctaccatgtgtcaattcattctccacctaattttcataaaaatccaaactccttttcatacagggtcacacctaatccgaccctaacaccctcactttttgacatactctcaggccttgaagattctgttttcctggtaaaggacaccaattttttaaggggctaaaggcagaggttaaaggtgaaaagctgtttctaatctgttaggtctcgacttaaaggatggctaatctaatcatcccacttgacatagggatttatagttgccatttatctcaagaccctgtgtttttcttttaatttatagctattaaaaattaatgattgtgatatttgcacctttactttttttttcctgtttccagccagactctaagctccactacagtatcaaagtgcccagcttcatgtgtggcacattagttaagggctcaattacatctgctgagtgtataaaagggccctgttctgggcacctttcacatagtacactgtctgcagatgagaaaactgaagcacagaggagtatattatatgcattatattctggttaatgggcaacagaggtgctatgaggggaccacaggtctctaccccaaggcctttgctcctctgactccacccaaccacctccaagaatcaaggcctgataatgacagccagtggaaatatggtttggcaagaatactctacagttggattttgaactctgctaacttgccaatcactattgtgtactgagaattttcattggtctttcattgtacatcctgatctataatcagacatggaaagagaagggttcttgagcatctctttacccagttttgagctgggacaattcctgacagttattgacctcccttggattttttgttctgtactaaggcagaggcagctatgaggacagccaagcctttgatttgagtcatacccagctatcaggaagcagatggatagggaacacatccaaactgctatgctttgtcatgacttgatttaagcaataactattggcttatttaccaatttccaaacagtgtttattcaaggaactacattttctcatattctttctcaacttcacatttcttccttccctaatacttaatgcctggtccatgaccattatcaaaagcaaatacagccctgtaagtacaacgtgacaaggcaggattcaaattggcttactaacaatacttaattctatggattaaagacataatgaaatgatatttgacaaacatgtattgagttattctcaaggttacctatgtcaaaggaaacaagagctggacagtagttaagggctgcactcaggaacaactgcaatgggttgagggagacttcagcaaagaactagtctccattccaaacacagcaaagacaagtggggctttatagtcaaggagcaggctgaggatcagcagatagaaaattactaagagaaaatatccaggccaggggtatttttggctaaacctagttgacaagattcttgctgaaggtaggcctgggtgataagatattaagcatggggaatgaggatgttgatcagatattgaggataggcaattattgataaaatgacttagcaacattcttgctagaactgggcaatgcaaagatgaaaatggacaccctataaggcctagctgagaagaaagttcagaggagtctgactaaaggtaggttaaggagagagtctttatcacctagtttgtctgcacaccatctaatacaacttgccacagcaataggggagtttttctcttcctagtgtctaatagtcttaattttataatttgcctttattacttcatataaaaagataaaacttttagtgtttacatatgcttgggcactatggtagctattttagacattgtaaacctagctcaatggccatttagaatttactttaaaatattgagtgctatgatccaaatatttttaaaagataagttgtaaattttaagcgtaagtaatgattgaaatcaggcttcctaatgaacccaagtgatcctaaattgccaacatagatattctttttttcaaaaggattttatttctggaaactcatggctactctctctgcccctgggcctttgtcagggacatgggatgtaccctggctcatatccctaggcacaagtactagggagaaagttaggatatttgttccttccatttcagaagactccaaagttgtttaatttgaactctctctttccagagttcagcatacttgagcaagaggaattattatcaaaccccttaagataaaatatccaattattccttctctcctgacaaaggatagctactcagctgaaatgtgcacaatcagtaaaaccacactggaggtctttcaaagggcaaagactctcttctctaagatggaagtggcaatactcctttaagctagttctatattttataagataaatttttgttgaatctcgaagcaaggaatgcttattcctctgataatgaccaggataattcctttgtgggaaaaatactcattttaaatggaacaatcaccttcaaatttttatattcaatacaagttgaaaattctctttaaaataaggtaaagcgtagcagtagccaattagaaagcaaagaactaaatgcaaaacttatcagttgtataaagttacctcctatcataaaaagaatcctcataaaagatcagacctagttcctaggtcaatattcaagtcttataaatttagatatattaccaactggagtatgacaaaaccccatcttaatatttgaatccagattcaccataaagcccaacagttacaaatgggttcatagcacattatgactaagaagtaataaaggacccaaacttctgattgttaccttaaatacattaataaacaggaaaaaagtaagcttttttcttagcataaattaaaaatattttttcaatgaagttcttctaatagctaacaccttcaatattgcagggaaaaaatttaattctatcaaaagtacagtttctatatacaagtaaatattctcaatacaagtaaatatttaactctcaggggaggcttcaagatggcagtctaggggtattttgtattcacttcttcccccccaaaaaaagaaaaaaaaatagcaagtagataatcacactttggaaaacccatccaagagagaacactggaatttaacagaaaagtgacaggcaatatctaaagcaagaaaggagaaggaattgaggcagcctactcagccaggatctgctgggagccaagagaggctaatacagggaaagtgtaagtgagagaccctcagcagtccacattcccaccatggactcctgcaatcctgatcatgggacagccccttgactctcttgggccctgaaactaacatagggagctacagagagatcatacaaccacggctctgccccatggaggaagctcatgctggatctctcacattccctgagaccttagcagctacagcaaggagccgttttagaactccacccctaacacacagcacactgtcctggagcccagtggtgctgcagctgaggtgcaagacaagcattggctgctgcccgaagggctgaagcacaagtaccataggctactgcacatggggcagaggtgcaacagaggtctgggatattctctttagaactgaggtgcaagtgaaacacaattctagagccctgcacccgtatactgagcactgtcttggaacccagcagtgctggggcggaaggcccagagaaatgacagctgctgcccccaggacctaggcatcagcaagtgtgggctgctatacatgtggaagtgtcaccaaagtgaaggctaccaccagggctgagcaaggtgccattcagagtcccacccccaacagactgaggactactctgtggcactgcagtgctgggactgagactcaaaagaagatctgactgctgacttcagggctgaggtgcatacagttgcaggctaccacatccaggctgaaggatgagtgctcccaggaatgaagtataagtgacatgcatgctccccatccgacagcccagccactggtgtctcccaccctagccttccactggtggcctgaggattgccccacccctgcctaccatggctagtacctatacatatcatcagggaagctgagggcaagcctgcctggcacagcttcaccccttccaactgtgacaaagcacacagtctagggggccacactcactcagcccagtacaccattgctggcactggaacactcctcccatgggcctacccacccagccactaccaccacagctggggcctacctgcatacaccacatgcaggcctggagactcagccactcagcccattgcagccactgccaacaccagcctgcaccactcaggaaccacagggttgtcttgccactggcactgccactgcccatgccacataggatgcccaagggccccaaaacctgcccacttcccagcccacacctgccatactgggatctgagtaagccacctggagtcccaagaatcagcccaccaggaccctcaaacactagtgctacctaagccattctggggcccacagacaggcaagctcagtccactggagccaccactaaggtctgaagcctggtctacctggcatccaaatatccagcaaaactgtaccatagcctccactaataattgcaccctaagcaattgaggaaacctcagattctactgatgctatttacagccaaagagattatacagagtctacactactacactcatctagcatgaaaaccaaagtgcactaccctatcaacaccatagattcaaaggaagtggagggtatgggagatgaaaaaagtagattaatgagtactaacatattgttagataaaggtataatttctgccattaaaaagcagggtagaataataacatgttatatatttcaaagtagcaagaagagagaattcaaattgttcccaacacatgcaaatggcaaatactcaatgtgatggatactccaaatacctgactggatcattacacattctatgtatgtaacaaaatatcatgtctatcatataaatatgtaaaataatatgcattaatttaaaaagtaaacaaaatgaaaaaatatttaatttatatacctttgaaaaatagtaagacaaattagacaaatagttcatcttaaatcttttagtattcttctataaggaaaagaagtgcttaaactaagcaaaaacaatactggatttgacttttatagaatattacctataaagagttatcctacctggaaaaaaacgttaaattgtaggtggtcccccaaaatatttcacaatatttctgttactgatagaggaagaagattcttagtgtttgttggcatttaaaagtttgaaattagactttagaaatatcaactaacatatcactccatcaaattggtttctgggtagctggtgattttgtgctacaaattccatgctgaatgctactaattttatgtctctttcaaagatcagagaagcttttatagacctccccagggatgtattttgaaaataaaatgagaaaatgcttctgagaaattttttaaaaagaatattggggcccagtatagaccaatgttgaagaggaacattacatagcaaatccactacagcttcctctcagctataatacaatcaacaagatggatttgtcaaacttctgcttatcagtgagcttctggactgtgttcagtcctcaggatatactcctttgcaagacacaaaattaatcactacagacattgaaacactgtatcatgtttatatagcatacactatatggcaagtgttgtaaatcttcatgtatattaattcatatgatcctcatcacaattctgtgatatgaggttaatagtaagcctattttatagatgagtagactaggcactgagaagttctagcaactttctcaaactcacacagctaatagatagcagagtgggtattttttccccaggtaatttggctccaggacccatgcttttaaccagtatattaatatagagtgtcttttctgatcttgcctttttaacccttgatcccttcctctgttcccatagtcaccttctggttccacacttgctgctcctggtttgcgtttaccattttgcctcatttacatttgaaaatccatctgttgccaatcattatgactagggtgatgatacatcctagtttctccagtatactcagggtttctgcttgttgtattgatatcataattcataacacacatcccctccctcgttaattctcaaaattttcagtgtgatgataaattttatggccaccctagtcatgactgactcaaaaacttcattaaaatgttttggctggaagctcccatcaggctgcagactttataactggggccacataccaccacctattaccaggactctccagtattgccaacagtgtccctgaaaatggtcatgcaaatgatagttacttctcttgtctataaaaatgagataataaatcaggagaggacagtgtaaggtataacatattattcaatctaactcttacacctaaaaagtcaaaattagataaagcagattgagtttgtttgaaaaaaaggcagctgaggaatagggaaaaactaagagatggaactattataacactcaaagccttagattcccacaaaaacccattataatagaatgaataaacaatttcatatatatatatatacatatacacacatatatacacacacacatcttttttgagatggaatcttgctctattgcccaggctggtgtgcaatggcacaacttcagctcactgcaacctccggatgcaagcaattctcctgcctcagcccccgggtagctgagatttcaggtgcccaccaccacgcctggctaattttgtatttttagtagagacgggggtttcaccatgttggccaggctgggtctcgaacccctgacctcaggtgatccacctgcctcatcctcccaaagcactgggattacaggcatgagccactgtgcctggcctacaatttcaacaacattgaaggacatgaggtcagttctcaaaaatcaattgtattttgatgcactgtcaataaacaatctaaaaatgaaatcaataaacaatcgcacttacaatagcatcaaaaataacagaattcttagaaataagtaatcgaggaagtgtaagactcggacattgaaaatgataaagcattgaaaaaactttttaaaaattaacaatcatttattagtgtttgtgaattggaagacttaatattgttacgatactaataatccccaaattgatctacagattcaatgtaatttttatcaaaatcactgcaacctctgcctcctaggttcaagctattctacttcctcagcctcctgagtagctgggactacaaaccacccagctaatttttgtatttttagtagagacggggtttcaccatgttggccaggacggtctcaatctcttgacttcatgatccacccgccttggcctcccaaagtgctgggattacaggcgtgagccaccacacctggccgaaagctgattctaaaattcatatggagttagaaaaatccagaatagggaaaacaatttgaaaaaaaaagggacaaatttggagaactcacccttcccaattttgttacctacctacaaaactacaacaatcaaaacaatatggtattgacataaagacagaaatagagattaatggaatggaattgagagtacaaaaataaatccttatgtttatgattgatttttgacaagggtgccaagacaattcaacagagaaagaagagtctttttaacacatggtgctgggacaaatggatattgatatataaaagaataaaattggaaaagctccctcacaccataaacaaaaatgaactcaaagtagattgcagacttacatgcaacttctaaaactgtaaaactcacaaatgaaaataggtaaatcttcatgaccttgatttgtcaacaatttcttagacataacaccaaaatcacaagcaacaaaagaaaaaaaaagtgaattgtgcttcaataaaattaaaatattttgtgattcaaacatcactatcaagaaagtgaaaagacagcccatataagggaatagatatttgtaaagtacatatctggtaaggaactagtacccaggatatattaacaactcttacatctcaacaataaagacaaataactcaaacaaaatgggatttgaatagagatttttttgaaaaggatttgaatagaggttttcccaaagaaaatatgcaaatgaccaataagcacctgaaaagatgctttaacatcattagtcattagggaaatgcaaataaaaatcacaacgaggtattaaccacttatcagatacatggtttgtaaatatttttttccattgctttttcactgtattgtttcctttgctgtgcaaaagcatttaagtttgatataatcccacttccttatttttgcttttattgcctgtgcttttggtatagacccaagaaattattgccaagacagtgtcaagaggattttcccctatgttttctattagcggttttataatttcaggtcttatattcaaatctttattttaagtttttttttgtataatgtaagataaggatcaaattttactcttttgtaggtggatattcagtttttctaataccatttgttgaaaaaaacaatcctatcccaattgtgtattcttagcacatttgttgcagaatagttggctatgtatgtgtgggtctatttctgaactagctattctgttctatttgtctacatattgcctttatgccagtaccatactgttttcattacagtggtttcataatatattttgcaaaccatatttctgaaaaggggttaatatccaaaatacataaaactctcatagctcaatagcacaaaacaaataaactgattaataaatggacaaagaacttggatagacatttctccaaagaagacatacaaatggccaacaggtatatgaaaaggtaatcaacatcaccaatcaattttcagagaattgcaaattaaagccataatgacatactaccccatacttgttattatgactatttttttaagaaaaaagtaagtgttggtgaggatgttgtgaaattggccccttgcacattgctggtggtagtgtaaaatagagcagccaatatggaaaattgtatggatgtttttcaaaaaattcaaaccagatataccatataatccagcaatttcacttctagatataaattaaaaataattgaaatcagaatcttgaaaagatatctgcactcccatatttattacatcatcattcgcaatagccaaaatatcaaaacaatgtaaaacatccactgacaggtaagtaaagaaaatgtgatataaacatacaatagagtattattcagccttaaaaaaataaggaaatcctgtcatatggaacaacttgatgaacctacaggacattatactaagtgaagtaagcctttcacaaaggacaaatacaggtatatctcattttatttgtgcttcactttttttcatttcacaaatattgcatttttttttttttttttttttttttttacaaattgaaggtttgttgcaaccctacttcaagcaaatctgttagctccatttctccaaatatatgctcatttcatacctctaggtcatgttttactaattcttacaaaacttcaaactttttcttcattattattatatctgttatggtaatctgtgaccagcgatgtttgatgctactattgtaattgtttgaggacaccatgagctgtgcccaaataagatggtgaacttaataaacgttgcgtgtgttctcactgctccattaaccagccattaatccatctctctccctgttttcagtctttcctattccctgagacacaatattgaaattaggccacttaataaccctgcaatggcctctaagtgctgaagtggaggaaagagtcacacatctctcactttaaaacagaggctagaaatgattaagaataataaggaaggcatgtccaaagatgagacaggttgaaagctaggcctcttgcaccaaacagctagccaagctgtgaatccaaagagaaagtccttgaaataaattaaaagtactactccagtgaacatgcaagtggtaagaaagtaaaatagatatgtagaaaattttaatgatttggatagaagtcaaaccagccacaaacattcccttaggctaaagcctaatccagagcaagaacctaactttcttcaattctatgaagactgaaagaagtaaggaagctgtaggagaaaatatggaagctagcagaagttggttcctaaggtttaagaaaaaaagttatctctgtaacatgtacgtataagatgaagcagcaagtgaggatgcagaagctacagcaagttatccagaagatctagctacggtaattgatgaaggtggctacagtaaacatttttcaacatagacaaaagtcttatactggaagaagatgccatctagttagagtgaagtgagcctggcttcaaagcttcaaaggacaggctgactttcttattagtgggttaatgcagttggtgactttaggtggaggataatcattccaaaaatcctaggagccttaataattatgccaaatctactctgtctattttctataaatggaacaacaaagtcagatgacagcacatctgtttgcagcatggtttactaaatatttcaagtccactattgacacctacttctcagaagaagatgcttcctaatgttactgcccattgacaacgcacctggtcactcaagagctctaatggagatgtaggaggagattattgttgttttcaccccttctaacaaaacatcttttctgatgaatcaagtagtcattttgactttcaaggtgtattttttaagaaatatacgtcctaagtctatagctgccataaatagtgactcctctaacagatctggataaagtaaattaaaaatcttctagaaaggattcaccattctagaaggtaagctggtcactggagcagtgacaacacacatgactattcatcattaagaacattcatgattcatgagaagtcaaaatatcaacattaacgggaacttgattccaatttggataggttcaaaacttgagtagaggaaatcacagcagatgtggtagaaatagcaagagaacttgaaatagaagtggggtctgaagatgtgactgaatttctccaatctcatgataaaaccctagccgggagcggtggctcaggtctgtaatcccagcactttgggaggccgaggcaggcagatcacaaggtcaggacatcaagaccatcctggctaacacggtgaaaccccgtctctactaaaaatacaaaaaattagctggacgttgtggtgggcgcctgtagtcccagctactcgggaggctgaggcagtagaatggcgtgaacccaggaggcggagcttgcagtgagctgagatcgtgccactgcactccagcctgggcaacaaagcaagactccgtctcaaaaaaaaaaaaaaaaaaaaccctaacagatgaggagtgcttcttatggatgagcaaagaaagtggtttctttagggagaatctacttctggtgaagatgttgtgaacattgttaaaatgacaacaaaggatttaaaatattatataaacttagttgatgaagtagtggcagggtttgaaaggattgactccaattttgaaagaagttctactttgggttaaactctatcaaatagtatcacatgctacagagaaatctgtcaggaaaggaagagtctatcaatgcagcaaacttcattgttgttttaacaaattgccacagccaccccaacctttggcagccaccacactaatttgtcagcagccattaacattgaggcaaaatcctctaccagcaaaaaaaattgtgacttgcagaagactcaaataatcattagcatcttttagcaataaagtattttaaattaaggtacatatttttagacataatgctactgcacacttaatacactacagtatagtgtaaatatagcttttgcatccactggaatcccaaaaattcatgtgacttgctttattgcaatattcactttatcgtggtggtctgaaactgaactcaaaacatccccaaggtatgcctgtattgcatgattccacttacatgaggtatttgcaatagccaaactcatagaagctgagagtagactagtgtgccatgggcctgggggagggccaaatggggaattgtttaataggtgtaaagtttagttctgtaagataagcaagttctagagatttgtgtaccaacctagtgcccatacctaataatattgtaatgtgaatgtaaaattttattaagaaagtagatattatgttaagtgttcttaccacaaaaagatggggccatgagaaagtgttagaggtgatgggtatgtctattaccttgattgctgggatgctttcaagaaatgtgtgcatatgtccaaactcatcaattgcacattaaatatgcgcagttttgtgtatattgattattccccaataaagctatttaaatcacaatgagataccaccaacaataagagttgttgagaatatagagaaattgaagccctcatatactgttgctgtaaatgtaaagtggtgaagccactctggaaaatagtttggcaatccttgaaaagttaaacatagaattaccatatgacctactgagagcagttccacttccaggtatatacttaaaagaactgaagacataagtccaaaaaaacacctgtaaatgaatgttcataacagcattattcataatatcctcaaagtggaaacaacccaaaggttcatcacttaatgaatggataaacaaaatttggtacatctgaagagtggaatatcatttggtcataaataggcatgaagtaatgattccatactaaaatatggttgaaccttgaaaacatcatgctaaatgtaaatttcatttatatgaaacttcagaattgtcaactctgtagtggcaacaaagattaatggttgctaggggctgaagtgagaggggaatgggaaatgactaagggatatggagtttccttttggggtaatgaacatgttctgcgattagataatagtgatggttgtacaacttcgtaaatatactaaaagccaccgaattgtacacatcgaaaataaaatgtaaacaaaaaaattatgtaaataaaaataagctttaacataaacagcaaactatcaattaggatccaggaagaccaaattagaaccggtgacaaagtgtttgagtttgtcatgtacttttgtggacctcacaaaaactctggaagaggtagtttttcccaagatgatggtaaggagaatagtctatgcaaaacaatgtactccagtggctcctggagttcaactatttcaaatgaaagcaccctcccctgcttcaagcattaggcttcagtggacctctctcctacacatggcccttaggaatatcgtttttgcctttcaattcagaatcctactgattcaggaaaccattctcttattgtcaggagaatcatgtttcttaaagtctaaaatgttattatatcacagatttcagtgagaatctgaatattaaagagaaataaatggatttctagaagaacaaaatagtgattgtttctttaattacatttttggctatgaaaacattttagttctctctttttaacagaattacctgacaatatatttatggtgaatgagtcaccacaaccaaattatccagccattcctaattaatttttcatacatccacatttgaatttatagaacttttctataaaaggcggaaaaagtagtagaggaaaaaaatctctctttgacttctgttcttcagctcttcagctccccacactggaggcataaagtatttttagataatttcttgagagcaaaattattttcaactttagtctagggtttggaaacctaaatatacagagtatctgcaaaaaaaaaaaaaaaaaatcttatgaggtgactaacaggaaaaagtaatgtgtgtgtgtgtgtttacatttaccttaaatgtatatgatttggccagctagcagagccattaagaagctgttaacagtctcctaggtagtcaagtgaatcatggtgctggcaaagtggcccagatcctataatcttgtaaattgctcttggccgggaagctacatgcatagagatattcgacttcatcttcaggagcatttacttcaagatacttaattaaatttcaaaatcattcctatgttagttttatagatcaataaaagttctttcatgtgaaaattggctaactgtaaagatggaggatgctcctgaaccatggttacactttgacctagattgtactttgagacagagcagaagattcaaatacttatttataaacaccctctagtaatcactgatggtgactggtagaaatattaggtcttgggtctgctgcaaaattgaaatacagaaaatacttaagctgccataattagttaaacccaaggagaattatgtatttaaaacattcttaatgttacagtttgaaaacatttagaactatcccactcagagtttcagaagccgagctttcccaatttctacgttaaaaattctcaaatgactaggtaaattatacaagtttctatcccattttaaatgagaatgtcatttccagtggtaccatggcatatgaaaattaatttggcaaaaattaaattactcagaagtcactgtatgacaactctctgataagatggcaatataatcactgtttccctagaagattaagaaattgttcatcacattcagtgatgtccttcatcccagtgtaggtatcagtgaattcatgaaattgaacgcattttgtttttgaaacaaaagctaataattcctacagaagcaatattgtttgaatgattaggatttgagttagacaataacatcaaatctagaaaagaaaccaaagaaatcttaaaagcatgcaggtaaaaggaccttagcaaacatttcatttcacatataaggaattgaagtcaaggaagttgaatgatttactcaaggtcaacaagctgcttcgtgactaaaccagattatttaaataaataaatcaaccaaaggaacaaagcaactctataaaccctaggtttttagggtgtggtagatacacattaactgtgattattttcattctactttttcagcaagttgtttctttttccattcttaatgaaaacatacattgtaaaagtacacttcagtacagtacaaatgacatttaatatcagagaaaaattattccattgcccttttaggtttggctcagttttgaatactgcctggtatgcagtggatgcaataaaaattcattgaatgaagaaatgcaatattttaagcaatcaaatcttcttgattctgattgtaacctattttcaacagcttgaaagaatgtaagaaatgcaattcaacataattatttttgttagtttaatgtgagattatcacaacagacaaaatctctatattcagccttttctaaaactacgatttgatatgaatgtggtctttaaagactacacaatttgaactgcaatataaatgtgccagggggatcagcaatggggaaggaaaacattttttaagtgtgctcaatagtgaacaaattatacattttgcacctgcaaaatacataatggccgaaagttacattttctctgtacttccaagtaagccatgctgtaaaaaacaggagttcaggctttgaacttctttcatttgtctttgttctttcttgtatcagattgtactatatacaaagttccatcaagttagtagttatttaaacagcaaaatacttctttagcaaaaaaaaaaatggcaattttttttatttttatttctatttatttatttatttatttatttatttattttgaggcagggtttcactctgtcatccaggctggagtgcagtggcatgatctcggctcactgcaacctctgcctcccgggttcaagcgattttcctgcctcagtcttcctagtaatagggattacaggtgcccaccactgcgcccggctaatttttgtatttttagtagagacggggtttcaccatgttggccaggcttgtctcgaacccctgacatcagatgaaatggcaatatttttgttaaactatacaatggatgtgtgaaaagatttgaacatgaaaaatttagcagtagtttgtattcctcttctagttaagtctaatttaatatggtgacttctaaacctcaagatcctgtggcttccaaagaagtggaaagaaaaaaaataaaattgagaggcaaagcatctttactgaggcctgtcaaattagcataattgtatgctctccttattttttttgacaaggatacttacgtttcacaggcataccctataatggaatgtctatcactaaaaatccagtggtgacataagtttcaaagacattttcatcatgagtcattagactcatcggacatctttcagagaataggcttgtctctctcttgcctgggagcaagctccttagaggattctctgaaaggccaactacctttccatgctggatgctggcagcaagtccccaaagatataaagtaaacaatgccaatattcagttgatgttttttgtcagtcaaattattttcaaatgctacagttctacctctcagtgagcagtgtaataatgacattaagaaatattaaggatatgaatctggaaacgtaccagcaaaaataattcatttcagattttaataaatgaaatatttaggattttattcttttctatgtaattggttataattaaaatctcaagactagctaagatcagctatctctgattaccttggctgttatgaattgcatttctttttttaaaaaaaaaacacacacactttatctaatagtttgcacatgtatatttttatgtaatgcagaaactcttgcttaatgattttattttaagaaattaaattttcttaatttattagaagtgattttatacaattgaggagataaggaaatgtattatctgtaataattctcaacttgaaaacaatagtattgtagagttttaagaaaatttgtatttttcccacaggagaattatattaaaacttaaaatatcccagggtgttacttagagtatttgaaaaagcaccccagtggatattagaagacgtaatgaagacatatcagccatatcaactttagactctgattctatcaccataactaatcatacaaattcttcagtatcctcaggtaacattcagaatggaagaaaagtagagaatgacaagccatactttattgatctcatatcacttttcagcctttaaatattgcaatgagaatccatttaacgactttcatctggaaattacttatcacctttcaaggacataatgtaaaattcagtagaagtcaatattgttaacagggcaagagtttcatgaacataagtttttaaatgaccaaagacagggttatgatcttgctatagaaacttcgataacacagaaaagaagaatgtggaaattgattagggaatttttgttgttgttgttttacttgctgttttattttgaaagatttcaaactcacaagttcaaagaacaaaataatgaactcctatatactttagaccagttgttaacatcacaccacacccccacattctatctctgtgtgtttgtgtgtatacccacacgtttgtgtcgataggtatatatgtgtatacatgtattacatatatatttatatgtgttttatatatacacatatataatacacatgaagcatattcatatgtgtgtatactcacacagaaagagagagagagagagaacatgagagagaaagagagagttcttttcattttttcaaatcatccttaagtggactatgggcatcatgactttttaagccccaaatacttaagcataaactctgaaaagcaatgacattttctatgtgaccagaaaaccattatcacacctaagaaaatcaacctcagtgcaatataatccaaggaaaaaatctataataaaatgcctgtattgtttcaaaaatgttctttatactttatttttttccatctgaaatccaatcaatattacaaaatactttggatttaacttttatttttcatttgtctccttaaatttagaacaattctctgtactccctttgttctttatgccactgaatcctttcaagagttcaggtcagttgtcctgcagaaagctcacattagtgattcatcttgtgttgaaattcaggtcaaagttttctagcaagaatgatatattggtgacattgtgtatcattgaatcacatcagaaccctcatttcaagctatgttcctactggcaataaaaagcttgattacttgtttaaggtttccatcataaaggaaaaattaccctttgtaatcaaggagtattttgtgaggtgaacaaattgattatctatgtttgaatcaaattgggagttacaaaatggtgattttctaattgaatcatcttttctattttaatcagctggtattcttctgtaaagaagagtttttcacctttctctgtcttcctttctctctgtctctcctgttttcatttattgtttttctttaatatcaatatggagtcatgtttttaaaactttattccatgtgttataattcattaccatcataattttgcaaaatttagactgcttcaagctggctcctgtatccttttagccttaccccatccttgtgtatttcttcaagctttctgttacaagaagatgtttcaggctcaatttgtactttcctttgtgcagatgtgaaaacagctatttttccaaggagtcaaaattccttttggtaggatattatatttagaaatctagatgtatcactatgttatactgctagctgctcattgccactagggtgtcattgcttctatacactttcagggacagatctaggaaaccacaaatacatacccacaaatacacagttgaactatagatgtatattatggatgtattattcaacacataggtgaatttttatatatatagaagtactgcattttatttataattgctgcaatatataggaatatatatgaatatatatatttttttcaataacataaaattattttcaccttttaccactccatattggcatctccctttacccatagtaaaagtttaacaatatctttattttatacatttgctttttcctaaaacacataaataatgcttttagaaatacaacaccaatatcactactaacagcaaccatactaagtaaagtctaatattctttatagtgattgggaagttttgtgtgtcccagaatatattccattaaaagcatagagcaagaatattatattcaatagttatttgaattaattatttactctggtttcattgtccctttgaaaatattatttttgtgtatttctcatgtgtttttattctttttaattttttaatttatttttgtctatggccagatcaccctgaatgtgcctgatctcatttttttaatgtaaatcattttttacatgattcataatgtaaagctatatacacaggcatagtcagagaaccctcaattctctccctacatcttctacattctgacattcctacgcatcacttcctgagcttctttatgcaaaaacaagcaaacatgcatatatcaattgtcctgtttaattaaaaaaggtaacattttatatatcatcttgcataccttgctgttttgacttatcactatatcctgaagtttatgccacatcggcatataaatggcatcctcatttcttgttactgctgcctcactttcaattttgaatgtaaattcataacagatgtgtctaagttgtcatcaatatttttcaattgacaaaaaacatggtatgtttttattatgtgcaacatgatattttgaagagtatacacattgtggaatagttaaatctagctaattaataaccctttgcatatattgttgcatatttgtgcagatgaccaccagcataaataactagagatagatttgcttgtcaaaggatgtgcatatgcagatttgttagatatttgcaaatttactaccataaatttgtactattttgcagtaccatttgcaatgagtgaaaattacatactttgttaagatttccttagttttagtttttatttaatgtacctttttctccaaggtcccatcaagatacatgtttaactgtcatgtcctcttaagttcctattggctgttagcaatttgtttcttacttttccttgtttctgatgacattgacagttttgcagaatactagccatattttcccttgactgagattcatctggtgtttttttcatggttagattgagattataggtttttaggaaagaagaccataaaagtatatatgccaatttcataaaatataacatcatttaaaggcaacattatcagtatgacttatcattgttgatgtcaaccttgttcacttggctaaagtaatgtttaccagatttttccactataagtttaccttcctgcttctttatcattcttattggaaagaagttgctatggaaagcccgcacttaaggagtagggagttaatacttcatctctttgagggcaaagtacataaacattatgtctttatcctatactttgaattataatccaataccacttcatatcttgttgctcaaattgttccacttttggccattgggagctctttcatttggttcctgtgtcccttctaacacacccccattattgtgtttttttgcatgctttcttactttctggttccacaatatgctctagactcaccttgtacattcttggctccagtcatttttccaagaaacccaggctgttatttttatggaaaatcatattagaaaccaagctctggatgctaggcatgttcactgctatgagagtatcactttttctaggtcctctcagatgaaaaagtaaggaaatatacatgtatactactctgtttacatttacatatctataaatattttacaagtatctatctgtatctgtcttaagctaaagaggagttcacatgaatgtcctcaactcaaatccattaccacatagataaattctagctttctgcatctgcttatctgttttctactataccaacagtgagaaacctggctcccttgatccatttatgtaatttttcaatttgtatacatgaagtgttaacctatatttctgtgggattatgactattatcaactagagtacagtgcttatatagagctctttttgcctttaggctcacagacttcatttatttccaaaattccttatgtcagtactcttttcctccacacctttcaatgaggttgtttcatgtccttgtaatacagttagattcttgcaccatactttgctttccattctgggatctcctactatcttaaatgaactcattttaacttgcatatattaagattcactttttgtgctgtaaagttctatgcatttttttttttttttgagatggagtttccctctgctgcccaggctggagtgaagtggtgtgatctcggctcactgcaacctccacctcccgggttcaagcgattctcctgcctcagcctcctaagcagctgggattacaggcaccctccaacacacctggctaatatttgtagtttttagtagagatgtggtttcaccatgttggccagactggtctcaaactcctgacctcaggtgatccacctacctccacctcccacagtgctgggattacaagcatgaaccaccgtgggcctgaccagctctacacattttaacaactgcataatgtcaggtaagcaacattacagtactatacagaatagtttcaccatcataaaaaatcctctgtgctttttctattcaactctctccttttccccaagaccatcaccactgatctgtttagtgtagtttcaccatcataaaaaatcctctgtgctttttctattcaactctctccttttccccaggaccatcactactgatctgtttagtgtattcatagttgtgcctctcccagaatgtcatataaattgaatcatacagtatgtaatcttttcagatttttatttagcaatatatacttgaagtctctccatgtcttttcatggtttgatagccattcacttttattgctgaataatattccattatgtggatgcatcacagattgtttccccttcccctattgaaggaaatattggttgcttctagttttgggtaattattaatatgaattaaattgctgtaagcatttgcatgcagttttggaatgtggaatacagatataagtttttaagtaagttgaataaatatataggtggacaattgctaaactgcatggtaacagtattgatagggacaggaggcagaaaagagcgggtccttggcaaaactccaccctccagctgaaaaagcctgaaactgcggcccaaagtaagaacttacatccctgttttcccactggaatgttaccttttcctaaatcactcatggccctgccctgccctgccctgccccaccccaccctatgcctataaaaaccccagactcagctggtagacgggactatggctggacatcagagagaagtagcttcacttcagaggcacaacttgttggcataacttcaaagaagaatccatctggagacagccggacttcaggggaagtttacctaccaacttcatcccgttttcatccccccttcccactgaaagcctctatcatcagctataaagtcccttgcatttaccgttgttctattcattagtgtgaccttatttttcatggatgctggacaagagctcaggaatgatgaatacagatacaaaatgtcacactggccctttactcttgctggcagaaagaagctgcctcacatgaaaaggcaaaggtccactgagctgttaatgcttaagccatccgtgaatggcagagctaaatgagcatgtaacacaccctctggggctttgggagtagcaggcacccccgcctggatgctgccacagggactgcacagagttcactgctgctggtgcccaaaaatggtcagccagagcctgtactcattcacctacttattccctcccacaaggggataagcacagtgagctgagtaaatggagtttgttcctgccagcggtcaaaagcacttgctctgtttcctgcactcatttgccctcatgttacctccagcgagtggtagacaggggaaagctaagcaagtgaggcactcctgttgcgagtcccatgacggggtaaagaaaatattctgattcactatgtttaactttataagaaactgcttcagttgtcttccaatgtggctgtattattttgcattctcactagcaagaatgagaggtccagttgttccacatcctcaccagcaatcactatcgtctgttctttggcttttagccactctaataggtgtataatgatatctcatggttgttttaatttgcatttttctaatgaaaaaatgatgctgagcatgttttcatacgattattggtcatttcatgggtgagatgtctgttcaggtcttctgaccactttttaattgggctgttctttcttccagttgagttttaagaatttttaaagtttctctgatacaagttctttatcagatatgtgatttccaatattttctccaagtctgtggcttctcttttaattctcttaacagtgttttttgtggagcagaagttttaaacttttattcagtccaacttatcattattttatgaattgttcttttgatgttttatctaaaaattcatcagcaaaccaaagctcatacagattttcttctatattttcttctaaaaatgttatagttttccattatacatttaagtctatgattcatttaagcttattttttgtataaggtctctgtctaaatatacagatgcacaatatttttagcacaattcctaaaaagaatatcttttcagcactgaattgtcttcatgcctattgactatatttatgtggttttaattctgggctctctatcatctatcactcacctatttgtctactcttttaccagtacaccacgtcatctcaaatgttgtagctttagtttaaatcttgaaatcaagtagtgtgagtctttcaacattgtttttcttcttcggttttatattctagatcttttacctttccatataaactttagaatcaatttgttaatttctaaaaaatagcatgctgagcttttcttgggtattgtgttaaatccagaaatcaggtaggaaagaatcaatatattgagccttccaatacatgaacatagaatatcttttcatttatttaaatgtctgattattttttgatgaatgatttgcaagttttgacataaacagcctgcatatattttgttagatttatatctatggttgttttttgtttgcttgctttggtgctattgtaaattgtaataattttaaatttctaaacccaatttttcattactgatacaaaatttttcattactgataaaagcaattttgtgcaatgacttggtgtcttatagtcttattatactagcaagatcatgagttttttgtagactaattgatattttctacatctgtcatctgctaataaagacaattttattttttctttacaatatgtatatcatttaatctttgctttcttttatttcatgaactaggacttccagaacaatgctgaataagagtgatggaagaggacacatttgcttgttcccaatctaagaggaaaaggatccaatgtctcaccattagttacagtttactatttttaatgtgctttggattttgtttgttaatattttattgaaaattattgtattgatattcagtttattttttagacaatttttgtcagttcaggaaaagtgtcatactttactaatagcaagtaatttagaagttttatatcttttttaattaaaataatttaggtagaaatgggatctatttctaggtctataatcatatcatctgcaaacaggggtagtttaacttactctcttcctatttggatgccatttatttttttctcttgcctggttgctctggctaggacttccaatactatgctgaatagaagtggttaaagaaggcttgtcttgtgtcacctttcaaggggaatgcttccagcttttgcccattcagtatgatgttgtctgtaggtttgtcatagacagctcatgttattttgaggtacgttccttcaatatctggtttattaagaacttttaacatgaaggatgttgaattttatcaaaaaacttttctgaatcttttgaaataatcatggtttttgtcttcagttctgtttatgtaaggaatcacatttctcgatttacataccaaacttgcaccctgggataaagtctacttgatcatggtatattagttttttgctgttctgctgtattcagtttacaagtattttgttgaggactttttatagatgttcatcatggatattggcatgaagttttcttttgttgtcatgtctctgccagattttagtcacaggatgatgctggcctcgtggaatgagttgagaaggagtccctccgatggaatttttgagaacagtttcagtagaaatggtaccaacacttatttgtacatctgatagaatttggctgtgaatccatctgctcctgggcttttttgttgttaggctatttattacagattcaattttggagctcattattagtctgttcagggaatcaatttcttcctggttcattcttgggaacgtatatgtgtccaggaatttatctatctcttctaagttttctagtttgtgttaatagaggtattcatagtagtttctgatggtttgtcttatttttgtgagacagtggtaacaacctgtttataatttctaattgtgtttatttgaattgtctctctcttcttttttattattctagctagtggcctatcttatcaattctttcaaaaaacaaactcctgggttttttcatcttttgaatggttttttgtgtctcaatttccttcagttcagctctgactttggttttttcttgtcttctgctacctttggggttgatttgttcttgcttctctattctttcagttgtgctgtttgattgttaattagagacctttcttactttttgatgtgggcatttattgttatgaattttccctttaacactgcctaagctgtatcccaaagattctgagatgctgtgtctttgttctcatttgtttcaaagaacttcttgatttctgccttaatttcattatttacccaaaaatcattcaggagcatgttgtttaatttctatgtaattgcatggttttgacggattttcttagtcttgacttttatttttcttgtgctatgatctgagagtgtgtttgatgcaatttattttcttttgcattgggcaaacaatattttctgtccaattatgtggtcgattttagagtatgtgccatgtgatgatgagaagaatgtatattctgttcttttggagtggagagttctgtaaaagtctatgagagccatttggtttaatgatgagttcaaatactaaatgtatttgctatttttctgcctacattatctgtttaatattgtcagtagagtgtttattctcccactattattgtgtgggagtctacatctctttgtaagtgtctaagaacttgctttatgaatccgggtgtccatgtattgggtacatttttcttttgttttctagttgtttttgagttaggtatatatcttatattattcttttcattcttattgataaaagaggcaagaactaagaatgtatatatgtcagatatttaggtcttcttgttgaatggaaccctttaccattatgtagtgcccttctatgtctttgaaattaggattgcaaccatgctctttactttcttccatttgcttggtagattttctttcatcccattacttttgagactgtgggggtcattacatgtgagatgtgactcttgaagagagcataccattgtgttatctagaacacctcatactctcagcccaaaatgtccatcagcgataaacaactccagcaaagtttcaggatacaaaataaatgtacaaaaatccttaccattcttataaagtaacaacagacaaaccaagggccaaaccaggtaggccattctattcacaattgccacaaaaagaataatatacctaggaatacagctaaccagggaggtgaaagatctctacaataagaattacaaaatactgctcaaagaaatcggagatggcacaaacaaatggaaaaacatcctatgctcacagataggaagaatcaataccattaaaaaggtcatatagccaaaagcaatttatagattcaatactacttctgtcaaatgaccaactacattcttcaaagaactagaaaaaaaactattttaaaattcatatagaaccaaaaatagcttgactaaccaaggcaaccctaagcaaaaagaacaaagctggaggtatcacatcacctgacttcaaactatactacagggctacagtaaccaaaacagaatgacactcatacaaaaacagacacatagatcaatggaacagaataaagagcacagaattttggcctcaccccaatgaccatctgatcttcaacaaaggagacaaaaacaaacaatggggaaacgactgcttattcaataaatggtactgggataactggataaccatatgcagaagattgaagctagaccccttccttatactacatacaaaaatcaactcaaggtggattaaaggcttaaaagtaaaaccccgaaatataataacactggaagtcaatctaactaatgcaatcctggacatatgaatgggcaaatatttcatgacaaagatgccaaagcaatcgcaacaaaagcaaaaattgacaagtgggatctaattaaacttaagagcttctgcacagcaacagacaacctacagaatgggaaaaaatatttgcaaactatgcatataacaaaggtctcatatccagaatctgtaaggaacttaaacttacaagagaaaaacaaacaaccccattaaaaagtgggcaaataacatgaacagatgcttttcaaaagaagacacatatggggccaaaaagcatatgaaagaaagctcaatgtcactgattattagagaaatgcaaatcaaaagcggaatgaaataccatctcacatccatagaatggctatattaaaaagtcaacaaaataacagatgctgagaaaagggaacacacactctgttggtgggagtgtaaattagttcaaccattgtagaagacagtttggcgattcctcaaagacctaaagactgaaatatcatttgacccagtaatcccattgccgggtatgtagccagaggaatgtaaatcattctaccatgaagactgtagcttttttggatagttctttattactttattccatagagtttgatctgtttaaaccttcaatctcatttggagtcaattttgaagattctgttttcctagtaaattgtaaattttatatagaatctcaaatatattttgaaagaggtgttttaaatttcctctgctttaatatttcccctcatattttcttttaggtatttgcctttaccctctttttctttttgattaggctaattagggctttgtctacaccgttgaatttttagcaaagccaccattttgatttatttatagttctaataagatgttttctactttctactttattatatttttatatttattttttgtttttcttttgttttctagttgtttttgagttaggtatatatcttatgttattcttttcattcttattgatgaaagaagcaagaactgagaatttccctctgattactgctttaagttgtatccaatagaacctaatgtagttttaacaattatttttgcttagaaattctgcaaatttagttttttatttcccttttacctatattcaatagaaagtttttaaattttcaagttaaagggaatttttgttcttaatattgttattaatttctaatttattgtattgtgatatgagaatgttatttttacttctgttttacagaatttgttgtgatcaatttttgtaaatgattcatatgtttataggaagttttatgcacatctataatgtctacattattggtgtgttgcttttgtctattgcactaagaatgttattttaaactccccataatattgctttatagttgtctatttttttctgtattatgaagtttttgctgcctgtttggtgcaaaaagatccatattgttctgtctttgatgtaaattttaacttttactttataaagtttccctcttcctttcattgttgcctttggcctgctttctgctttgcctgatatcagtattacaacctccacttttctattgtttgtgtttgtctctgaacggttgcccataacttaacttgcagccatcctgaatcacttaattttggtttaactgtattttgtgtaccactccaaaaattatttgatttgttgagtgagctaagcccatgtatatgtgttaatataactgatacatctggcatcaaagttttatttttttgctacatttaatgtgtacactttgttatatttactgtttctaatttctgtatttttttctttgctgtttaattgtactccttttgctatttagaaagttaatactattgcagtagctacctttaacacatttcataatgacttagttcctcctttttaaaattagctttttaatattagaattggcagctttagatatatttatttagaagttatatatttagatatctatatttagaattgtaggcttagatattcttttatttccatttattgtctatgtggcaatcaatgagcctattgtacttttctccttttatatacctcccattttttcagttatgttttcttctcatttattacaatttagaacactgacatactaaccttcaacactgtactcacctgaattttattcttagagcttcacttaaataccttaagtaaatactaccagtccttttcccaaagttcccccatcatgtgttaatcaaatgaaattttttatctctagatgcctcaaaatgtgctcatgagtaaaatatttccagattactcgaatgcttacagcatttgcatggttacagcatgttatataaccttaacacattaaggatactgtgatagaaaagaatccttacctcaaattttctttcctttttttaaaacttttattttaggttcagaggtatatgtgcaggtttgttatataggtaaattacatgtcacaggagtttggtgtacagattattttgctaccaagataataaacatagtacctgataagcagtattttaattgtcaccctcctacctccctccaccctcaagtaggcaccagtgtctgatttccttcttcaaggtaatatatattcaatgtttaactcccacttataagtgagaacatgcagtatttgtttttgtgttcctatgttacttcacttaggaaaatgacctccagctctatccatgttgctgcaaaggacatgatgtccttcttttttatggctgtattccatggtgtatatgtaccacattttctttatccagtctagtcttgataaggatttaagttgaattcatgacttcgctactgtgataagtgcttcagtgaacatacatgtgcgtgtgtctctatgatagatggtttatattcctttgggtatgtacccaataatgggatcactgggtcgaatggtaattctacttggagttcttcaagaaatcaccaaactgatttccacaatggctacactaatttacattcccagtagcagtgtatacacattcccttctctctgcaacctcaccagtatctgctattcgttgactttctaatgatagttattatgactggtataagttggtatctcatcgtggtgttgatttgcatttttctaatgattagtcatgttgaacattttttatatgcttggtgaccatgcatatgtcttctttctaaaagtgtctgtttatgtcctttgctcactttttcaaatttattttttattactttaagttctaagatgcatgtgcagaacgtgcaggtttgttacacaggtatacatgtgccatggtgatttgctgcacccatcaaccaatcatctacattaggtatttctcctaatgctatccctccccttgtcccaccccccgggcctgagtgtgtgatgttctcctccctgtgcccctatgttctaattgtgcaactcccacttatgaatgagaacactggtgtttggttttctgttcctttattagattactgagaatgatggtttacagcttcatccacgtccttgcaaaggacatgaactcattcttttttatagctacatagtattccatggtgtatatgactttgcccacttactttttgttttttttgtttttattatactttaagttttagggtacatgtgcacattgtgcaggttagttacatatgtatacatgtgccatgctggtgcactgcacccactaactcgtcatctagcattaggtatatctcccaatgctatccctcccccctacccccaccccaccacagtccccagagcgtgatgttccccttcctgtgtccatgtgatctcattgttcaattcccacctatgagtgagaatatgtggtgtttggttttttgttcttgtgatagtttactgagaatgacgatttccaatttcatccatgtccctacaaaggacatgaactcatcattttttatggctgcatagtattccatggtgtatatgtgccacattttcttaatccaatctatcactgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcccatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttcttttcagaagtgtctgttcatgtccttcgcccactttttgatggggttgtttgtttttttcttgtaaatttgttggagttcattgtagattctggatattagccctttgtcagatgagtaggctgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccgtgcctatgtcctgaatggtaatgcctaggttttcttctagggtttttatggtttgaggtctaacatttaagtctttaatccatcttgaattaatttttctataaggtgtgaggaagggatccagtttcagctttctacatatggctagccagttctcccagcaccatttattaaatagggaatcctttccccattgcttctttttctcaggtttgtcaaagatcagatagttgtagatatgtggcattatttctgagggctctgttctgttccattgatctatatctctgttttggtaccagtaccatgctgttttggttactgtagccttgtagtatagcttgaagtcaggtagtgtgatgcctccagctttgttcttttggcttaggattcacttggcaatgcgggctcttttttggttccatatgaactttaaagtagttttttcccattctgtgaagaaaggcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaaattgcttatcagcttaaggagattttgggctgagacaatggggttttctagatatacaatcatgtcgtctgcaaacagggacaatttgacttcctcttttcctaattgaataccttttatttccttctcctgcctaattgccctggccagaacttccaacactatgttgaataggagtgctgagagagggcatccctgtcttgtgccagttttcagagggaatgcttccagtttttgcccattcagtatgatattggctgtgggtttgtcatagatagctcttattattttgaaatacgtcccatcaatacctaatttattgagagtttttagcatgaacggttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtgaataagctttttgatgtgctgctggattcgttttgccagtattttattgaggatttttgcatcaatgttcttcaaggatattggtctaaaattctctttttttgttgtgtctctccctggctttggtatcagaatgatgctggcctcataaaaagagttagggaggattccctctttttctattgattggaatagtttcagaaggaatggtaccagttcctccttgtacctctggtagaattcggctttgaatccatctggtccctgactctttttggttggtaagctattgattattgccacaatttcagttcctgttattggtctattcagagattcaacttcttcctggtttagtcttgggagagtgtatgtgtcgagtgatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattaatttttggaagggttttttgtgtctctatttccttcagttctgctctgattttagttatttcttgccttctgctagcttttgaatgtgtttgctcttgcttttctagttcttttatttgtgatgttagggtgtcaattttggatctttcctgctttctcttgtggacatttagtgctataaatttccctctacacactgctttgaatgcgtcccacaggttctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtctcgttgatctgtccaacgttgacagtggggtgttaaagtctcccattattaatgtgtgggagtctaactttgcccactttttaatggacttgttttttgctttttgatttcttaaagttccttatagattctggatattagaactttgtcgtatgcataatttgcaaatattttctcccattctgtaagtggtgtatttactctgttgttagtttcttttgctgtaaagaagctattgagattaattaggtcccatttgtcaatttttatttggttgcaactgcttttgttttcttcatcataaaatctttgccaggtcctatgtcaggatggtacttcctaggttatattccagggtttttatactttcaggttttgtatttaagtctttaatccatcttcagatgattttgaatatggtgtaaagaacaggtccagattcaacattctgcatggggctagtcagttattgcaacagggagttgcaatatttattaaacaggcagtcctttcctcattgcttatttttgtcaactttgtcagggatcagatggttgtgaaacaggagagttctgttatcccttttgcagggtgttcaacaggggtgtggctcacttcttcggtgccccactgctcaaacccctaggggaaccgtgcagacaagcaggtgaagaggttgtggggaggatttttgggcttcgaccccatggcagtatctaggggtcagtgtttacaaagcctgaaacccaaataggcatgtgttacattgtgctctttcagctttgctagctacaggcagcttgtgttaatcagctcaatcagactctacaccttgtcataaggacagatggctttttgtatcccgggtccttgccctagtgtaccagaaaaatggaatcacacatgggcttgcaggatgagtgcaaggttttattaagtggtggaggtagctctcagagaaatggagatagatggggagtcagagggggatggattaggaaggtggtcttcccctggaattggattgcccagcagccagactctcctctgatatccccaagctgaattccccttggcatccacatcatttcaccattcctggtctgctggtgtctgctgaagtctgtcagtgtgttctgctcctctcaactccagctgcttgtgtctgtacccactgtggtcttgagtttttatgggcacaggatggtggcatggcgggccacagtggtcttggaaaatgcaacatttgggtgtaaaaacaggagtgcctgttctcacttaggtccgtgggcacaggcctgagggtagagccctcaccaaggaccccatccttctctatccagcacttccctgctcccatcccatgtcagttgcaggtgtgcagcattatttctgagctctctattctgtttcattggtctatatttctgtttttgtaacagtaccatgcattttggttactgtagcctcagtatgatttgaagttgggtgatgtaatgccttcagctttgttctttttgcttagaattgccttgacaattcaagcttttttgggttccatatgaattttcaatttctttcttttttgtaattctgtaaagaatgtcattggtagtttgataggaatagcatttaatctgtaaattgctttagataggatggccatttaacaataattattcttcctatccatgagcatgaaatatttttacatttgtgacttctctgatttctttgagcagtgttttgtaattctcattgtagagatctttcacctccctagttagctgcattcctaggtattttattctttttatggctattgtgaatgggattgtgttagtgatttggttgtcagcctgaatgttgttgttgaatacgaatgccactgatttttgtatgttgatttttgtatcctaaaactttgccaaagttgattatcagataaatgagttttggggcatagactatggggttttctatgtgtagattcatatgatctgcaaataaggatagtttgacttattctcttcctatttagataccttttatttctttatcttgttcaattgctctggccaggatttacagttctatattgcataggagtggtaagaaagaacatccaggtcttgctctggtttttataggaaatgtttcaagctattgcccattcagtatgacgctggctgtgggattgtcatagatggctcttatttttttgaggtttgttcattcaatgcctgcttgttgaaggtttttaacattaagcaacattcaatttcatcaaaagccttttctgcatcttttgagattatcatatggtttttgtttttaagtctctttatgtaatgaatcgcatttattcattttgcatatgttgaaccaaccttgcatcccattgataaaggctctttgatcatagtgcattagctttttgatgtgctgctggattcaatttgctagtattttgtttaggatttttgcatggctaccaaagacaatggccggaagttttccttttttgttttgtctctgccagatgttggtatcatgataatgctggcctcctagaacaaactggagaggaatccctcctcctcaatttttttggaataattttcatataaatggttccagttcttaacatatcttacagaattaagctgcggatttatctggtcataggcttttttgggttggcaggcttttattactgattcaaacttagaactttttattggtctgttcaggaattcagtctcttcctggttcaatcttgggaaatcgtatcattccaggaatgtatccacttctaggttttccagcttctgtcatagagctgcttgcagtagtctgagggtttttgtatttctctggggtcagtggttatgtcccctttgtcatattcaattgtttttatttttatattctctcttctttaagtctagctagtggtctatctatcttactaattctttcaaagaagaaactcctggaattgttgatcttttgtttgctttttttgcatctcaatcttcttcaattcagatctcattttggttatttcttctcttcttctggctttggggttggttgcctcttgtttctctagttcctctagttgtgatgttagatttttaatctgagatctttctaacattttgatgtgggtgtttaatgccataaactttcctcttaacactgctttagctgtgtcccagagaccctcttatgttgtatctttgttttcattagtttcaaagaatttattgatttctattttaatttcattatttacccactagtaatttaagagaaggttaatttccatgaaattgtatggttatgagtgattttcttagtattgatttcaatttttttttgcactgtggtccaagagaatgtggttggtatgattttgatttgttgctgttgtttttgaatttaagaattgttccatggccaatcgtgtggtcagttttaaagtatgggacatgtgcaggtgagaagaatgtacgttccattgtttctggttggagagttctgtagatgtatgttaagtccatttggtcaagtgttgagttaaaggcctggatatctttgttatttttctgccttgatgatctgtctaatattgtcagtggggtgttaaagtccctcactcttattgtatggttatctaagtctctttgtaggtctataaaaatttgctttacgaatctaggtgctcctgtgtttggtgcatatatatttacataattaaatcttgttgagttgagccctctacaattatgtaactcacttctttgtgttttttatcttagttggtttaagtctgctttgtctgaaattagaatagtaacccatgcttctttctgttttccatttgcttggtagacttttcttcatgcttttactttgagcctatgggtatcactgcatgtgagatgggtatcttgaagacagtatccaattgggtcttgcttctttattcaacttgccaaactgtgccttttaattggggcatttagtccatttacattcaaggttagtattgatatgtgtggatttgatcctgtctttgtattgttaccttgttattatgcagacatgttagtgtggttgctttattatgtcactggtctctgcaattaaatgtgattcttttgtgtcactggtctctgcaattaaatgtgattcttttgtggtgagcattgattttttctttccataagcactcccttcaggacctcttgaaaggtacgtgtggtgataacgaattcccttggcatttgcatgtctgaaaataatcttatttatccttcgcctataaaacttagtttggctgagtatgaaattcttgtttggaaattcttttattcaagaatgttgaatataggcttccagtcttttctggcttttagagtttctgctcaaatgtccactgttagcctgatggggttcactttgtaggtgttttggcacttctctctagctgcctttaacactttttccttcattctgaccttagagaatctgataactatgtgtcttggggatggtcttcttgtgtactgttttgcaggggttctccacatttcctgaattattacattggcatctgtattgaggttggggaaattttcatggatgatatcctgaaatatgttttccaagttgcttgcttcctctccttctcttagggacaccaatgagtagtagatttggtctctttacataagaccacatttctcagaggtttcgttcattcttccttattgtttatttatttttgtctgactgagttattttggagagccatcttcaagttctaagtttcttttctctgcttggttgattttgctgttaatacttgtgattgtattctaaaattcttgaagtaagtttttcatttctatcagatcagtttggttatttcttaaaatggccatttcttcttttatctcctgtatcattttactgcattccttagagtcctcatattgagttttgactttctgctgaacactgatgctcttcattcctatccagagtctgaattctatttctgtcatttcagccatttcagcctggttaagaaccattgctggggaaatattcctgtttttggaggtaagaaaacactctggctatttgagtttccagagtgcttgtgctgactctttctcatctttgtgggctttgaagttactattctttggatttttttcttttatcttctttgatgcccttggggtttggttgtggtataagatgggttctgctgacttgcttcttttccggaagatttttagggggccaaagctctccttaggactcctggactgcataccatcattctaaggggcaggtatcaggcccctgcctttgttctctggcctttagaggttagaatcctgctgtgctggaggggccaacatgttcctggactgctggttacaacactcgatgggtggtggcagccaaagcacttcattgggtgctggcagtgggatctatgcatattcacatatgccagcagcagtggcagtgtggcaggttacataggctgaggtagggcacttgaaggcatgagtctggtgtcttccctgtgcacaatcatgctggcagcagttgcagcacagggagggagatggggctgctggtttctatgcacacccttgcattggcaatggtgcagcaaaggggtgatatgttcatgccagcagcagtggcacgatggtgtgcatgtgcacacacatgccagtggcaaaggggaggcaaggtccacccatgtgcacctgccccagcaaagcaatgtggtgggtgactgtaggcaagtgcattcctgcaaagtggcatgagggaggcagtggtagagggtggcaggtgggctagtgagcacagccaggtgccgccctgctggagctctcttatggtcaggtgtggtctgttactgcagaagctatgataagggccctcaagagacaccccagctgggcatccaaggctgcactgaaagtaggcatggctaggctggggttccaggagaagctagcatacggcgggggctctcaggtcagatcagccccaactcatgggcaggattgctctactctgtccaagcaccacagttcccctgtgactgaagtctcataaggaagtaaggcaatccttggagtgtggggatccctggccatgctccactgaagatgctcctataccaaaccctctgggctctgtaccagctggacttctgccagtaccacctcactaagcagctctccctgccagctcaagtgtccatagggtcatggggtctcctgctaccaagattccagaggtccatggtgagaggccagttgctcctcacctgctcaactcatcccttccccaggagttgttggggaccagggactagttgtggtgtgtagcagcagccctttgcagagttcccagtttcctctccattcagcctagcttatttaacctccctccatctactctcaatgccatccctctgaatatgtgctcagaatgcaccagtcttctggatgccccattcctctgtggcagattttcctccttgctgcatctagtcagccatattgtctctcaataaatcctttaatttcttaaaaatgttttaccattgttacctatcagtaactgaaggatctgagattggggtattatttactggggagctaataaggaagccagatactgcttttatggatgatgggaaaagacataagactcctggcccagagacaaagggctctattactcatgcactgtaagaagcatgaacatcagcatatttttcattacttcctcttgtctgcaagtcctacagcaatgatgcaggtaggaactgaatgtctgaacatagagtagcttgtgttataggaaagaaatcctgagcttagtaaaactatatcatttacaataggtggtaaccatacctaccctttgttccagagggagatactatatcttccaagactattcactatacaaaaatcctggaaaagatagtctggaacaaaagacagtcagtgcctctgcttgcaaggcatgtagaagcacaagagatccataggtaattgtctccccagattaccttgatttatataatgacaacctaattttgttggtacaaagaatcttcagagattttactggtgtcaagtttctcatatagtcatgaatataaggaagggtatgctttttgtagtgtaggttaaagaagactattaaaaaaaaggtgcatatgagtactaaaccccttctactcagtcatgccacgcatgaccccaagtcttaggttttctatctcttttgacatcataaggcttggggtaatgtatggcatgagagaatattatcatgaaggtcagaggggttacctagaacctgcatcttagcttccacttatgagcactcagccaatgcccaggacacatctcagaacaatgaattctgaaactgtgaatctgggatccagatggcaggacattttaaagcttcccaggtgattccaatgtgcagccaaaggtgagattgagctctgatttcaatgcaaagataaaacctgattactggccaggcacggtggctcacgcctgtaatcccagcactttgggaggccgaggcaggtagatcacctgaggtcaggcgttcaagaccagcctggccaacatggtaaaacccatagctactaaaaaaacaaaaaacttgctgggtgtggtgacgggtgtctgtaattccagctactcgggaggctgaggcaggagactcacttgaaactaggaggcagaggttgcagtgagccaagatggcatcattgcactccggcgtgggcaacaagagcaaaactctgtcaaaacaaacaaacaaacaaacaaaacaccctgaaggtctataggagataacacttattttaggagagatttttaatgccatttttccttctttatgaggtacagactttgaatacttatcttcaaatgcacaacaaaaacttgaggacagatgactaattattttcgtaagacagtttgtgatattgcaggcaaattcttcagtagtttagctaataacagagatagtatttaaatgttcaaaccaaagtttcatgtgggagggaaaaagagatattttaaacttcaaagtgaatatgatttgccctggaagtcacagctactgcaaagcacttaaaattatttcagacagctagtctgtcggatcactgttatagctaggcattcctcaccctataatttggggaaagtgggtactgaaagatagagaattcacagagcttagcttttagctttagatgaagagttacactgttgactttatacaaaaaattctatgtgcttaaagcatatcttacagaatgctagccaactcactttggcagagatacatgcagctaaaattgcttcccttctgactaatactatatattcagcattttcctgataggcacactcttggaagaagtcctcagatatacactgaattactctgtgaataaaatatttagtctctttagagcccttaaacagagccttgacttatcgactccaaagctgctgactttctacagttcaaatcagtagacttcccacatgaccttaccgttaatgataagtaaagcacttagctacccctagaagactattataaactaccataaaatgtttaaaatgtcttttaggaggcataagtgaaaatgcttcaaaatccactgaagaagtgtatccacacaatcaaatttcattataaggtatgagcaaagactgatagaatgcttacaaaataaaatgcacaagtcccatttaggatttagcatgtttaaaaactataccaaggctaccaaattaacatgatggcaaatgtaaagatgatctcaaattgtgttcatatgctattttttcccaaataattcaaaacattttaaagagcatcaaactattaaatcaaaagaggtagattcttactaaccccattttttttttttttttttttttttagagaaaggagatcacaagaaatcaattcatggtccaaatgaactactacttggagccagtcaaatttttttttatacactgaggccaggtgatttggaaaaggcaattaagtaagtgtacagtaaaaataaggaatatatacagtatatgtagttgtcaatgaaaatctgcaaactcattaccatcaaaaacacaagaaaagtttggttataagagttaatcttctggtaaatatttagttaatccttttttaaaaaaaattatcttgcttgcccttggattaagaaagaccatcagagagctactcatagaaatgctgttacaggacaatactttgctttttatcattttactgacagtgcaaatattactgacaaatgttctctgatgactatatctccaatacactgtgttcatactccataaaaatgttctctaaagccattttttcttaatagattactttgttttcattttaaagatagttgtcaatgataatttattcttctgcatttgcttcttgaaagcagaatcagtgagcaatctttataatatgcacacagcctacctctggattcatgttatgattacaactctttttctcatttgtcttgatttactatagtcatacaaaaatttttctagtttaaaagtaacataaagtaaaactttgaaagtggaaaaaggaaaatatgtaaaattcatgttttttctatttttttgagtctagataatttataatgatacatcttcatatttgcttttaagtaaatgtacatttatattacagggcaatgtacattgtaattttgtagatgcacatttattttgtttctaggaggttttttaagttactgctttaacagttgtctattccattatttttctcctcttggttttcacttactcatatactggatctcctttacctgtattacaaccctatcattttgccattaatcctctttgaaatgtttacttctattttcttttgcttgttatttgtaccatttttcttacaatgtttttctcaaatgattcctaattacatcaactttttaattgacaaatagaaatggtatatatttatggtgtacaacataatgttttgatatatgtatacatagatacccagtaatgggattgctggatcaaattgtagctctacttttagttctttaaggaatctccacactgttttccatagtggttgtactagtttgcattcccaccagctgtgtaaaagtgttcccttttcaccacattcattccaacatctgttattttttgacattttagtaatagccattctaagtagggtaagatgaggttttattgtggttttgatttgcattcctctgatgattagtgatgttcagcattttttcatatacctgttggccatttgcatatcttcttttgagaattgtgtattcatgtccttggcccactttttgatggaattgcttgtttatttcttgctgatttgtttgagttccttgtagattctggatattagtcctttgttagatgcatagtttgtgaggattttctcccactcgataggttgtctgtttactctgctgattatttcttttgctgtgcagaaactttttagtttaattaagtcttatctatttatctttggttttgttgcatttgcttttgggttcttggtcataaactctttgcctaagccaaagtgtagaagggttttttcccatgttatcttctagaatttttagagtttcaagttacagatttaagtctttgatccatcttgagttgatttttgtataaggtgataaattatgaaccagtttcattcttctacatgtggcttgccacttatcccagcactatttattgaataggacatccttttcccactttatgtttttgtttgctttgttgaagatcagttggctgtaagtatttagctttacttctgggttctctattctgttccattggtccacgtgcttatttttatactactgtcatgttgttttgataactatagcctcgtagtatagtttgacatcaggtaacatgatccctccagatttggtctttttgcttattcttgctttggctatgtgggctcttttttggttacacattaattttaggattgttttttccagttctgtgaagaatgatgatggtattttgatgggaattacattgaatttataaatgacttttggcagtaagatcattttcacaatattgattctgtccatccgtgagcatgggatgtattttcatttgtgttgtcaacaatttctttcagcagtgttttgcagttttccatgtagagacctttcacctccttggctaagtatattcctaaggtttggtttggtttggtttttgcagtcattataaaagggattaagttcttgatttgtttctcagcttggttgttggtgtacagcagtgctactgtgtacatttggtatcctgaaactttactgaattcattcatcagatcgaggagctttttagatgagtctttagagtttcctaggtatacaatcatatgatcagtgaacaatgacagtttgactttctctttactgatttagatgccctttatttctctctcttgtctttttgctctggctaggcctttcaatactatgttgaatagaatggtgaaagtggccaaccttgtcttgttccagttttcaatgggaatactttcaacttttccctgttccatataatgttggctgtgggtttgtcataggtggcttttattaccttgaggtatgtcccttttatgccaattttgttgagggttttaatcataaagggatgctggatttagtcaaatgctttttctgagtctattgagatgatcacataattcttaattctgtttgtgtgatgtatctcttttattgtcttacatacgttaaaacatccctgcatccctaatatgaaacccacttgatcatggtgtattatcttcttaatattctgttggattcggttagctatgtattgcatcaggatttttccatctatgttcctcaaggattggtctgtagttttctttttctttttttttttttttttgttatgtcctttccttgttttggtattagggtgatactggcttcatgaaataattagaaaggatcccctttctctctatcttttggaatagtttcagtaatattggtatcaatttttcttttaatgtctgatagaattcagctgtgagtccatctggttctagactttttttgttggcaactttttcattactgtttaagtctcactacttgattttggtctgttcagagtttctatttcttcctgatttaatctaagagggttggttatttccaggcattttccatctcctgtagattttctagtttgttcacataaaggtgttcatagtagccttgaatgatcttttgtatttctgtggcattggttgtaatatctcccactttatttctaattaagcttatttgtaccttttctcttcttttcttggttaatcttgctaatggtctatcaaattttttatcttttcaaagaagcagcttcttgtttcatttatcttttgtattgtttttgtttctattttatttatttctgctcaaatttttcttatttcttttcttctactggctttgagtttggcttgttcttttttctctagttccttgaggtgtgaccttagattgtctatttgtggtctttcagacttcttgatgtagacacatccctcattgatgcaatgaactttcctctagcaccacttttgttgtatcccagaggttttgataagatgtgtcactattattgctcagttcaaataattttttaatttccatcttaattttattgttaagacaaagatcattcaagagaagattatttaatttctatgtatatgtatagttttgagggttcattttggagttaatttccagttttattccactgtggtctgagaggatactttatataatttcaattttcttaaatgtattgtgactggttttgtgacctatcatatggtttatcttgaagaatattctatgtgctgatgaaaaggatgtatattctccagccgttaggtcgaatgttctgtaaatatctgttaagtccatttgttctaggtgatagattaagtccattgtttctttgttgactttccatcttgatgacctgcctagtgctgtcagtagagtattgaagtcccccactattactgtgttgccatctatcttattttttaggtctagtagtaactgtcttataaatttgggaggtccattgttacgtgcatatacatttaggattgtgatattttcctgttggacttatccttttatcattatagaatgtctgtctttgtcttttttttactgttgttgcattaacgtctgtttcgtttaatataagaatagctagtcctgctagctttcagtttccatttgcatggaataactttttccactcctttaccttaagtttatatgagtccttatgtgtgagtctcctaaaggcagcagatacttggttgatgaatttttatccattctgctatcctgtgttctttaagtggagaatttaggccatttacattcaatgttagtattgagatgtgaggtactgttctattcatcatgttaattgttgcctaaataacttttcttttcattgtgatattgtttcataggccctgtgagatttatgctttaaggaggttcattttgatatatatttcaaggttttgcttcaagaattagaattccttttagcatttcttgtagtgccgcattggtagtggtgaattctctcagcatttatttgtctgaaaaagactatctctccttcatttatgaagcttagttttggtgaataaaaaattcttggctgacatttattttgtttcaggaggaccccactcccttctggcttgtaaaatttctgctgaggaatctgtggttcatctgacaggtttaacttataggttcctgatgcttttgtctcacagctcttaacattttttccttcatcttgactttagataaccagatgactatgtatgtacctaggtggtgatctttttataatgaatttcccaggtattctttgggcttcttgtatttggatgtctagatctctagcaaggccagggaagcattcttccattatttcctcaaatatgtttttgaaacttttagatttctctttttcctcagaaaaataagttagtcttagatttggccatataacataaacttaaatttctcggaggcattttaatttttttctgatatttttttcttagtatatgtctgattgggttaatttgaaagccttttctttgagctctgaagttctttctactttttcttgtctattgttgaaactttccagtgcattttgtatttctctaagtgtgtctttcatttccagatgttttgattattttttctttatggtatctatttctctggaaaatttttatgcatattctgtggttttttttttaattctttaagttgggtttcacctttcactggtatctccttgagtagcttaataaacaaccttctgaattcttaatctggcaattcaaaggtttctttttggtttggatctattgctggggagctagtatgataatttcaaggtgttagagaaccttgttttttcatattacaagaattacttttctggttccttctcatttagatagactatttcagtggaaagatctagaacttaaggcttgctattcagattctttttttccatggggtgatcccttgatgtgcgctccttctttctctaaggatggggcttcctgagtgttggactacagtgattgttattgcttttctgcatctagcaacccaggctagatgcaggctccaggctggtgctggggaatgtctgcaaagagtcctatgatgtgatccatcttctggtctccaagccatagataccagcacctgctctggtgcaggaaacaggggagtgaactagactctgtaagagtccttggttgtagttatgtttattgtgctggctttgtcaaatgtttatgctagcagtgaagttgtgacatggacaggcttgggaaattccggctagcctggatgtttcaggcagtagaattaactgttgttttctccttcttggaatcagggttattctgtcatgagttatgctgtaatggcctgagttagttggcttccagccaggaggtgcactttcaagatagccccagatgcagtagtagtagggggatctaagcttgcactaagttggccagcataagcattgtggttcctcaggcaatgggcatggtcataaagctcccaagattttatgtcttttgtctttggctaccagggtgggtagagaaataccatcaagttagggcagagttaggtgggtctgagctcaggctatccttgggcagggcttgtcacggccactgtctttaccatacagatctcagaagtcacgcagcagccatccacatgaatctactggaggtaaacaatctacagtggtacttttgcttcctgaaatcctgagaaaaccaagcttctttgagctctctgctggaccatttctcagacctcatttatacagttccaagaggcacattttactaaatcttcccaaacagcagtataaaggtaagaacagagtgagaaaagaccatggccttgctattgattaagggaagtcctagaaaatactaaacaatacttttgcttatacaccattgacaagaattatgttatatgctcacatgttgatgtaaaggagcctgggaaatgtagtctttattgcagaccggcatgtgcctacctaagaacaggggtttcaattatcttggaacaaaaggaaaatgaatactgtggaacaaactagcactctagtgctatgccagaaaatggatttgggttacgtttataccatgactgaaaaggtatttgagttatgtttctaaccctttcatttgtcacaaaaaaaaagaaaaagaaagaaggaaaaaggagaacagcaaaaaaaagaaaaaaaagaaaaaatagactaataaatgtccagaaagaatctcaaaagtaacagtgttcaatctagatgaatatattcaacagatggagaaaattacaaagaaaacagagccataaattttaaaaataattaggataaattagaagttgtaaaatgtaataaactataataaaataaatttggtattaaaagtattataattccttaccttcttgcatcctatgacaaagacagtagaactcaatagtgctacatttttataagaactaaatgcaagtaacgtggataaagactacaccattaatatgtagttttattgaatctgaaattatttgctcactactccattaagaggctaagttatgatgggggactaatgctggattggggcaggaaaggattgacagagtggaaaataaatgttggaaggcaacctgtggtcacaatcatacttttttattacatctctctgattctgacacagttaaaaatacactcagaatttgagaaaataaggcataatttctagatatcattattacagcagacagacaattatgcaagagcactaaccaaagcaattatactaccagcatggggcaacggcagccattttgcaaatccatttgcaccctccttcctctcctcagggatgcactgagggcataaatgatttcttccactcttatttccaaattatctatatgatgatgagtaagggctgttccattccaaccttacttatcatcccattaaacagtggaaaaatgtggacagcaggaatattgaaaattctgtctgcatttacaatccaatttcctacaaataatcttccagttctggctgaaaagtcaagcacaatgagcttcacatctggtggatgcagtacatcaagttaccaccccactcagcacacaggctttactgccaaatgccagaacatcctgcagcaggagcaatggaaagacctacattctattgtttataaactcattgtgtgggaaaagcgtagttaagctggttctattctaatcatctctgatggcacagggcaggtgattccaagataatggcacctttgaaatgggttttatggtgatgcaaaatttataatttgtaatagaaaattacattatgctagctactaggtcattttttccacttggataatagtatttttatctcttctgttctaatttagaagtcaatgcagtgtaaataactacagcatttgcttattaccatcaaattcacagaagcaaagatgattagagtcaattttgtcatttttgagttaatgtggtacaagggtattttagtgtctctaacaagtgtcaaagaaacaaaaaacatcaaatacaaacataccagttttgaattttctgctttttgtatactctccaaaagtttatttaggacatatccaatatagtttaccataaatagtacagataagcaagctgctcaaatccaaaggggtattttttgaggtagtcaatgcaactcaattgtattttaagactatctctcttgctttctctacattgtagaatttattaactattttgagataattttatacttacaaaaaaggttgcaaaaatagtacaatggaatttcagtaaatttgttttcatgcctcagtatatgttattaatgtgaataagaaatagtaaccaaaacagcatgatactggtacaaaaatagacacatggatatattaaaaagaatagataatccagaaataaagccacatacgtactaccaagtgatctttgacaaagttaacaaaaataaataataaggaaaggaaaccctgttcaataaacagtgctgggaaaacttgcaagccaaatgcagaagaatgaaactggacacctacttatcatcatctacaaaaattaatgtaagatggattaaaaacctaaatgtaatacctcaaactatacacatcttagacacaaaaactagaaaaagctcttctggacattggcctactcaaataatttatgactaagtcctcaaaagcaaatgcaacaaaaacaaaaattgatgattgagatttaattgaagagcatttgtacagcaaaagaaacaatcaacagagtaaacagacaacctacagaataggagaatatatttgtaaattatgcatcttctgtagattaatatccaggatctataaggagcttaaataaatcaacaagaatgaaaaacaaataaccccattcaaaagtaggcaaaggacatgaacagacacttctcaaaagaagacatatgagcagccaacaaacatatgaaaaaatgctcaacatcactaattatcaaagaaatgccaatcaaaaccacaatgagataccatattacaccagcagaacggctattactaaaagtcaaaaagcaatacatgttggtgaggatgtcaaggaaagtaacacttgtacactgttggtggaaatgtaaattagtttaacccctactgaaaacagtaaaaagacttctcaaaaaaccaaaaatagaactatcattcaacccaaaaatccccctactgggtatctacccagaggaaaagaaattgttctatcaaaaagatacctgcactcacatgtttattgcagcactattcacaacagcaaagttatggaatcaacttaagtgcccatcagtggaggactggataaagaaaatggggtacatatacaccatggaatactccacagccatagaaaagaatgaaattatgttctttgcagcagcaacgtaggtgcagctgggggacgtcatcccaaatatattaacacagaaacagaaaatcaaatactgcattttctcgcttataactgggagctaaacaataggtatgcatggaaataaagatggaaacaatagacactgaggactccaaaagaagggagggagggagaagagaaagtgttgaagacctacgtattgggtactatgttcactgttggggtgacgcgttcaatagaaacccaaaccccgacattatacaatttacccttgtaacaaacctgcacagatgcaccctgaatctaaaattttagaaatacaaaatataagaaaagaaatacccaaatgttatattcaagtaatattttcagagactatttaaaggagccttatcacagacttacatgaaaggtgggtatggtaagacattatttcttagcacttaaaaagtatgatgaattgctgcacctagtaatggttttatgtgcccctctagagaggagaaagaaaacaaaaaaccatcacttcaaggaagctcttcattaacctcatgaagctaactcagaattagcattaaatgccatcctggcccagaacttcttttgctacaattttggggcaattatgtatcactcttcaaagtgttatgaaattttttttggttagcccagaaacagtttataacatgatactacttgaccatggggatgatacaacataaatgttaactggattttcctgatagaagcaatgtcgctttataatttcttttatcaatttctcagctgtagaagccatctcctgcatttgttacctctatttgctgattatcttctattgaactagcttagatgttaatttgagaatgcattctgtttgtttgtggaataaaccaaatagtacattttctaatataacattttacttataaatgagttaacattttgttatatgaaacaggtttctttaaatcaaagatacaaaaagactttaaaaaaaaaaaacactgtatgctacatccacaataaatattttattgcctagagatacaaaacaatattttattatgtccaccagttaagcacttaaaaaagtaaatctgatgttcttcaagatgagctggcagtctatggtatgagaatacataatttttaaacagaaaagataaaatatataagcaatgatgctaccgaaaaaagtcaaagctatatcctgtgtcctctactgctccttccaaactccaataaatgaaaatattccaataggctcccactgaatataaatatatggagatacatatatctccgtaaggttaggaatgaaattagtttaagatttcttaactagtagaaaagaggggctaggaaacttagtagaagctatcgtttcacctgtggagatctgtgtttatatcctagctcaaacagaaagaaaaaattagtttgatattgacttatatatcccataacaatcacctgactaactctaactgcttggaaaatatcaaagcccaaggcagcactatgcaaaagcccaatatataaaacatttacaaacagtatgagaataattatattaataacaataatgtgaaaaataataataaagcacaaggaacagaaactaaatatgtttcatctccccctttattatcaatggtataaaagtcaattaaccaattatcaagcaccttctctgttcaaccatttctgtaagaaactgagagatataaagataaatatgtacaaacagaagactaacataactctaatgtgactctcattcctaaagggttatgcaacactaggtggggttgcatttatagaacttgagcactaaatagatgactgattctgaagaccaggagaactattcccagtgtacagcaggggccattggaatgcatttcaatccacagtgaacctctaagatatgcaaaaataactcatctgagaaaaaaatgttctgattgaatacaaaattactagttcacaaacatgcctgagctgcaccatcaagaaggagactgtttaataacagagattctcgggcaccacctcaactctttggaatctgcatggaattaatacttgcataaagaaacaccatttcactagatacctgtgagtcctgtagcatcttcaggcattttaagctaggaaaggccagggaagcaaatttacctaccccagggataagagtcagggaacttacatcatctctgggaacaagaatcaagttcacttaagcaatatcttaccaagttcttccaacttgttagctcacagccactggcctggacactatttggtcacatgcaacaatattgcttctcggccaattttaagaagctggcattttgaggattaaatgtggaggtttctgtgccatgtcctgtctaaagcaccactgtactagtccattttcatgtgactgataaacacatactggagactgggcaatttaccaaaaaaaaagggggggttaattggacttacagtttcacgtggctggggaagcctcataatcaaggcagaaggcaaggaagagcaagtcacattttacatggatggcagcaggcaaagagagcttgttcagagaaatccccatttttaacaccatcaaatctcatgagacccattctctatcatgagaacagcatgggaaagacccaccctcatgattcagtcatctcccactgggtccctcccacaacacatgggaattatgggagctacaagatgagatttgggtggggacacagagccaaaccatatcaaccacatattgccaaagtttaagtgaatgtcacatgatagaactcacagtgaaccgagtgctcctaattgaacaagatgccttcacagaggaaaaaaccataaaacattaaacctctaggtattttttccattgttcaacaagagaagtcatattgtcatattgactcagttgtttttaatgaagataaataatcaaaaccctcactttaagacactttaagtagataaagcaccataggaccactgacaataactgtcattagaaggttagggatagttgatttaccccactttctagagaaagagatttgtaacagggatatccttacactgagagttttaaaggaaagttaaggagaatactagccaggagaggaaagttaaggagaatactaggcaggagagggtgtttgggagtcttcaaagttgtggatatagaaacagacatttctcacaaagcatctagagtgccaacaccataaacccagcctcacctacattttatcccttggcagcttcatttgtgtaagtggacggtggcttccagctgaatgaaaccattacagctgaactggtgccatggtcagggttccacctatgaccctgtaccactagaattattaaacagtaaagacaaagaatgcatatctgccaaatttttaggtaatacaaaatagaaggatatcaaagatattggtccactttctgaattcaaaaatataatagtttataatgttgagacaaatatagcaagataatcataacagagttaattagaaggccctgtgtgtaccaatagaaagacaaaatcagcacaactgatcatcaaggtatgaatttgtagtagcacctaaacaatacaaagaaaattttaaatcagcaatatgccaaccctaagcaaactccaaagtggcacatttctcttattataatttatgagaagtacttggaaaagaaattacaacataacctataactttcttatcacacatttatttgtattacttgctaatttctctacaatatattatgttgaggtgttagcagttgcctttgtacagatatattgactatacttgtatgaatttaatccccacctctcttatttgcttgaagaggaaggacaaatttatttttggcaagaaatttaaagcaagtgattccttatttattgtcttagttattagtcacagttagaaaatcagtgatcatacgaacttatcaataaaatattttattcattgcttgtatcaaattgctagtgtatttgtcttctgtattttttaatatgacttttctaaaattggttctcctttcttagatacaatacttgctggaaaattcagggaggaaaagggaaaatattaatatttaagtcatgaggaaagaagattctttactcaaattatcactttcccactcagcagcagccctgagtaatatattcattataaaccagcagcactggatctcttttagtcactttataacactgacagaatcaatagttaaaattagacttctcattttcatatcagaggagacatcaacattagtttctatattaaacattctggaactgtagaaagctttttaaattaatttaaatgatggatgcagaattgtctgaccacttatttaatagaaattatgattatcaaccaaattatactttggaaaggcaatcatctcgtccctgcaaagcagtaatacagtttcagcccacaaaaagtactatgtatgaaaaagtattttacagtactttttatagttctgaagagtatcacattaccacttgtcaaccagcaattgcatcataattcaacctgctgcaactataaaactgtgtcttgacttgattaaacaaaagacacagtatagtgttgtacatatatgtgtgcatacagcaattctaggaatgaaaataatttaatatgcttagcatcaaaacatacaatgagacaaaagcagagcatctaatgaaaataaaatagattctacctttaattttctattccacttggtgtcagttttctaaagagtatttgtctacagacaaatcagctaaattttgacagagagctgattttatttcctttatctaatatagcaaagatctgaagaagagaggaatactatcctaaaagtgttcctcatgcttctttctatcacagcagtccccaacctttttggcaccaggggccagttttgtggaagacaatttttccacagatgggggcaggaaggggttggttttaggatgattcaagcacactaaatttattgtgcactttatttctgttattattaccttgtaatatataatgcaataattacacaactcaccataatgtagaatcagtgagactcctgagcttgtcttcctgtaactagactgtctcatccgggagtgatgggagacagtgacagatcatcaggcgttagattctcataaggagcacacaacctagatccctcacatgcacagttcacgatagggtttgcaatcctataagaatctaataccattgctgatctgacaaggggcagagctcagacagtaatgcgagcaatggggagcagctataaatacagatgaagcttcacttactcccccgccactcacctcctgctgtgctgccatgttcctactaggccacagacccttactgtagggttgaggatccctgctccatcaggtcatggcattcatagaaaatagtaagatatacctgccctaattctcaggggccataggagtctggccatggagctatggttgttcatcctaagtctcactggtcacccaaccagggctgaggggtcactatctcaatgtatgtgttacttatcagtggtgaaatgggttgggagcatctgatttaggtaattgtgggattcacaaatggaagaaaaactatgataaatattacagaacaaggagaatttccccagatccaaattatagaaaatgtttttggaggactgatatgattatttgtaaaaatttgaattgccaggatgctgggaagcatagtagttataagggaaggttttgccctgtgaatgccttagctcagaacaattccatcccttcctagccatacaaatatgaggaagttactgaactcctccaagcttcagttttctattctgtgtaatggggatagtaatagcacctacttcaccaggctgctgcaaggattgaatagcttaatatgtggtagcccttagaggaatattcaataaatatatcttaatataaatacattgaaattaattttttattttctaacaatatcaaaatatgaaaaacttgcaagaaaatagaaagaaatgttatttttgagacatttgagaataatctgctacatgaatattaagtatactaagtatattatttatttttaaataaatttttaaacaattttactgtatttttttaaatgacattctcctacttaactatgaaacaaccattaatatcagacaattagcaaagatatgcttccaccatctaatcctcagacctcattcaaggatcagcacttgtcccagtaaagtcttttataaagaatccagttcagaattatatgtgcatttgttttcattctcttttaatttggaggagatctcagtctttttctgactttcatatcttgacacttttgcacactgcagtccaattattttgtcaaatgttcctcaatttggcttcgcctgtcatattctcacaattagattcacgttaccaatctttggcaggaatatcacaaaagtgatgctgtgttctcattgcatcctataagtttgtacacactttgatttgtctcgttagtggtattggtaactgattattttatcaggtggtatctttcagccttctctaataaaaagttaatcttttttactttggagttaataaatatttcaggggacattattatgaaactattccatttctaatcaatctttcaatataatcttttatttatatcagtatagattcatggatttatagtctattaatgggctatagtcaactgcaactactacttattttgatgcttgagctcaaaagagatcatttgatatgacccaatcattttctgtgcactttcttgctttctggcataagatgttccaggcttattttgaacattttctccaacagtccaggaatcaaccatttttccaagaaacattagtttcattttagtgcagaataatgtttacaatccagtatctcgcactaggggtacttgttggtagagggtgtcacttctcccaggtcctctcagtggacaaagtaaaggaatacaatttatacacacacacatacacatacacagagatatctatatagaatccataaggttacacaatacattcaattccaatccaacaccacacagttcattctagttttttatttttccatatttgaatattctttgacggttagaaacctggctcctcaatcattactaatatggtccaacccctgcacataaccaatttcccatcaccacaactacaatcactcccttccccgacacagatattctcctcacaatgcttagtctccattgtaaggtgccccttctagcagaagtccatgtcacccctctcatgtctgacactcctcttttggttatcttcccatataaattcccaccttatcatccctgcttgggttataacacccaacaataggccattcgcatgtgtggatgcatctgcaccatacgtggtcttctacatttcattctgggccaccaaaatcacctccatactccagaatcaatgtctatcttcctcagtcctgccaagtggcttttggactaaattatttcaagaaagggaagaaaagaggaagagcaagagcttgtaatgcttaaaatatcttgtgaggtgcaaatgctctaatggagcttaaagtgctttggaagcagggaagcattatacaaaaattaaatgtatttgattctagatagtgcccccagcacacacagctgccttctcctacatcatagatccttagaaaaactagaaaataactaagaaaagaaaaagctagttagagtggatgggtggatattagatacaagatagatagtagaaaaaagaaggggaatttctagaggacgactagggaaattactctcaataatttctaaaacatgcacaggattgtacttgaataaggaaaccaaagtgccttagatatgagaaatggattggaggatctaaaaccaagtgataagtgaataattgggacagtgcaggaggaacagtcagatagaaaacatcctgtgttctatcccccagctccatctctcccaatagcgttgtcctcctgcaggtaggaacattgagtgtggacttggttcagagtcaggaccacacattggtggctggtgatgcccaagaagaatgagaacacccttcttcttataaggccagccatacaataccagctctggctgggcttctctctcctctgaatcccatgaggagaggttggagcaaaactgcctcaactcatctctcaccttcccctcagcatgaatctcaagtaaaagataaacatacatgcaggtatcaccaacttgtaatttgcgaaaaaaaaaatcaacaccatggatgtcatacaccagagaatagaggaaaatatatatatgaaaatgaaagagaaatggggaacagattcagaagtgcctacacattcttttgctattccaacactgaggaatatgaagaaagaaaagaaataagagaacttcccagaactgaggaaagtcagggtactcatgttgtaaaggcaactaagagtagaagggtacttcctaattaatgtgatataacaagtaagagatactaatgtttagcaaggaagacatgcagaagatgtgattgattatctgagtattggcagaaaatatcaggaaaccaggacctgtgtaccactgggcagggcaggcgagggagggatggacaccaaaatcagggcagtttagttatgtctaaaagatatatgttatgactcagaaaaggttgtataacaagattataacattaaaaaaatgtgttctcttctcctattttgataagtataccttcattgtcataaaattggaaacaggcataatgctacatcttttgatttactgaaagttagtcaaataccaagtggctaatttagttattattgccatggtctaaatagtctcttaatgggtgagcaacgtttgaatcaatagcataaagacataataatttataaattattatatgtacttttttattccataaaagtaatctttctcgcttttgcttcagtaaaattattagaccatgctataatctagattttcacacaatttttgttctgttgatattaatgtcaaattagatatccttctgacgccactgtagtgtttacttagtttttattcattgtaatttggagtaattgttcaccgctgaaaatatataagctgcaattatcatagaattgataaatgataatatataggttaaaaatgaataatacattttacatccagttttacatattcaaacactgtaatagactacatacaataaattataactgttgtagaaagtattataaaatattttcatttgttgtataaatcactaccccatttaagtgtcataattttccacaacacttaaatcaatatctaggctcataaaaatgtttttaagttctttcttccagtttttcaatgctgaagcattataaagaaaaacaaattaaaaatcagtatgctgtacaatttggttaaacctccctttgagattataccttgatttagaacaaccagaaataatctcaataaaaattagttttttgagtctatgtgtactttgaagaaaaaagttagttttaggcttatttgttcataaatcttttcctttatagtcacataattttcattatatttcatacaaatgttaatttttgcatatgtcacataaactttctattaaacctttctgtaaattaaaaaaattctaatttttgaaagatgaaatattgacacatatttggtacacttttgctaacattttcaataatgagcaagagtttataatcaaatgactgtgaacagtacatattcaaaattagttttcacccaaaaccatggtttgcatttatttgaagatctactattgtttcaaataactattccactgcattttattcacatctcatctaaattaaacataattgctttaacagtgttcagttgacattctcatcatgcatcaacaggcgatttcatgtcaaatctgatatgtgattcatcaaaaggttcaatctttgggcacacagatcagatgtgatctttgacttgctccaaggaagagcatcactcctggcataggtgaggccataacccatggggataaattaataatgcgctgccaaataggtcatgaaatgtttgcaagtatgtaatatatgttctggcctaaataccagtcatgttagcatcattattacaagtttacttgtaatcatgttttaagctaatgctcaatgttcaaaattgttttcttgtttttcctcaggttgaaatttacactttctacaacagatgtatagtcaatgaaatagtcattaattttggatttctttatttctggtcttggtggttaaatcatatgcataataaaagtttgctgtttagaattcttattttgtgcattctcatttgctgaatatgcactttataaaattatatttttaatttcttctctcacttgatttctcccaaaattacccatctatttttatttctccatctaggcaccatttgttttattatgtttgtatttttatccgtcttacatgattagccattctagcatcatattttgaaaacatttcagctacatccagacattttccacctatgaatgctacaaaaagaatccttattcttagctaaatattggacacatattaatcttttaaaaacttcacacaaatgttatcagtgttcttgggtctttgttgaatataatcaattatttactcttttttttcactacatagaaataactgtactccagatctctctctctctgtatgtgtgtatatatattatctataatatatagtatatatatctatatctataatttaatttattttatataatatatacattttatatataatatataaattttatataatatataatatatattatagataatatatatatacacacatacacagatggaagcataaatataaaaattggtggaatttttaatgagatcatattctaaataatgaatattaaatttaaattcatttgagtttaagagaaataaaattggagagatattatgttcccaaagatttctgtaaccttaagacaaaaaaagcattaaaaactttttaaattctgtaaatacagatgtgccttgctgtgtgcaggtgatactttatgttttttaatagagaaagtaattgtttccagttacctatacttcaatgaccaaagcttatcttgaaaataaagtatgaaacatataacgcaaattacaaaacactttgtcttttagctgacaacaaaaagccatcttctagcttacttcgccatttgcaaatcatgttatataaaataaaacataaattccctgtgatattcacctaatggaaagttgtaaatattaatttgttcgagacttttattttgctataaatattcttaggctgtatgaaagatgtgacagccattttttagtatcatcttccaataatcagagaaaatggactcatttttcttctccaactagccaacttcatgatggtaattcgccttctcatggttgggcaaagttgcatttattgattcggatttgtgaattcaacataaataactcttttttctcatgatttttatcaataactaaattcttcatttagtaaaatagatataaatcaaacagttcttatctaatatgcttaagttacaggtttgcatttggtaaggttaatttttggttcacttttattgtttggatcagtaactgactttcaatgaataacaaatctgtactgtcctttagcaaattttacatggttcaggcttttaccagcataaaattttcactttatttctttattgttctaggtttttttttgttttgttttgttttgttttttttttttttttgagacggagtctcactctgttgcccaggctggagtgcagtggcacaatcttagctcactgcaacctctgctgctcgggttcaagagattctccctgcctcagcctccagagtggctgggattacaggcgcctgccaccacacctggctaattctttttttttttttttttttttggtagttttagtacagatgaggtttcaccatcttggccaggctggtcttgaactcctgacctcgtgatccacctgcctaagcctctcaaagtgctaagactacaggaatgagccactgtgcctggccctattgtttcatcgttttaacatattaatcacactgcctctttgaaaatttttctccttttttcttttcagttgtgctttctttctgcactctattttttattagcttggccctacttatttttaatgaaaaaattaaaaatgaaatgaaattatattcctagggtagaaaagtttaatatattttctttccagatatttatagtcaatatttatagactcatccaaaactcactaattaaaataaatgtaaaaaataattcctatatgtgaaaagctacttttaaagtatttacaattaaatgctaaaattaagataaaatgagaactttaatttttaaatcaaaattatttaaataaaaccaacatttacatttagtttctgaataattaaatcctattaaatattttttaaaaataacatttttctgagtcttacagtttaagatccagctagtgaccaatgtaaataatcaacatcctacatcacctgtgacacagctggattttataacagcattgtagattgtttaatactataaaatgtttcccaggcaccatctagcactattgtgattactgtgctaatttattgcaccttgattggaagaggacgaacagaaaagaaaaaatatgcacttagggctatcgaaagcaatattttattttgaaaaaaactattaaatatactctctggccgggcgcggttgctcacacctgtaatcccagcactttgggaggccgaggcaggcggatcacgaggtcaggagatggagatcataatggccaacatggtgaatccccgtctccactaaaatacaaaaaaattagctgggcgtggtggcgggcttctgtagtcccagctactcgagaggctgaggcaggagaatcgcttgaacctgggggacggaggttgcagtgagcccagatggcgccactgcactccagcctggtgacagagcaagactccatctcaaaaaaaataaaaaatacataataaataaacaaatataatctctaagaagaagaaatggacattctcattaatttatccttcctcttattttaaggattctatggataaaatcttccccaaactcagaggcagtgttcatgtctgatatggcagcagcagcacccacagtgtcatttcctcagggaatacctaccttttgtttgttggcacaggtcaagagccgtggaaagacatttccccggggccccaattgggttaatcataaaatggatgcttgagatataattgctcaatgccatcccttagtaccagatccagaatgataagtgccctgaaattcttaataaatttattaattggacttctgatatgtgaggccaagggcaggggcacttattttccctaaggtaccatagaaaatataattcagtaatatatccattctaagcaacagttaaaaagagatatctctgtgtactaacacagaacattcatcaagatattttgttaggtgaaaaaaaattgttacaaaatatatgtataataccatttatacacattttaaataaaaatgacatatttctatgtattctgcatatgtacataaacaatagaattatagatgcatatgaagcagattattatcctagagaaggtgaggaaaactggctaggaataaaacaggaaacttaactttatctacaatatttaagttttcataagaaaaatgcattaattattcactatattattaaaatttgaaaatttcccttcaaaatgaaatgtgttggaaaacttttaattcgtaagtttgacaatatgaatgttacatcatgcatatatgtggttcaaatcattaatagactgctcttagagctgttatattctttctcattctacttgatgttatgtatttcagagttccttaaaatttgaatacatctactaatatgattcttcattactccatcagatggagactttagtagttatctggatgtgccctttttgatataaaatatatttttattatagaaaaacaatccacaaatattcatattgtgtgccaaaagttgtgctgaataattttttatgttaatttcatttaattcttataacaactctgtaagaaaatgttatcatttttacaaatgagggaactgagggctgtggtaacaaatgttgtcaacaaagaatccagagtgagaaaatgtaaacgccagagagctggaaatatcaagacctaaatctaataggttctaggtaggcaaaaggatgaggtaaatgcacagcaagcatggaacaaactcattttggatttcgatagtataaggaaagagttatcaaaagagaaaaatgtttacccacaatgtctaagtttagttgagctggattcatcctggagaaaaagctgaacaaatgtgtattttaggcacgaacctaaataaagtagctataatgcttcccaaatttaacagaaaacagtcccagagaagggtgtactaagaagtagaataagtaaataagatttagtgcaggaaggaaaaagaggaacactgaatggatcagctttcacaccttctggatggccagacaagataggctttttttgttgcaaaacagcaggcctggaatacagacccttgtaaggttccacaggcttaagcagcttgatatcccctatgcaaagctgctagtgcttaacagatagttaatctaatgccaacactcaacattgtttcagaagtcccagagaaatctcattgaaattttaaatatgtaacacaaaatacaatctaaaactagtagttaaacaaggttagaatttatagaatacctccaatgttttcaaagtgtttccatctatctaattcttgcttaaaggtgtacttttacttattttcctagagaaaggtgtgccctttcattattattttagtgtgtggatgtatactgcatattatatatcagtattttttttcctatgtaacatacattatctttctcttccacttggaaggctctgatttacaacaagacatttttaccatcttgtgtcagcaatatgaattgcaggcagaatttaaaaacccagtgaaaaaataacaagcctcagaaggttagatgtggaagaagacctacatgctttctaaaaaaatactgccacagtcagcaccactatgctaccaaatttcacagaaagctcaagatatacaaatgagtttctgattcccaaagtgattgtgaaaagtgatcccgtgacaagctgaacattttaggtgatattttctttcccacctctagagtccatgcatgctctgaatggataccaaccacaaaactcaagattgttaactggggactaccaatactgccacacaactcaaggaacagaacaccatgaggatggctgagactagaaagtgggtggtatctagaaataggttcattctttgaagataaaatatgtcttcaggatagaggcatacttccttttattgcaccttccaaatattgtgttttcaacaaattcaaggtttgtgacaaccctgcatccagtgagtctatgggcatcatttgtccaacggcacgggctcactttgtgtccctctctcatattttggtaattctcataatatttaaaattttcagtattatatctgctatggtgatctgtgaatagtaatccttaatgttactattataattgatctggaatgtcctgaagcacacacacagaagatagtgaacttaattgataaatgtatgggttctgactgccccactggctggctgtttcttcatctctatgcttctcctcaggcttccctattccctgacacacgataatattgaaattaagccaagtaatagccctataatgacctctaggtgttcaagtgaagaaaaagccacaagcctctcacttgacattaaaagctaaaaataactagactcagtgagaaggcacaaataaacccaagatagtccaaaagctaggcttcttgcaccaaacagttagccaagctgtgaatgcaaaggaaaagtttctcacagaaattaagtgtgctactccagtaaacaacaaatgataacaaagtgaaacagctttactgctgatatggaataaatattaataatgttagaggtctggatagaagatcaaactagccacaacattcccttaagccaaagcctaatccagagcaaggccctaattctcttatattttatgaaggctgagaaaggaagctacagaagaaaagtgtgaagctatcagaggttgatttatgaggcttaagaaaggaaaccatcttcatcgtataaaagtgcaaggtgaagtagcacatgcttgcacttcataatataaaggtgcaaggagaagctgtaacaaggtatccagaagatctagctaagatcatttatgaaggtggctacactaaacaacagatttttcaatgtatatgaaacatccttctattagaagaaaatgccatctaggacttccatagctagagaggagaagtcaatgcttagcttcaaagcttcaaagtacaggtcttcttgttaggggctaaatgcagctggtgactttaagttgaagccaatgatcatttatcattccaaaaatcattggacccttaagaattacactaaatctactctgtctatgctctataaatggaacagcaagcctggatgacagcatatctgtttacgacatgctttactaaatattttcagtcagccttgagatctactgctcagaaaagagattcttttcaaaatattactgctcattgagaatggacctagtcacccaagagctctgatagaaatttacaatgtttttatgcctgctaacaaaagaaccattctgcagcccattgataaaggagtcattctgacttgcaagtcttattatttaagaaatacactttataaggctaaagctgccataaatagtgatccctctgatggatctgggcaaagtaaattgaaaaccttctagaaaatattcactattctagatgcaattaagatcattcatgattcatgggaggaagtcaaaatatcaacatgaacaggagttaggaagaagttgattcgaactctcatggatgactttgaaaggttcaagacttcagtggaagaagtaactgcagatgtagtggaaatatcaagaaaactagaaatagaagtggaggctgaagatgtgactggattattagaatcacatgataaaacctgaatggaggaggaattgcttcctatgaatgagcgaagaaagtgttttctgagattgaaactactcctggtaaagatgttttgaacattgttgaaatgacaacaaaagatctggaatattacgtaaagttagttgataaagcagcaacaggacttgagaggattaactccaatcttaaaagaagttctactctgggaaaaaatgctatcaaaaaacattgcatgctacagagaaatctttcctggaagaaagagtcaatcaatgccgcaaactttattattgtctcattttatgaaattgccacagtcaccccagcctttagcaaccaccatcctgatcagtcagcagctttcaacactgagataagaacctccatcagcaaaaagattatgccttgttgaaacctcaggtgattgcagcagttttaacaataaagtatttttaaattaaggtatatacatttttagacataatgccattgaacatttaatacactccattatagtgtaaatataactgttatatgcactgggaaaccaaaaaattcgtgtgactcaccttattgcaatatttgctctattgcagtgttctggaaccaaacttacaatatgtctgagctatgcctgtacacatattctaattttgtggtaaatgtataaaattctaggagaaaaaatagctttggaagacttttagcaagttagttttatttcatctttatcacatcagagggctagggatcataaaaatggttgcaactttcttattacttatatagaaaacctttagcggaaagattcaaaatgtctatacggataattatatatttttaatacatgattttacttacctctgtgacatttattaaagcttaatgttaatatgttttataaatccattgtaacttcttgtggcagtctacatttagtcctcaccccttacagtcactgaaaaatttagccaaaaataactaatgctacataagcatatggctctatggcataataaaaggaaaatctatgtcatccatggatttcccactaggttttgaagctctggctttcaagaaaatcttcttaacactgtattaaacacaaccattagtattatctttggaaaatcaagcattatttagaccatcaatcaaattcataggaaaatctcacaaacattatccctaaaataaaaaagcatttaagcacctaatcatgcatgaagccctcagtgctaagaaaattaattgtatagctctaggtcattgacctgtagtagttttacaacctgaaacagatcatgtccctgtccctgtaggtcttgtggttaacagagaagtaatagtagtcttcaaggagtttagacctttacatgatttcatggggaaaaattagaataagtatctgcaggtatttgggacattcctttgttttcttgttcaagaatgaaacaaccaaaaatcaagagaaatttatcttttccatgtaatcatgtgataaatactatagaataaaggcaactgggccttctccagtatggaaatttcccggtactagatgtagtattgtatgcaatgatgtacagtcttccgcagatttaccaccacaactatccacacctaaccccagtatacagaacaagtattcccccctcattgaatttatcactattgcaattaattcatggagtactttcttcattgaatgtttagtgtctgtttcctcctgtttgtccacaaactccataattcctattatctacttgcaaagcttagcacatggtagttgttctgtaaatgtttctggaacaaaagaagggaagaagagtaaaaaggaaaaaagagaactctgaccataaaacatgacatataattaaaagaaaagactctctaatattcagcaaatacagagcagctagactaacatttaagcactttgaaaccgtcagttgacaaatttaagccataaccactgacagtttctcatttcctgagaaaatgtaagacacaaattcttagcctgctttaaaccttaaaaggtcccaaaacatccttttcaattgtcccatatcaaatctgcctcccttaactggtgctgtcttggctgcctggttactgagctgtaatctcctcataccccattttctgagaagccctagctaagttacaatgattgcctgtataaattaatctccactgcaataacaaaggcaatcccgtcagcagttgacattctggcttttaattcactgaacaactttttgtttgttaatcaaagctgcatctcatcccattgaggatgtgatttgtctctgcttctctgggtcgtggtgtcccttacgccagtgctgctcaaaatgtgatccctgggctagcattagcaccttctgggaactcattagaaatacaggcctttatgctcagtctattgaaacagaatatctggcaacgagtccaaggactctgttttaacaagttcttcagaagattcttgtgtatgctgactttgagatgcatagctctacacactactgtaatactagtctgtggcatagacattagtccctcatactttcttaggtacagtttgcattaggaaaacatgaatcagctagcatagacattccagtaccctctctcgctatcctgcctcttcaccagcctccagtgggagtagtgacttaaagcatgcattctggacttggattgctggcatttgattcccgcctctactatctggtagccgtgtgacctcaggtgacttattcaatctctctgtgcttcagtctcctcatccataaaaggcaggtaaaaggagtatcatctcatatggttttaataagagttgaatgagttaatatatatttagctgcatagaaaaatgtgacatatactaagggctatatttattaagatagatttaactgatttaaaaaagttcttgttttctgtccaaagagcatgattatttcacccatcatctttgctctggaaaacaaatccatgtaaatgtctcatgcaagctgaaatctggtctttatgacagatacaacggttagactctttaaaagcattttcctagtttgaagtgtgggatacagtattataatggaaaaaaatacaccactatttctttcttttatgaatatatttcttacaaaattagttataaacatgccatgtctgtcatgaaatgctgatacacaaagatattactggctttgcaaggtatcctcttgtgtgattcaaatatatacattaaattgtcaggtggcctccaagaaggaagtgaaggaaacctctaccaggctgatttctattcttgataaaataaaaatacaggtaagaaccccattataatgaattccactggaactttaatttgcttttgctttaattaaattttgtttttgtgactatattgctagaaatcctatccctagtaagtagaaactagagatgaaacccatctgataggtatcctctctggtatgtattaacaagtgaaaaggaatattttgaacccacttgggaaagaaaaagtttaatgagctcaccaccttgcacccttttcttctccaactgctgctggtctggtttatccttagacagtgtttttaggtcctgtaagcatgaacatgggtgtataatgtacttggctcattttgggttttgctttttctttcttttccttttttttttttcgagtaatgaggagaactacagttggaaagggggagaaagaaaactgaatgccaattgctacttaattctgtcaacataaagaattattagagatttttaaacccttctatttccctcacttcccttccttcattaaaagcagtatatttggacatggctagtaaaagtgaagaggcataaaaataccgaacaggatcacttggagggagaatatttgtaacaagaacatcaaggcattggtggtttgggccacatgcaactacatggaaatctctttattttctgaaatgcttatttatgaggaaaggtttatgtatgattgactggttctgtgatatccaagtctgtacctcaaattccctatttaggctttattatttcacatatttaagattcagtactaagttatatagtcaataatgggtatttgccaaatatatgtatgtacgtataaataatatatatatgtgttttataagtagtgtatatatcagtttgattctcaacagtggattctttaactctgagttttcagtttcattggtgttaattactgttaaatggagctagataagtaaaatattctatgtctatctgatttaatccggatatttaacttcaagcaatatgtcataagaaaataaattataatgagtaaaacaatatatacctgagtagtcccactttgatgttatttatgagtgaaaaaggaatataaagttcttgtccaacagtaaagaggtgacttagattaactacagacaaacatgtaatggggcatttgtggtaattaaaaattatgcttatgaatactgtaaatcagcatggaagccaattacgctataaagaaaaaactaggttaccaaattgttcatttcatgagactaaaaaatgagaggtatatgaaaaaaagataaagataatacaagattaataatggctggatgttggcttttaaaaatttctgtatttgcaatctgtttagctttcatgacgaaaaagcagtggccgggcacggttgaggtcaggattttgagaccagctgggccaacatggagaaaccccatctctactaaaactacacacacacacacacacacacacacacacacacacacacacacacacacacattagcagggcatggtggtaggcacctgtaatctcagctactcaggaggttgagacaggagaatcacttgaacccaggaggcggaggttgtggtgagccaagatggtgccactgcactccagcctgggcgacagagcaagactctgtctcaaaaacaaaaaaaaaaggaagaaagaaaaaatagtatttatctcagtataactcaaagatgaaggcatttcttgtaaaacctagagacttactaaataccatgtgaaatgactgaattaacacggcttagatattttaatagaactttgtattataccaaatgcaattttgttataagaggatttgccttgaaagatttttaaatgacaagtatatatttttatagttttttacaataatatggtattatgtgatgttatatagaatataagagcttacaaattgtgaacttataaactgtattaagtgtatcctgttgatttttaataaatactaaacagacaataccatcattaatagagagtcattgcgtgtgcctgtaatcccagctactcgggaggctgaggcaggagaatggcatgaacccgggaggcggagcttgtagtgagccgagatggcaccattgcactccagcctgggcgacagagtgagactccgtctcaaaaaaaaaacaacaacaacaacaaaagggagtcattaaaagtggaggggccgggtatggtgcctcacacctgtaatcccagcactttgggaggccgaggcaggcggatcaccagaagtcaggagttcgagaccagccttgccaacatggtgaaaccctgtctctactaaaaatacaaaaacattagccaggcatggtggtgcacacctataacccagctacttcggaggctgaggcaggagaatcgcttgaacccgggaggcggaggttgcagtgagccgagatcgcgccattgcattccagcctgggtgacaagagtgagattccgtgggaaaaaaaaaaaaaaagttgagataagattacaaggacgtagcatactagatatgttcactaagttaacaaaaatattctaatctgagtagtgtatattttccattaacattaccatatgtcttaggaaatattttaagtgaaatcctcattttataattgtttaataagtttagataagagattttaatctagagtttgttttttctgtgtgattgaattcattgatttcaaacccaattatattaacaaatataagaatgctaacaacactgtatagtctttcagtttgctattccattatgaccaatttttattttcatataagtatggtaaatgtaattaataaaattggacaatttatattcatgtaacttaattcttggaatacaggactctttattattacagagcaccatgactgaacagaccttcttgtcaatgcattaacccactgtttctctataaggtacagcaaactctatgaaaggaaaaggaggggagtaacttttcacagtactaaataaagatctgttgaacaaataattaatttcatttatcagaatatttgatagattaaaatataattgatgaaaactattactgtgaatgccatgaagacagaattttcattgtagcgttgttttatggaagcaataaattgaaaatagtttaaatagtcatcaaaatgaaatggtagtataaattatggcatatcctcactatggaatattaagcatgcaataaaaaggaatgagtagatataatctactgacctggaaagatgtccatgatacattattttttacttaaataaaacccagcatcctccagcccattatgcttggcaagtttccattttaatttaaaaatatgattatagggtatgtattattaatagtagttacttctgaaggttgaaatttgagaggtaaaaaggaaacattccattctcaatttttagaattttcagcatagtgtaattactgacaatttttgcttttttgcattatctgaattttctaaattaaaatatactgttctaatgataaattaatatctgttaattagagagcctttaaaataaagaaaaaacttgaaatcacctataattctcctgtgataattgcaagaatttatcacagtgaataatttggttatcttctagtttttttttcataatttatatccatggtctcaaacttttacaagcatcagaactacctagaggactctttaacacacaggttacctgttcccagccatagagtttctgatgcagtaagtctgaggtgggatccaagaatttgaatttctaacaaggtctcaggtgatgctaatgatgctggcctagatactatattttgagaactactgtttgctatattaggagtattctatattcaacattatatatttttagtttttacattaaaccatactataaatattttccatttatattaaaatttcttgaaaatatttattttgcttgatattttcatataaatagagaacaatttaactcatcttttttgactcgttgaacatgtgtgctttatttttattttcataaataattctgaaataagacttctcatgctaaaaatatctaacttctttgaataattttataaatgggaagttataaaatctgtatcttggattatgaacagttttaggctcttgtgatatattgccaaactgtttaccagaaagtttgcaccaaactgtaacaacagcatataagaccatccactactccacaccctcgttagcaaattaattgttcttaactcagcctaaggactaacattgtagcttgtccagtttaacaagggaaatcaaaggagaaaatgctgttcaaatttataaacaatttttatatttggctagttcacaaatttaccaatgtcaaattattgtaccatagaataaatttataagaaggtcttatatgccacagtcaaagaggataaaaaaatatttttgacctgttagaatgtgcattaaaaggaaatagagaaaaggagtgcattcaatagctaaaaaacaaatcttattggaatttttaaggctctcgttattttctcctccctacaatttaaagtaaatttgatgtgtggaaataaacaagtagggaaaaatctgaaatgtgaataaagagcaccagcccaaaataactttgtgtaagacttgtcctgtctcactgttggcactgacagattttaaagatatgccaggtttccaatctttagtctttcacttatctggtaaccttgggaaaattactgctactgtctgtgcttcagtttcctcatggaaaaaatgggataataattcttgtaccattgaattcttgctggtactcaataaaatgtcatatttaaagcatatatatagtaggcaatcaatacaggtagttattactctgtttcatccaccagctcttggaatacagtaatcattcagtgaatgagtggatgaactaataagttaataaatacaggtataaatggataactctacctctaatgcagcatcaaacaaaagttttagatgctctgcttccaggcccttagtccaagaagacacagcataatgtattattacattccctcaatttcttcctgcactcccacatgggaagtctttgctcacatctttttttttatatggcacaacaaaaccttccctcagaaagaggccaggatgaataaaagggtcctgagtgtctggaaaaggaaaacattcagcagaaataccacaacatctaaccagcctttctttctttctttctttttttttctttttttggattagcagggtattttgcttttatccttctcaatgtgaatcctggtatttccccctgtaagtggcatttcaaagctgacagctccagctgtccagccttcctccctccaatgactcatacccaacagatggtgcaaatagcttggcatcaattcactgaatcagtgttgggggaaaagccttgccagacgactgatggtttctttgaagttgttcattctggcaacaatgcacagctaatagaacagccttggctgaacaaaaagatatgaaactgatgtttgagagaaaatctggaacataggggtctatatctgtcacagtgcttgcaattattttctaccaataatatcatttttattattattatctaccagagctatgtaattctctcacttgacattcctaatacttgatattaaaataagcctattaatcctgctcaaataacattagaaacaacattggactggaggtcagtgcacctagattctagtctaagttccacctgaaacttcttggatattcttaaccgaaacattttgtgctgacctttagattctgcagctttaaaatggtgacaaaaatatctttcctgacagatttacaaggtgattttgagaaacagataaaataatgaattcataggtgttatgtaaataagttttataaaatgttataaagtttaaagtgttatgaagaacactatactgacccctcacaaagaggcatgaattctttccccctcccctccccttgagatggagtctcgctctgtcgccaggctggagtgcagtactacaatctcagctcactgcaaactctgccttccgggttcaagcaattctcctgcctcagtcccccaagtatctgagactacaggtgtgcgccaccacacccagctaatttttctatttttagtggagacaggatttcaccatgttggccaggatggtcttgatctcttgacctcgtgatctacccacctcggcctcccaaagtactgggattacaggcatgaaccaccacgcccagccacaggcatgaactcttaaatgaggatgggtttacgcaggtataagctctcaccttcctgtatactactgtgagagctatgacaggattggagagacaatgagtatcatagaaccatggactctcacccactcatttttaccaacttctcaacacaccttaaaagcatgttaactccacaatcccataaaatttggttaaatcttggattgatcttaaaattctttgcataatgtgaccaattataataaattagatggaattaaagaaaattgtgatatcatcaaaccagttattacaattgaataatagatcctaaacacactttcataaataaaatagtagaatccacaattaaagttaccaggagactgtagcttcctggattagagattttcacaaatccatctctgtatcatcaccatggtaggaagtcagactgaaatatggatatgggtatctagctccaaagcacaacccatatggatttctcctatattaaccaatttgtagtattacctgacagctggagaagcagaattattcaaataatttatttcattttgcttttaatcctttgtatctatatttcccagaaacattctagggtgttttaaataagtaaatattcacagttcacagaatccaaaaatgcattcaaatatctaccactcaaaaaaaaaaaaaaaaaacggcccacctaaagcctttcttcctgtttactaaaacgagtctctcataataactattttccgttttcccttttcactaaaacttagttgacaggaaaacagatgatactgactcaaatgataacctaaaactcacttctagtaattcaatttattcaagatttcacttatttattcccatgtgcaagataccactatcaaaataatctgtttgaaactgaaagtaacaagttgttagttttcatttgtctttctaatgaatgtgagtatacataagaggcttaggtttagagtttgtttgcccataaatgtggctaaaactttttctacggtagctgtttaaactgaaagaaaattgtactaggtatccattaaagtttgatcagaaaaacatatgccactgtagacattttgagctttctcaggaaattcagagtttcaaggttacaaggaagctgccaccagttatttcatctgccttcatcaccaaacgggggttcctgaggaagatgcctccaaattgcaggcaaaatccatgtctgccatctgctgatgctcatgtgcctgacctgatgtgtctcttctttcctattttgaatcttcatgaaagcctctaattggcagaatatcactggaatcctgcaggccatggagtatgggaactgtagtctccaggcttccaaaattcataaaacaggacatttttctgacaggccacctcatctcttgtcaactgaaccaaaagagccaaatcaaagagtacaaggcagtcctcctctaaagagtgacgcgtattgccttctcagtcactgaaaacccttgtaagagctctaattatgccagaaaatgaattttcatgaagagaatttgtcatcagcagcagcagcaagtatttattgccacaaaaatgagagaagcacagttattgttccaggagcatacaatgccttagtcgggaagataaaactttattatttttaaaagtgttgagcaccaaattcatgtcagggacttgactaaaggcttttcgaatttcttaaatcctcataacttttctctgatgtatttattgtttgctctatttagcagctaagaaaattgaaattcaaagcagttaagaggaaattgcccaagtcctatctacagcattggtgccagacatacccggattatgtctgattccaaagcttttgctctttctgctacacagtgatggtggtaaagtcatatttctgagggtcaaataattactataagaaaataagtgctaaaataattcaaagagatgaacaaaagtaaatttatattggatgatcataatcacccattctttttaagtcaggatctgtattattattttgtgaacatttgacatttgtttactaccacagataacttagggtatctctttgaaacttcttacttctgttgccagttaacaggaataaagatttaaacttgaattaaaatgctattcagggacttccattaaccagtatcagttggttgcttctaaagctaaccatgagaaaaatatatatatatttaaagaaactttagcaaggactgtccattcattgcctgatgctatttgggaacaaaatggctcaattctttttgtcctcagattaatagagcaagctcaagtgttataaagagcactttaactccctccaatattttcactgtggtttcttgtggcagagctcatttgcaataatccatgtgtaatttggtaaaccaaatggaaaatctggcattgtaacaattctctttactgggagaaatgctaaatatataaaaaattgaaaggcaaggcaaccccattcttcaactttatcatctctttgacaagtgaaattttccatttgttgatagaatattaaaaaacagatgacataaaactgaagaaatgtaatgaggaactctgatatggttgtcctatgctttctaagtattgtaagatgtgaaatgtgtattataaaatgtccttctcaagagattgaatactcctagacctaaaattgaattactataaaatacttgaaatcattaaaacaagtatttctctttttatttggcatattatatatgtaaataacatacactaattcttatatcagcctggtattggagaaaggcaacaaggctgaagcaatgggaaagggctttacttcataaggatgacttttttgaatgataaaagtacatagtgaaccacaacataaaaaaacatttaggcataaaggctaaatcacttattttgaagtaaaaaatcataagatttatacactagaattgaatgtttatcaagaatacaaaaagagacttggcaggtacggtggctcacgcctgtaatcacagcagtttgggaggctgaggttggtagactacctgaggccaggagtttgagaccagcgtggccaacatggtgaaatcccatctctactaaaaatacaaaaattaactgggcatggtggcatagtcccagctacttgggaggctgaggcaggagaaccgcttgaacccgggaggcgaagtttgcggtgatctgagatcatgccactgcactccagcctgggtgacagagcaagactccatgtaaaaaaaatatatatataaaatatacaaaaaggaagttattttagatttagattttgatatttaattactccatatgttagagatttttaaataaatttttgcttaaaaatgcaacagtgtcaactttgctgtaatttgatactactttcatttgaatttacaacagggtgggcttatttttcacattccatagaaatataagttccagagacttcagcatcacctttgggatcttatgaggtcagtaaataatacccttttcttcccatcttatgttcagaatagatttaaaaataaggcagaggaaatagatcgagatttaaacaacagctttatgactgataaagcagattagagaatgtggcatcaaacatgcatcaaatagcttcccaacatgccatccccaaagtagacagactcacacacccagagacacaccgagctgtgggcttttcccatcccatggagttcatctgaatgcacaagagcaaagaacaaaagtggaggtagtgacttctaaaagtaggaaagaagggctgggttggctttccccaaaacctgcaatcagtgagaagtgagtgatgggtgaggaaatgaggcagtagtactatgctacagggaccctgtacatggaaaaacgaggggtaaaatagtgtctcccgtccccaaaattcaaattgaaataaggaatcagtgagggtgtgtagcttccagggtgacagcctgcagtcatcctccttcacctactaaatatatatgttttttttcctgcatatagcacatacaaataatatatatttcatttttacaaaatatttacttctttttctcattttagtgttcgttagcccatagtacaggcatataacagttttttccacaaagtattttaacctagtactggagatgaatggatagataggtaagatgattgatacatatatatagatagagagaaaaaaaaaacttccagaaaatactgcattgggtctaatcatcttttgtattataaaataacaataaagggttacagtccatataatagatactaacaaaattagttactaattatgtatctgaatttatacgggttatttgccttccctagactgctttatgcatcacaacatatagccttggatgcagaatgcaattttctatgccctttagaaactgctatttcccctttttcatctggttatacattttcattgtgccatcattgtgaataattgggctcacatgatactaatagcatagagatttggaatttttgcatttataaagatctaaaatagtcatgattaaatatttggaagaaactaaaactaattttgaataactgttattgtgatgggggatgggattcaatcttaacacatttaggaaatgcaaaataaattatctaatctccttaattatgtagagtattttaatatatgcaaaattaaactttaaatgatcgttcagtaagatcaaatattcgttatgaaatcactatttaatcattgctcatagttgcctaacccattacagttcaaactgctgttaaaagaatggcctaaacttgcagtttcacctattacattgtttgaggagccacagatcatagcgtgtgtggtccaaaaaaagtcagaaagaataaaattgatattagcattttttgtttacttctcttaatattgctgaaaaaagcaaagacactcttcatcctccttgatgtgatgctgattttccattcaagtggaatcccacagcaggacattggaattaagcaataaagtgctcttggtgaccaaacaccagacatgtcacaattaacatgagtaaattaggttacatcttatttgtcaactcattttcattactagttttctctaaccaccaaatggatgggttagaaagtgatggattatatgcctgttcaccaagctgctataagtgtcttagaggctttgtcaagaaagtcacccacgactgggcaagctaaagggacttgccaaaggagtcaagaggaggtaggcagagcatgaaagcccttcttaggagaatgaaaaaagaaatgggaacagaagctaaaaggtaaagcagataattgtaattaaagtttcattagaaagtattctccaaaatcaaccaaataaagttagtgggaaacggtatatagataatggataacaatctaggatttgaagtcagacagaactagacatgaatttcagctcatacatcaatagacagtacaacctgaataaatttcttaatttttcaacatttcaatttcctcattgaaaaattgtcataataatactattatgattgtggcgaagagaaatgaattttttttgcatatcaaaattgttcaataaacactccctataattactgctgctttgctgtgctgtagtttttattaatgtagaaaggcattagctcccatttctttaaattcagcagtgtaattatgaatatccatcaccatttctgctgccaagaccactgcaatgaagtagggaaaagggaatggcatactgagatgagagccagtgggagtggcctgccccatggtaaggagtattttatcacttatatcgtttataattgtctgtgaaaagtgatttttaaaaaaactggcttttaatacagtttaaattccctacagataatgcatccctttattgactgtgccagtgaaactgtccgctcaccatatcctgccccatgcatcaccactgctctttatacagatgaagtctgagggccagagaatacaagcaagtagccaaagttacagaggatcattttcaagctgcttcttttcaaaaataattccacattttttcagttctttccagctcatttgccacttcctaacttcttttgactcatgtatcaggtccttagtttggttttcctccaaaatctaaactaacacaagcaaaatccattcattttcagaggttcctcatagaaaaggtagaaacaaatatagtgcattcactctaaaggatttttactatttctgtttctacctcttatgcagtattcctggtctctgctagtccagtcttacgaggctctgttaacaactggtgtgatgtactaaaatgtttgcctggaataaggcgacgacaaagtcgagccacctttatgccatgtcatattttaatagtgttttgtttcttaatccttcccaaaagggaaaaaatacatgatagctcttttcccccaactgtaaagaaaaaaagaaaagctaaacaatgttgggatttcttccagattctattgccccttcactgaagctattgtgagatgtttctttcagtgtgtgtattaagaatccactctgctagctaaagtcaggtaagtttccacttgtcaccactgaaggaagtaaaatgccaagaatggaacaaatgacacacacctttatttccaccatacacaatgtgcctttccacttggcaacacaaagcagaacagataaagtaatattctgctaaataattatgcacaccaaaacaatggctatttgtgcaactcaagaagaaatcgttatgttgtttactgttcacagttctcactgtcaaaggtcaatattgtgttttgtgccctgattgtcttaaattaataaacactattctcttgctgggttgagaaagaaaagagcaatctgtcaagagaagtatttctctttcattaaaagattttactcagtccagaaaactgctcctacctccaccttcctggctagtaatgagagaaaatccatggcaaccagtttcaagccacctaaataaagatgtcccaaagaaatcctatgatgaatatgatctttttccagaagagcatttctctccataattatgctataaaacagatttcacaccataggtataatgtataaaacataagctaaaatttagggcctaagatttgaaaagtctaaaacatttctatctcaacagtctctatttactctaatcacttttctataaataactatatccatgtggtctattccaaaagtcctctaagcatatcacatgtttctgctcagaaaagtttgatagtaccaattattacttacttcaggaaaaaggatatgcatttaataaaattaattggggaaatttattcataaatgaatataaagattgtggtgaggatccttaaaatgctcatttcacactcaactctaaagtttactcatgatttgactaaccgataaaagctctgcaataaaaaagcaacgtaataatacagtttctaaatgagcaagtattgaagccaattgaaacctagtaggtgaaaaggttttttttataaatgttaaaagctgaagcttgaagggataggaaataaaacattttaaaagcatcagtaagagacaatcttaggtataaacataattatttatttaggggattcctagagatagatgctgcagccagcaaagatatgatggcacgtaaaccacatcaacaagagaagttggaacagctgaaatgtgatgttcctcccagggaagcaatttggactcaaaccaggccaacagtgatgaaaaatcattatcattgagtgaccagttctttagttgtgtctcattatggtttgagaaaggtatttcaggtctggacttggaagctaatgcttttatcacaagcatcgaatgctaatttgttaatccagatctgccaggacaagcatagtttcttcttatttcaattacctacactgatggttagaaagcacaccagaatccaagcatctgtttcatttgagataaaaagtgtttaaagaaaacaaagttaataccatatgcattataattaaaattctgcttggacaataaaaatgttaatatataagtgaatttttttttttaatttttaagacagagtctcgctctgctgcccaggctggagtgcagtggcatgatctcagctcactgcaaactccggcttccaggttcacaccattctcctgcctcagcctcccaagtaactgggactacaggcacctgccaccacgcccggctatttttttgtatttttagtagagacggggtttcaccgtgttagccaggatggtctcgatctcttgaccttgtgatccacccacctcagcctcccaaagtgctgggataacaggtgtgagccatcacacctggcctataaagtgaattttttaagcaaggggaaaagctcaaattcaaattttaaataatctgttggttgattctctattaaatgagttcaagaaaaaagactaatcattcacatcctcactaccatcagagattgctaattaccatctttttccaacttttttggggctaattcagaaattcaatgtttatgacatttttcagttaaattcttcataatgtatactcaacaaaagacaaacatctcacatcagccagcaagtttcctcccaacacttaatatcttcatatttggtaaaggtaacaatccaaaataaaatcattttacttaacggaattaacagagaatgaaatcatcgcactgtttctttaaaataattgtctagaatatgaggtttttccaccaggaaatattatgaaaatacacattgaaattatttcctactcaatcagcagttctattaagcattttacaatcagatgcttcaatgcaagatgcaaattgttttatttctgaatcccctccctcacattgtgtgactcctgaaattgctttagaaggaagcacttgttttttaaaataatattgtaattctttaatagatacaaaactaacaaagaaactttgctttaacaaataagcaatcatttaggagcacatatatcccaaatataaaagattgtagatttaagctatttgtcttttttccaagatcatttggtttgaaagattcctctactcaaaggcaatgcgcatcatttccactttgctaggttatttgggaaacactacagaagtggtagagtttatatgccacaatggttacaattattggctttaaagtcaaacatgagtcagagtcccaggtctgctacataagattttgtgatcttgagcctcagtgttattatgggtaattggaataaaaatagtatcttacatgtttgctgtaaaattgcattaaataatgcttaatgcctatgtataataaacaacaaatgttatctatgataattgtgattaatagtataattaataaatggatatacatttttatttctataagtatggctgagtagataccctgaatcattgtctcaattgaatcaattaaaattccagttaaaatatagcattatttttcaaagcattgttgaactggcatgaaagttagaaattcaaaagccctaaacaaaattaaagcattactgcttactctaagaggtaaaaaaataataaatctggcattcacccgagggttcgagaccttgctattctaatcggcaggtttgtggagttagggacagaagacaaaggcagcactctgtttataggtggaatttaggatgagacactccagatagctggaaaatgtttactggagctttgttcttgcttttatttttgttgaatggcaaatcatgctttctataaaatttttaaatcctcaaaataaatttaatttagagtaattttgtttggtactggccacgggcaattgggagaagtaaatgcaacttttctgaaaaatatcacttttggcacaaccctcaaataattcccacagataaagttccaaggataaacaactcagaactgaatatcataaaacacacatacagaaacaagatattatatgtagaaatctgtagaaataatagcagaaacaagctgacaaacattaagaaaaggaattatttgaaacacactaagaaataactctatatgtctaaagaaacaaaaaaagtttgatattttgactagcaactaggagactataaaaatgaacgttcagatttgaaaaggaaccaaataaaatctcaggaaatactgtactaactaaacttaaaaagtcaataactgaattaaattcagcagcagagataaattatgaactggaagagatattgtccagaaaatagtctggagagacaaagagatggaagacaaaaaatgaagtgaaggggcacagacagaaaagggctgatcaatatgtaattgttgtttcaaagggagatagaaaaaaatgggaaataaacgatcacagaaagagataatagttgagaacgtcatagaatgttttaaaaaaaaccacaaattctcagttctaagaatatcagtgaatactaagaagggtaaataaatacatttgcaagacgacaaatcataactaaactgtgaaacacggaaaaaaaaagtctttattgaagccaaggagaataaacaaattacccacaaagaaaaggcaattatattggtagctgacttcacaaccacagaaagaaaaaaatagatgtcttgaatattattttcaagatgctgagatgaaataactataatcttaaaactttgtactgagcaaaaatatcaaccaagaataagggtggataaggatattttcagaccaagagagttaacacgagaattaaatatttaaagctatgcttcagaaagaaagataatgatcccagatagaaatctgagatgaaagaaaaataatggacaaagatactggtaaatatgtgaataaatcataaaataagaatgtctatacaagtatgatttatcaataatatttaaacattaaaacattaaaaaaagaatgtcttgggtgtaggtgggtgggaacagattcaaaataaattataggtctcatacagttacaagggaaatgatagaacttacaggattcttatattcaggtaaggttgccagatttaggaaatgaaaatatgcttttcattcattgtttacctaaaattcaaattcaactaagtgtcctgttttttagtctggcaaccctatgttaattgatatgtatgaaaaaaaattatgcttaaatttaagtatgcagttaatttaataatataaaatcaattagtgcattttgccatatttacagattgaaaagaaaaatcatatgacaacttcaataaatgtaaaaaaaattaatcaataaaattcaatattcattaaaggtaatcttcaaatggaaatatataatacacttttttagtctgcttatgagtattatgagaatccttagtaaatgtcttactttgtggtgacattataaagtaattttctttagaatcacggatgacacaagaatggttactatcactacatttattccacattgtgtttgaggttctgaccactggaataagagaagaaaataaaattataaattctcacaattggaaaggaataaagcaagtcattctctcagattatgtaattgtccacctaaaacaaagaaatctacgggtaattgtcaatatattattgatgtaattatggtgtgtgctaaactggctagataggtagtgataggtagtgattttggatttggactcccactaacttggaatatttctgagttaattttacaaaatcagcatatttcttgtttaaaaagagaaagaatcacaatgttgctggaaatcaatatatatattgatatatatatatgtcttgttctgttgtccaggctggtgtgcagtggcaaaattgtagcctcaacctccaggtactcaagcaatactcccacctcagcctcccaagtaaatatgaccacaagtgcacaccatctaactcggctaattttgttttgctttgttttgttttgtttgtagaaatgaggtctcactatgttgcgcaggctggtcttagactcctggactcaagcaatcctcccaccttggtctcccaaactgctaggattacaggcatgagccaccatgccgagccataaatatttttaaataaatataaaatactattgtatttttatatgtcaacattaacagaaaatgtaattttcaaaatgatatcatttttctatggcaacaaaaaagtaccaagtacctagaaataaatttaataaaaattggataagcattgtgaaaaaaattaacttttataaaggcaataaagaaaacataagtaaagggagaattatgccatgaatccataaacataattgcatgtgcacatgcatacatacccacaaggttggtaattgataatagaatggaagcttctgctgagtggggagaacatggactccaatacttaattgtgggccaattagttatcttatagaaggaaaataaaagtggattgctaacttgccacaaaaaaataaagttataatatttatgattggaagggaaatctataaaactagtagaataccatgaggaaaaacaggtttatgactttaggctaaatataaaaaacatataccataaaggaaattataaattaaactacagtaaaattaagaacttctgttcatcaaagtttaaaaggtaattcataaactagaagacattagcaacacatattagccacaaatgcatatgacctcaaaaatattttaaaaccctgtaaattgataagaaaaatataaacatttaaataaaaataaaaaaggtaaaaaacacagaaacactttttacagagtagaaaacacaaaattcttgtaaacatgaaaaattttcagcttcattagtaatcagaaaaaatttaaataacaatgaaaattcaataaataatgacaaaagttgtacaatttaagaaatgggacaataccacatgttggcagaataaaaggacatatattaatgaaaattctcttccactgctagtgggaagataaattgaaacaccttttgggaaagttgagcattacctggtaaagtggagtgtgtgtgaaatctgcaatccagaagctccatgtctacacgtaaagcttagagaaatccttgcacaagtgtttcagaagcattgcaagaatcaagaaaagaacatcagtggttaagaaccacgaacaacatagtcaggctcttagattgaaaactcctgtctgctactttataactctatcttagttaatttattagcattgttatgttcttgcatcctcaactgtaagttgaaaataacaatagtacctatttcataggcttgtgttgatatttaaatatttaaaagtgcttggaatagtgcctggcacacagtaagtattatactgttatctgttattattatttacaacagcattgttaatcatcaaaaaaaaaaaaacctggaaatactgcaaatatttgccactaggatatgtatgtataaaactatatgtatacacacacatatatattcatatatgtacacacataaacacaatggaatacaatataacagcaaaaataaaaactttagaataaacaagataagcaactcagactatacaatatgatgcaatttttgtgattttttaaaggcaaaatgttacattgtttaagaaggtatattttattaaacttggggaaaaagagagggaatgatttacatgaatttagaatttcagaatggttgtgtcctctttggagacaatgagtggaatgaaagctgggagtgtgacccaagggtttctatagtgctaataatattctctctcttagcctataagaagattgagatttatttagtcttaaactgtatgtatacctcttgtgcacattttatgttctgtattttgccaaatatagtgtgaagtattttaatgtgaagtattccacaaactcaaggtataaatatggcttctttgctttaactttaaaattaattgctttacttctcacttgccttgttgatatggtttggctctgtgttgccaacccaaatctcatgtgaaattgtaatccccgtgtgttgaaagtagggcctggttggaggtgattggatcatgggggtggtttccagtggttcagcaccatctccctagtgctgtctcatgatcgggttatcacgagatctaattatttaaaagtggctcttcccctttctcctgctgccatttaagatatgccttgcttcccctcaccttcagccatgattataagtttcctgagtcctcccgagccacatggaactgtaagtcaattaaacatctttataaatcaccagtctcaggtagctttttatagcagtgtgggaacagataatacacttgttaacaagaaaatcatttcctctctaaaataccacctcctttacaagttgtcctaaacatgggtttttttttttccacacctaaggaactaagatacacgagtcctggatattttctgtctctcattttcactgcttgtcacaattgtattgcaatgctagaagctaattcaaaacaattttactgacgatggggatgcaatatgacccagatggaaaatttatattatacacatctcatcagcagcaatttctgagatgaggttagagcagcagtagaaatacaaaagaaatagaaggaaacggagaatggaatcatagacagcagaaaaacatttaccccttaaatgtcaaattggggataacaaaaccaaattagcctcatacaaattttacctctccttagtaataatggtccctaaaactatacttcctgaaacagaaaacaagccctgattaacactaaggatgctgtatttcttttgaatttcctattttcttcatgcagagcaatgtgtcaaatccaagttgagcttcctgcacagggctgcttaggatctgttcatgatacacaaagtgagttactgggttggaggtttctagcagagagagtcagaataaagatgagaaaaaatagaagaatgccatttttaaatgcttattagatgcgacataaaaaaatgtattctaaggtctgtattaaaaagattttgcccataattccagggtaaaaaatgttaagcatgactgcacagaaatgataaggcactgatttatgtatagactaggggagacaacaattttttggttagactattccgtcacacattataaaatggcttttccttttttactgtttagttcaataaatcttcttgtctattaatctgaattgctggctcaagctacataccatgattttctcactgaaataaagtctgtgggagaggcccctggcataaactaaaatcttatatcaagtgcagaattcttctgtctcctgcaggcccattgcaagattttactgtgtttgcttactaatataagctagagaaattcccattaatgtttaaagcagttgtaagccccatgaggacccgaaatcacttaaaatcctttaagtgtttttcataacacacattaatcactatttcagtcaagacatatatgacaaggagtgatgagcaaataaaatgttataaataaaatgcctagaaaaatatttattagtattacattatagtatagtttatgaagttaaaaaaagaagataacaaatattagctaacaatgatataaacctgataaaacagtaattggaactaaagtgttctaatgtcctaaaattctaaagccaaggctttggtagctgggaacaagaacagctatactccagaggccaatgtggggaaagtggagacagtccttcaaagtcaaagatgcagcaagtaagaaagagtgagctgcctagacgtgtgacagtaggatgagccaaggaagctctgtggctgagtcttctggcaacacaattttggggatattgactcttgaaagacaagctgagtctgagttacctgctctgaacccaaaacacttaagagcacaaaaattctatagggttagttggcaaaatttccagagataaaaatgaaaatttatgaataacttcacaaagattgcacagacataagaaagtaacccacttggagtcaatccagccaaaacaagaaataaaagagtaataataaattaatacctgcaagacaaagattttgaaattgtcagtcctggcagtcagaagaaatatgtatgaaatatttagagaaataaaatgggcaatagcaaaaataagcataaatcaagaaaatatcagaagtgaacagacaaaattgaaaaacagaaattctagaaaaaaatttgaaataaataattcaacaaatgtttaaaacagccagaaagatatagttgaaatgagaattagagagctagagatacatagaaataatttatctggaatgaaaaaagagagataatgaaatgaaaaatgtgacataggttaggagatgtgggtgtgatgagtcttatctattgtgattacagaagagaaacatttgactttatcatggggctactacataatatattgttcagtcttaagtttttattaaaaaaacttaaggctaatcacttaaagaacagaatgtgtaaactgcaaaacaaatgttgggaggagtataataagagggaaaatatgttaataaatcaatcagtgtgaaaaaaagtaatgaaggagaacatgtataaagaaagaaaagcagaatagatagaaacaaaaacaccagaggaacttgagagtaaaaacaaatctaagcatataaatacccacgataaatataaataagctaaattttgcattgacagatactgtcagaaaagacataggagttagcatacttactatatatcaagtaattacagttagttttaatattgatgtttaacacacagaccttctatttttaactaatgagggcctctaaagttaagttctgagctcttgacatgacaacggaggtagctagaattgttctagatttaagttcccatttctccaagatgtgttggtttctaaaacgacagggaatggtatttagagaccatgatcaaggtattatggagattcaatcctagagaactgatgatagtttctaggccttttcagtagacaaagcaaggaaataggcatttcttaaaagggaatgcagcataaagcctgagttcatatcagtaattcctattcgaaattaaattgtttctatctcttttctcttgcactgaaaattttcagttcctaatgacattaacatattttacttattttattctactaataataaaataacaatcctaatgatacaggaattaaaaagaaattacttaggcagagagtgagggtatggaagtcctcgataaggttttccttttaatgaaaagcagccccaaattatttttccttctaacaaaaaaaagcagcctgtaaaatcgaactgcagacatagatgctggcagttgtgccaatcatgttcaagatggtggctctatcctaccttctttttgtcagtcacatgtacagtaagaagcagacaagatggcaccaatcaactgaaaagttcacttgcataataagattagggtggggtgaccagccttccccacacgctacataaacatcacacctgatccaaccaatctgtgagccctatgtaaatcagacactgcctacacaaggtggactataaaatctggcacatctgccaccagccagtcttttccactcagaagaccccatctctcaatagagaaagttgtttttctttctcttttcttctgcctattaaacctctgctcctaaactccttgtgtgtgtctgtgtcctaatttttcctggcatgagattacaaaccccaggtatataccccagacaacatagcagcttcatattgggggcttaactagaataccaaggtacaacattcattgaaacagtaagtaggggagtggactgcaactctgtcctttcattttggggctctcggtctccattttagaaccaaatcaaaccaaatactgggcctccttcaatcatttaaaaatgattagcttgggttccagatttacaaaacttggtggacaggattacatggagaatcccccagcactcgtgggttgttgggcatgttggccatgtttgaaccagctttgtttcatagagaacttagccatcatgtggggctagtggaagtcctggggcaactgaggatttctggctggggctacctcccactgttatccaaaggctctccaactttcctatcacaatttcctcatttcctggtcacaaccaccatatttcttattctctctgagtatgcaatgtgcaggaatttttatagttcagggaagtagtcttgtttggcaagatcagggaatgtcatagtaaccagggatatagctcaagggaaggcatctttgtgattttctaggaacagaaccccccaacccttccacagtaggcattactcttggcccttggtctggagagcacatggcatttccatgtcactctctgcccttggtctggagagcacatggcagttccaggtctctctctgcccttggtctggagagtacatggcagttccaggtctctctctgcccttggtctggagagcacatggcagttccaggtctctctctgcccttggtctggagaacacatggcatgttatggtcactctgctgttggtctagagagcacatagcagttgaaggttaaaagaggcacctagaggaatggggatcctctccatgaggcaaattgtcggtcctttacagaaacactctagcttcccaattctccctttttgcagccctcttgtagagaacaggctgcttctgtgaatgacaaaactctgccttcaacaactaggagtaaaatatccttcaaagctaaattttagcctccatactgtcccatcagcaggaaaacggccattcagtccctatattcttttaaggcacctatcctgcctctaattagaatggtacttaattagtaaggggattttaagttcagaagttaaatgtaaccattctctaagggtacatgctttagcacagaccataacagcaagatacagagctcaaactagcacactttctccattaaggagggaaatgcaactgtcacatagtctctcctgagatctgcagggagccaggcaggtcacacaaggccaggacatcaaagggaaatcacaggcagaggactagagctgcatgggtgagtgtgactaatcccaatctcttagttcctctggttccatggctggggttcacacctgcaaccatgagtagcacgttcaacaaggtgccaggatccaggaaccaagagggaaaaaaagcagaaaggacaccccccactgtcttcctctccaccctgggtcacaccaaaaggaaggagactaaaggcatgcctttttctcacttctcattctagaaaggtaccatcatcagcctgcactcgcctggagtccattctgaaacacaaagactcatttcaccctgagactttaaagaaaaagtggctcattttcttttgcacaggggcatgaccttcttactagacctttgcaggcattacaaaatcaacccagctcttttagtagtcatatcaggcaggcctatggagaatgattctcctaagttagagaagcaacttcaggggaagaatctgaggattccccttagttgggtccccctcaagttcccttctcattacaggaccttagggaaataaagggagacttaggccaattttctaacgaccctgatagatatacagttttccaaaatttaactcaagtgtttgacctttcatgaagggatgttatgctgcttctaaaccaaaccctaactgcagctgaaaaacagccagttctgcaggcagcagataattttgggtatgagtaatgtgtctcctgtgataggtaaaaagggaaaacagaaaacggagaaggtgaaaaatagtggtaacaactttgccaatagaaggaaagcagtatttcttgacaaccctaattggaaaatctagacttttctatggtgtttttccttctttcatgatttaaaatggcttctatctattcttttataatgttcctccaaaccgggaaaagttaatttccccaaatcttaaaaggcttggcttagagttcagcttgggaaaagggaacccagaagcctgacatgctagcaaaaaggtaaaagcacttttttaccagtcaggcttttggcttctctctccctgtgaaaatcagtaaacgaaatagtaaggagcaatgtttatattctctgtaaagttttaatcaatgaaagaggatttgtgaggttggtattacactgtagccaatctggtgtactttgtgtgtctttctgtatagttctgtcaaaagaaagagtaccttaggttaggatacaggcccaggatgccataagcctgctgttcaagccagctcaacaaaatggtccataataaactttacctccatcttgtttcatgtccttgggaacatgtcctataaccacatggcaatacttttttttagtctctgtcttcttgtgctaagtcagttcctgggtgagggccacaaattcagaaaagccagtttatcaatctgggtagggctagctaatacatcaagggcagggtttacagaatatcttaagcactgatcttgaatggatcagaatcttgtaatctccagctgtgtgactcctgagccatggtttctaatcttgtggctagtttcttggtctgatccgcaggctagagggaaatatatcttgggaaggggctgttattatctttgttttgggctatagtctgtagaccaggctcctcccaaagttggtttggcctacacccagggatgggcaaggacagcttgggggctgaaaacaaaatgaagttggatgagatctttttcactgtctctgtcaccactttgcaatgatggtttcaaaagctgcttgccacccctttaaaaatatcttgtacactcaaggttaagtcataacctaattaagccttgtttgtttcatctgtgaggttactctttgtaaagttcaagagccgaaaatcttaactgcttgacatggctaatgtcctttgaaaggatttaaaaagattttcttaaagagtgctcagcttaattaaaagtggaaattctagttataggtagatttaaaagacctttatgtatttttcttcttggatcttgtttttctggaaaaaaaaaaagggtggggggggttcttctcagttgactaaattacttattcccatttttttttctgtcttgccactcttaatgcacacatgagaggctctaagctaaagtctgatagcctaggactccttgaggaaaacagaggaaatgccacagatgccattttggggggaaaaaaaccctctgttttcctcatgaaacccagtaattaagagcagatagttccctctcaaagtcaaaggctctgttctgttttgcattgtgttatctgacatttttaagttttggggcatcagaaattacctcacattagagagttttgttgtataatagctaagaaggaaagatactttaagggatgcctaataatagttatggagggatatttaattctgcacatttgtatcagagaatcgtgctcttgaccacctgaaagatatggaaacatcctcatcccccactgagatgagactaccatgggggatggggtgtttacaaaataagctgattggctttgagttgccttgcaatgaaatgcatggaagaagcactgcactgtcttctcccatagtatctccctccttttggggatctaaaatctagtataaaaaggcacacttaattttgggatctgtgtattatatagtattttatagtgtattatatagtattatattatatatagtatatattgtattatagtatatatagtcttttcacaaattcagtgttgaaataaaagcatagaaagcttgtcttaaaatgctaatcggccctttagcaaaagggattataaaaggtttgtaaagagttcaactcatgatcaaattggttaaaattagatggaatcatctataaggttttttaaaaacaaactgaggttaacattaataaactaatgcaagggtaaaatttggctttcaacaggattttcatgtaatagtaaaggctaatgaaaggtttttgccttttgagtcatcattttggcaaaataaataatttatggcaatctggaattctattttataacatcaagtgttttaacactctaacatttaacagtctccccaaaatctaacttcaagtttcaaaattgtctttcctgatgcctggctttctggatggttcagagggcccctgaaacatccagagaagaggtaaacaggatcatttgaatatgtttagttacatgggattgccaaaatgatgttcaatcttctttaggttatattttagtgaataatactaatatatgttccaaaattgtatgggatttctaaaattctaatgtctaactatatgctatcaatcataattaaggttaaagttattgtaaaccacagagataactaaactcctttgtcagtaatgtttttaactgtaactaccctggatattttgtcatttgcagacaattgttgtcttgctttgttccttctcaaaagatggtttgtaatcaagctataggactttaacaggtgttctcaaatgcagttttctaacagcattgaaaactgtaacattggaatagagaaaaaacgtacaggacccatgaagagctaaaatgttcatgaatatcaagcaagagttaacttaagtggaatgaactcaggaaactgaagcaaatctttttgatttttggctggaatattgctaatttatgttttatttttcagagtcaatgaaacttattttgaactatttacagcctttaacaattaagtaaggtatactcctgtgaacaaaatttggagcatgtttgtttctctctgtgtggttcctctagaatttgtaaactatctgtgagtactcttaacttatgacaatatagttgtttgcatcaatgaataagaatccatttttcttttgcaacaggacacaattggaaaaactagttgttttatcaaggcttttactggaagggtatgcttccctttaaggagtgaatctcaacttgcagagccaataaaagccccatggggagaactggtctcatacacctgcctatacagtccccatacagggttcctgacttgtggtcagtaaattatgttactttcttacaggtccaggagctccaagtttatcttgagaccttaagaggagaggatcacccaactcacaggtatttgaggatacaaacccatggctgggcttggctttaaagagtcttatctgagattccttgtggaacagagttccatcaaagccaatccaaaaggcctatgtagaaacaaccattcttgctgcacgttatgcaagtaatcaggacaagtataagactaaagtttattctacaaacaacacagtcctatcataatttgtttttaccaaaaatgacactggaaagagaaattatgcaccaaagcttatcatgtatttgtcattaaagcctagtctcattaattgtttttaagctttttgcctaccttttagactaactctgctcatttctgtaaatcaagtggtgatctcctgcagcttggaagaaccaaaaagggatgggtaatgtaaaaatctggatcaatatgctagttctgggcaataaacccacaaattcggctaggtaatgaaagtgagtagggtgtccataacccagaggttttttgcttgagatattaaaaccaaggaacttcatagacccacagagggaaaatctatatcttggcaagtcaaattttatatggaaaaaatctactatgtcacctttgcaggaattgctatactcactctactatttccaatagagttatacacgatagcaccttctagctgaaatattggacagagagtttccactgctgtaatattttacttaattattatccttgtagcaaggataatagttaccaacaaaaaggaagcatgaaagttttactagcactgaatctgctagaactttttattgggtttggtaatatgtcacaccctagctatgcaaagaaggctataaagaaaagagattttatataagaaatgatcttgtatggtaaatacttgtcctaaagaaaatagctggttctttaaaagaggaatgtttaggacaagtcagaaggtctaagcatgtcttagatggtctgtggaaatcatgaagggattaatatttgcgggaaagatttagccaaggtttaaagttagccaaggttaactaaagttactctagctacccaattccaatgccacttatcctaaaaggaatgttacttctatattaacatttcaacaacatctgttggaggcaaagcagttttacaacccattggaatggctgacacaatcaaactccaaatggtgttgcagacaggaccacacatggacatgtctttcttccaaggaccttagatttaccccaggaggagccctagctactgttcccacacaacgtccctattcaggagaaagcagccagaaagggtcatcatccaacaccccctaaaagcagttagggttaccactccacaggggaaaataacacaggagttaagaagaaattgcttaggcagatagtgaggccatgaagtccccagtaaggttttccttttaatgaaaagcagcaattagtttcctttctaacaaagagcagcctgtaaaattgagctgcagacatagatgccggtagttgtgccaatcatgttcaagatggtggctccaactttccttctttttgtcagccacatgtgcagtaaggagcagacaagatggcaccaatcaactgaaaagttcacttgcataataagattagggtggggcaaccagccttccccacgtgctatgtaaacatcatactgaatcaaaccaatctgtgagccctacataaatcaaacactgcctcctcaagctggactataaattccagtgcatccaccaccagctggtctcttccactcggaagaccccgtctctcaatagagagagctgtttttctttctcatttcttctgcctattaaacctctgcccctaaactcctcgtgtgtgtctgtatcctaaatttcctggcacaagacaatgaaccccaggtatataccccagacaatatagccacttcaccaatattgtaatgaatataattattgaaaacaatatttaaaaattttaagtatatcatataatccttagagtatgtcacactagtgatctatggtaaatttactagaatttaggatcacttaaaataattctcctttgtatggtttatatcaccatattgaaccaaagtcagattcgttagctcattttttttattttagctcctgcttttgtgcttctctcttttttaattttagtttctattttttgagacagaatttgactctgttgcccaggctggagtgcagtggtgcaatcttggctcactgcaacctctgcctcccaggttttgagcaattttcatgccttagcctcccaagtagctgggattataggcatgcaccaccacacccagttaactttttttgtatttaggagagacgaggtttcgccatgttggtcaggctggttttgacctcctgacctcaaatgatccacctgcctcagcctcccaatgtgctgcgattacaggtgtgagccaccatgcctggcccttttgtgcttcttctactaattttcagaaattacataaaaacacatttacgtggtttcaaagtcaaacgcacaaaatgtggcatatttagtatagtttggtttctatttatgagccctccatatattctttttcttttaaaaagttcttatttattcattttttaaatttaggcaaatatatataagcaaatataatatatatataattatacaggaaaacaataatacgttatacacattctcgccaccttattattttattccatagcagtacatagagaatttcctcattcttttagaattgaataaaacttcattgtgtggatataatcatcttttacatagtcccaaacccaaacatccatgaaaggtcatggataaataaatatccctgcaatgaatagttccatgcaaacgtctttttgtgtttttactagagtatctttgagataaattccaatcagagagattgctgggtcaaaaagtaaaagcattcatagttttactacaaattgtaaagcttctattcataacagtttaccattttatattccctctagaaacatacttgtttccccacaggcttgaccaaagagtatgttgtcaaatacaaacttttgccaatataatagaaatggaatttcactgtagtttcaattcgcattttacttcttgggaaaaaaattgagaaacatttcatatgtttaagggtcatttatttctctttctccaagaactgctcatttttctccacagttataattcctgtctattttagaaggtctgtatcatattaactctttatttcctaaatgaattgcaaatattttttctagtttatcatttatctttgactttgtttatggttattttgccattcaattttttagtgttccaaagggtcagtcttttctttactgtttttgttttttaatcagagttaagaaagttttctctactcccagattacaaaggacctcactcagctttcctcctagtacttgtacatcttatttttaaaatttacatttctaattcatttttattttttcttgaagtatggtgtgaaaatgaatgtaattttatatttttctatatgtctaaccagttatcccaacatcagttattttgatatgattgacgtggaaaaactgtacacatagagtttgggaacaagtatacatccacgaaattatcacaccatcaaggtcataaatatatccatcactgcacttcccaaagttttctcccaccccactttattgttattgttataattctgtgtgtgtggtaggaacacaacataatatctacaatttttgcaaattttaaatacataatacagtaaggtgagctataggcactatgctatatggtacatctccagaacttgtgtattttgcataactgaaactttgtaccctttgccaacgtcacatattgaaaagtccatcttttcttcaccaatttgatatgctgacttcataatatagtaaattttcacagggattttaatctatttccagatattttccctttcttctctttagttaaatgtctatttggttttcaacactatgatatttcaatcactatatgttttaatatcagatagaaccagttcaccccatatgccactactctatcaggacattcagggctattcttgcttgtttttccaaatgaaatggctaatctatgtgtttatgtccggggtgggggggtgtggaatcttaatgataattacactgagattatattagatttatttattaatttgcaaaatattaacatataatattaaagcttcctataagttaatatggtatataaacacaacacaaacccaattagaggatatactgaaagagaagtccttgttatgttcataaatatttatatgcaagcctagatgtgtttaaaacctatatggagaaagctataaaaagctcctgaaaggcacaaaagtacctacaacaaaaggaaaagatatgccatatttttgcatacacaattcaatatcatatagatgttaatctttgcctgcacacgcataagctcagtttcctgcttattgtctgaaatccttctttcgacactttctagaaaaacatcatggaaaagtcaatgtcaaaacacactgtatgggtatcacagacatgaaaaaaatctgagactaccgtagagcatcctataaagaaatgctgtatcattaacactattgataataaagaacatcatgctatatggaaaacgacaaacatcaaaaactctaagagccagactctaaatgcaaagaaatttggaaaactttcaacacagatgttttcaaggggtctctgaagccttttagggatctgcagggttgaggtgattttcagtattattattattcttgagacagggttttgctttgtcacacaggccggaaggcagcagtgcaatcataggtcactgcagccttgaactcctggcctcaagtgatcctcctgcctcagcctcttgagtagctggggttacaggcatgagccaccatgcccagccattttgcataatttttaatgtgttatttgtcatctttcattatgttgaaatttgccttaatggttcaagaacaatcataggtaaaattattgacaacttttcatgaattaagtggtattcatgaaactgtgccagtggacatatttttcaccaccacacactcagagtactaaaaaataatggggaaagccaatttctcttaaaaatatcttaggtgaagtagaaattattgatattattacatctcaaccctttgagtacccatgttttaaatctgtgtgacaaaggaggaattatacatagagtacctggctgcataccgaagtataatagttgcctctaggaaaagcacttaggcagttgtttgactggtgagctgaactagctactttttcacagaatgctatttttagttgaaagagtggcagacaagaaaatgatgagtattcaaatttgggctaccttttagaaaatttcttaaccataaacaaagtcagcctgctgtttcaaggtaaagaactggctacatttgtcaacaatgataaaatttaagtttccaagtgaaaattagaattttggaaaactggcatctgccaccatgcattttccaatcttcaaagaatatgttttgtggggatatcagttgaggttttgacactacataataaacgtgttaatatttgaaagttccccaaactcagtgaatcagtattttccaaatacctaacgcatgatgttataaaatcatgcatggtaaaagaccattcagagtacaagataaactaataaattttaatgtaacactataggacaaggccattgatatgtgaagtgagctgaatggtggccctgaaaaagatatttccatgtcttaattctcagaacctgtaattattaaccttataggataaacaagtaaattacatgtaaaatatgtgattaagttacatattttgagacaagaggcatatcctggattatctggatgggacctaaatccaatgactagtatcctcataaaaatgagccagaggtggactatatagacagaagaggagaaggcaacgtgaccacagaggcagagattggagtgacagtcacgattcaagaaatactggcagccaccagaatataaaagagacagaaagggttgggcacggtggctcacgcctataatcccagcactttgggaggccaaggcaggtggatcacctgaggtcaggagttcaagaccagcctggccaacctggtgaaaccccgtctctattaaaaatacaaaaattagccaggcatggtgatgggcacctgtaaccccagctacttgggaggctgaggcaggagaatcgcttgaacctgggagatggaggttgcagtgagccgagatcaaggcattgcactccagcctgggtgacagagtgagactctatatacttttaccaaaacaatatatgggagcagattgatacagaagcagacataagaatgcagctgtcttctcttaagacagacatttaagaaatttacacaaacgcaaaacaatcccactctaataactgtatttattttggaaaatatagttaagttttcctaacaattgttatgttgacaaattatggttttagtattgtaattttaaaatgaattattacatatttttaaatttttcaagttgtaatttttaatacaataaatgatagctatgatccacataaacaaaagttctttgggatcctcagaatcttcagaaatatacagaggccctaagaccaacaaaagaatactgcattaactagtttattatacttataatttcatattttatgcattcataagaatgacatctgatgaaaaatctacacctctataaattcaaaagacttctttcattaagaataaaatattggaaaatgaattcagaggtctctatgaggtgtgcctggaggaggaagctaaatttcagtttctgaattgagtttattaaaggtttggaacttcttaataaaaagataaaaaaatcatttgacccctcaatgaaaaagcagaggaaaaatgcaaagcttgggggaaaactgtataaaaagtcatgatcataacattttaatattgcacagagaaaaatacttcttcatatttctatgaaatctatccaatcaccttacatgcaaaactatttttatttcttcttcccaaactccaccccaaattcctccccagccttaccccatcctttgaccttatgactccttccttttctcttaggctctacatcacaaaagctcccaaagtctactctggaaacactcaaatatccttcaggagtggaagaggaaaagaaattccatggacagtcagaaccaacttttaaaggtaaaggtggggatgagaaagaaactcaaaacattgatgattttggtcttgttccataggcttacattttcttctctatggaccaagtacctccgtttaacttaattattaaatggcattcattcatatttttaattaaaaatactttattgataaaaaatactaatacccatctgagccttcagcgagttgtaatctttttgctagtggagggtctgacctcagtgctgatggctgctgactgatcagggtggtagtcgctgaaggtaggggtagctatggtaatttctgaaaataatacaacaattaatctggccacattgacagattcttccttcaaaacagatttctgttgtgctgctgtttgacagcgttttacccgctatagaactttgaaaactagagccaatcgtctcaaaccctgatgctcatttatcaactaagtttatgtaatattctacattcatcatcatttcagcaatgttcacagcatcttcagcaggagtagattctatctcaaaaaaacactgctcatccataagaagaaaactcctcatccattcatgttttatcatgtgactgcagcagttatgtcacatcttcaggctccacttccatttctagttttgttaactatttctagcacatctgcagttatttcctccatggaagtctcgaacccttccacatcatccataagggctggattcaacttcttccaaactcctgctaatgttgatattttgacctcctcccaagaatcatgaatgttcttaatggcagctagaataatgaatcctttccagaaaattttcaatttactttattcagatccctcagaaaaaaacactttctatggtagctatatctcaaattaagactagaaagctgaaaggattccttcatccatgggctgcagaatggatgctgtgttagtaagcatgaaaattacattaatctccttgaacatctccattagagctcgtgggtgactagaaatctttttctgagcaaagtctcaatagtgggcttagaatatcaaggaaaccattctgtaaagagttgtgctgtcatttacacttgtcaatttccagatcacaggcagagtagatttattattatcttatgggtctctaggattttagaaatgataaaagagtatttagctttgactttgtcagcagctgcattagtcactaacaaaagacagcatgtcctttaagactttgaatccaggcattgaattgacttctctatgatagtcctagatggtatcttcttccaatataaggctatttttctcctatggaaaatctattgttcagtgtaaccactttcatcaatgatcttagctggatcttctggataacttgctgcatattctacatcagcacgtgttgcttcaccttgcacaatttttaattttaattttttttaaattttagcctttatgagcacatagtaggtgtatatatttatggagtacatgagatattttgataaaggtatacaatcagtaataatcacgtcagggtaaatcgggtatccatcacctcaagcatttatcatttgtgttaagaacattccaactggctaggcgcggtggctcacacctgtaatcccagcactttgggaggccaagttgggtggatcgcctaaggtcgggagtttgagaccagtctgaccaacatggagaaaccccgtccctactaaaaatacaaaattagccaggcatggtggtgcatgcctgcaatcccagctactcgggaggctgaggcaggagaatcacttgaacccaggaggcagaggctgtggtgatcaggccattgcattccagcctgggcaacaagagtgaaactccatctcaaaaaaaaaaaatccaattatactcttttacttatttttaaatgtgctataaataatcattgactgtagtcaccttgttgtgctatcaaatactagatcttattcattctatttaattacatttttgtacccattaaccattcccactcctctcagccccaccagtactcatgccagcccctggtaaccatcattctaatctccataaccatgaagtcaattgctttaatttttagctcccacaaataagggagaacatgcaaaatttgtctttctgtgcctgacttatttcacttaacctaatgtcttccagttccatccacgtggttgcacatgacaggatttcattcttttgtatagctaaatagtactccattttgtatatgactattgtgaatagtgttgcaataaacataggagtgcaggtatcaactcaatatactgatttctctcttttgggtatatacctggcagagagattgcttgattacatggagctctaattttaattttttgaggaatctgcaaactgttctccatagtggctatttttaatttacattcccaccaacattgtacaagggtttcctttcctctgcattcttaccagcaatcattgttacctgtcttttggataaaagtcctttttactggggtgacatagtatctcattgtagttttgatttgcatttctctgatgatcagtgatgttgaacacattttaataggactgtttaccatttatatgtctcttgagaaacgtctattcagatcttttgcccatttttaatcagaatattagacgtttttctattaacttgtttgagatccttatatatatgggtattaatcccttgtcagatgaatagtttgcaaatattttcacccaatctgtatggtgtctcttcactttgttggccatttcctttactgtgcagaagctttttaacttgatgtgatcccatttgtccatttagcttggttgcctatgcttgtaaagtattattcaagtaatttttgcccagaccaacatccttgagagtttatccaatgtattttttaatagtttcatggtttcaggtgttagatttaagtctttactccattttgatttggtgtttgaatatggtgagaaataggggtctagtttcattattctacataggaatatccagtattcccagcatcatttattgaagagactgtctttttcccaatgtatgttcttggcacctttgctgaaaatgagttcaccatagatgtgtatggatttctctgggttctctgttctcttcttttggtctaggtgtctgtttttattccagtaccatgatgttttggttactatagctttgtagtataattagaaatcaagtaaagtaattcctccaattttgttctttttgctcaagatggctttaactattctgggtcttttgtggttttatataagttttaggattgatttttctatttctggaaagaatgtcattggtattttgatagagattgcattaaatctgtagattactttgagtagtatgaacattttaacaatattgattcttccaatccttgtacgaggaatgtctttccattttatggtgtgtactcttcagtttccttcatcagtgtttcatagtcctcattgtagagatctttcacttctttggttaattcctatgtatttatttgtgaatattttatcccatttactaggatgtctatttactgtgttgatagtttcttttgctgtgcagaatctctttagttcaattaagtcccatttgtcaattttttttttttttttttttgcaattgcatttggaatcttcttcaaaaaatctttgccaaggcctatgtccagaatggtactttctaggttttcttctagggcttttatagttttgggttttgcacttaaatctttaatccatcttgagttgatttttgtgtatagtgaaagggagagttccagttttaatcttctgcatatggctagccagctgtccaagcaccacttattaaatagagtatccttttgtcattgcttattttagtagactttgttgaagatcacatatttgtaggtgtctagctttatttctgggttctttaactggttctattggtcaatatgcctgtttctgtaccagtaccatgctgttttggttaatgtagctttgtatttgtagtttgaagttaggcagtgtgatggttccagctttgctctttttgcttaggattgctttggctattcatgtgtttttagtttcacatgaattttagaatagctttttctaattctaagaagaatatcattggtagtttgataagaatagcttttggcagtatggccattttaatgatatggactctttcaatctttgtgtcatttctgattgtcagcattgttttgtaattctccttgtagagatatttcacctccctggttagctttattcctaggtattttactttttgtgtgtggctattataaatggcattgcagtcttgatttggctctcagtttggacactctatatagaaatgctactcatgtttatacattgattttataccctgaaattttgctgaagttgtttattagatcaaggagatttggggcagactatgggattttctatgtaaagaatcatgttgtctgcaaacggggatagtgtgacttcctcttttcctatttggatgctttttatttctttctcttgcctaattgctctggctgggacttgaggtaccgtgttgactaggagtagtgagagtgcacatccttttcttgttctcattctcaaggggaaagctgccagcttttgctttctgcatcaattgagatgatcacatggtttctgtttttagttctgtttatgtgatgaatcacatttattgatttgcgtatgttgaaccaaccttgcaccccaaggataaagcctactttattgtggtggattagcttcttgatattctactggatttggttggctaatattttcttgaagatttttgcatctattttcctcaaggatattggcctgatgttttctgtttcatgtgtctctgccacattttggtataggaatgatgctggcttcattgaaggagttagaaaggagtccctcatcctcaattatttttgaaaagtttcgataggattagtatcagctcttctttatacatctggtaaattaggtgcaaatctatctcatccaggactttttctggttggtaggctttttataactaatgcaatttcagaactcattattggtccattcagggtctgaatttcttcttgcttcaattttgggaatttatatgtttccagaaatttatcaatttcttttaggttttctagtatgtgtgcatagaggtattcatatagtctatgatttttttttgtatttctgtgaggtcagtggtaatcgtccctttgttatttctgattttgttattttgtatctcctctctcttttttctttattagtctagctagtggtctatcaatcttatttatgctttcaaaaaacaaacttctggtttgcttgtctttcgtacagtttttgcatctcaatttcattcagttcagctctgattttgattatttttttctcctgttaactttggtgttggtttgcttctgtttctctagttcctgaatgttttatgttattttgctaattgaagatctgtctaactttttgatgtgagcatttagtgataaaaaactttcctcttaacactgctttagctgtgacccagagattctgatatgttttatctttgttttcattagtttcaaagaatttcctagtttctgccttaatttcattgcttacccaaaagtcattcaggagctagttgtttaacttgcatgtaattgtgtggttttgaggtatcttcttagtattgatttctatttttattgcactgtgatcagtgagtgtggtggtatgattttgttttttttaatttgttgagaattgttctattgccaatcatgtgatctattttggagtaagtgccatgagcagatggaaataatgtatattctgttgtttttgaaggaatgttctgtagatgtctgttagagccatttggtcaagtgttgagtttaggtctcaaatagctgcgttacttatctgctttgatgatctgtctaatactgaaagtgggatattaaagtttcccactgtcattttttgcttctataagtctcttcataggtctctaagaacttattttatgaatctgagttctccagcattgggtgtgtatatatttaagagttaattcttcttgagttgagctttttatcatgatgtaatgcccttctttgtctttttcattactgtgggattcatgtctgttttatttgaaattaaaatagcaacctctccctttttacttttccatttgtttgtacatttttctccatttctttactgtgagcctattggtgtcactgcatgtgagaagagtcccttgaagacagcatatcattgggacttgcttctttatccaacttgccactctgtgccttttaagtagggcatttagctcatttacattcaagattaatattaatatatgcaaattcaatcctgtaattgtgttgtcagctggttgttatgcagacttgattgtgtggttgctttaatagtgtcaatgctgaatgtgcttaagtgtgtttttctcatggccagtaacaacattgccatggttggaactctcttaaggaactcttgtaatgcaggtctggtggcaatgaattacctagcacttgcttttctgaaaagaatcttatttctcattcacttatgaagcttagtttggctggatattaaattcttggctggaatttcttttctttaagaatgctgaatataggcagtcaatctctctggtttgcagggtttctgctgaaaggtcctctgttagcttcattgggttccctttgtaggtgaccaaccctttctctctagatgcctttaatattttttctttcacattgaccttggagaatctgatgactatgtgcgttatagatggtcatcttgcacagtatctcacaggggttctccaaatttcctgaatatgtgtgtcaacctctgcagtcagattggggaaatttttgtgaacaatatccttaaatatgttttccaaatggcttgctttctctccctcactttctggactgccaataagttttaagtttggtctctttgcataatcccatatgtcccagaagttttattttttatttatttttgtctgactgagttgatttccacaattggtctttgaactctgatatcctatcttcagcttggtctattctgctgttaaaatttctgattgttttacgaaattcttactgtgagtttttcagccctatcagatcagtttggttctttcttaaaatggctatttcatattttagctctcgtattattttattggattccttagattctatggtttgggttttgactttctcctgaatcttgatggtattcattcctattcagattctgaattctacgtctgtcatttcagccatttcagcctggttaagaaccattgctgggaagctagagtacttgtttggagatgagaacacactctggcctttttagttgctagagttcttgactgattctcgtctgtgtgggcagatgttcctttagtctttgaagttgctgggaagtgttgctttcatattctccaatgcccttgagggtttgaatttggtataagttggattcagttgactggctttgtttctgaatgatttcagtgggccaaggctcagcttagctctcctgggctgtgtgctgtaaccctgagggactggtatcatgcccacggctttgtcctctggcccctcaaggttaagcacccacttgctgtaggggccaaggtgttgccagtctgatgacaaaaacattttgatgagggttgctggccaaagcactttgatggcatggtggtgcaggatccacactcacagtggtaatgcagcagcattcaagtgcacacttgcactgacctgataggtttatcttttggtcttcctctactcgagatataagtagtttacacacaacaattagagtgttgtagtattctgtatttgtctgtgtacttatattaccagtgagttctgtaccttcagatgatttcttgtttctcattaatgtccttttcttacagattaaataactctctttagcatttcttataagacaggtctggtgttgacaaatcccttagcttttgtttgtctgggaaagtctttattttttccttcatgtctgaagaatattttcactgtatatactattctagggtaacagtttttttcttccagcactttatatatgtcatgctactgtctcctggcctgtacggttttgactgagaagtttgctgccggacatattagagctcctttatgtttcattttttttctcttaatgcttttaggatcctttctttatcctggacctttgggatttgattgttaaatgtcttgaggtaatcttctttatgttaaatctgattggtgttctataaccttcctgtacttgaatattgattcctcaccctaggtttggaaagttctctgttatctctttgaatctctttctaacccaacttctctctctctctatcttctatttaaggccaatgcctcttatatttgcccttttgagactattttctagatcttttaggcatgttttattcctttttattcttttttatcttctctatttattttcaaatgtgtgtgttaaagctctttcttcattcttttttctgcttgtttcattctgcttttgagagactcggatgcattcttcagtttgtcaattgaatttttcaactccaaaatttatgcttagatttttaaaaattatttcaatctctttgatatatttatctgatagaaattctgaattccctctctgtgttatcttgaattttatttagattccttaaaacagctattttgaattctctgtaagaaatgccatatatctcagtcactccaagattggttactggtgtcttatttagttcatttgatgaggcacccaccaccatgcccagcaatttttttgtatttttcagtagagatggggtttcaccatgttggccaggcaggtcataaactcctgacctgagatgatccacctaccttggcctcccagagtgctgggattacaggcgtgagccactgcacccggccatcaaagtcctctttactctaccttctcttttcatcaagtggaaggagtctctcctggagttgcgaattgtgctgtctgggtttgggggatgggtgacacaagcactaccttggccagcccagctggtatctcactgggtcacatgcatcccatgttcactggcttcaagcccagaacaacatcaggacttgcccaggaattgcagtccttgtggcctagactgcctttcaagtttatttaaaatcccagagcactgtagcccatggtggtggggctaggtggaatccagcttccaactgctgggacaaataattcctctttgactggggctagtctaaatgcttcctctgtgggtgctgactgaatttttatctgttcttttctgctgtgacaggacaacactgagttccaattaaaagtcccataatcacttctctttcctaccccaagcacacagattctctctccccataccacacagtactgctaggggatggggaaggagtggtgttagcaattcaagactgtctttcctaccttcttcagtgcctctttccttgatatgatgttaaactcagctactgtaattgctcacctgactttgatttttatgaaggtgcttccatgtgtggatagttgttcagtttggtgttcctgcaggggagataatcacttcaaagggaatgggaagatgttggtcaaagggtaccaagttgcagttatgaataaatctagtgtacactatgactatagattacaggcacagagccacaacctgtggctctgtgcctgtaatcctagcactttgggaggctgatgcaggctgattgcttgagctcaggagctcaagatcagcctgggtaacatgacgaaactccatctctacaaaaaaaaaaaaaaatacaaaaattagccagatgtggtggcatgtgcctgtggtctcagctactcaggaggctgaggtgggaggattccttgagcccaggaggccaaggtggcagcaagccataatcgagccactacactccagcctgaatgacagagcaagactgtctcaaaaatttaaaaaaaaagtatgtattgtatttattttggttatctccatatttttggagatatcacaagtacaactgtgtgaggagatggatatgctactttgcttgactatagtaataattttactatacgtttatcaaacattttgtgtacctcaaatataaacaattttttctacagttaaccatgaaggaagactttactcagtctattgcaataagggacggagactgaaatcaactctgctgaaacaaaaggcaggaaggtttctaaggtgagctagtggaaaagcactgaagtacattaaggggaaggttgatcaatgagatttgtccagcacattgggttattcctgttattccacaattcacaaatgtttttctctgtgatcaggccacctttgtttgctaatcagtgcccatctaaattaggcctgtatggaaccacagagactggaagatgaggtgctgtcttatttgacattaatacttcaaaaagatgtttctagattcttcagaaaggcatttcctgggtggtaaaactggcaggatggccagttccagatatctgactggagatgtctagcactcacttccttcacaaaaaagagtcaaaacggtgaatagataactactcatctgagaacattaaggttgtcttggtcactagtaacaatattttagatgctaaaatgctgcttgtaaattcatgtcagaatgctaacatacttccatttcttcatcccatcccaaaaagcactctaagaagatcacaataaccatgtgaggcattcagggcacaaacacacttttgttctgctatcttttctctgacactcagaccacccttgcctatagcaatcatgtttgactataagctacttgaggaaagactctttttaaattaaattttatagctcttagaggtgttaatacagtaatgtacaaatgattatgttctaataatattgactgatgcattaaataaatgaacattcccctccctggagatacgtatcaaagagctcatagcagaatctgaacatatctatggtcaaaatcagtttacatgccaaatctatgtaatctcacatccactgcaatccaaccttctttattacaataacaaccaagtcaaccttttagaatacagccacaagaccaaaaatccattagacctgagtgacaaataggaaccacagagttcatgcagatagctccctgataccataataagtataaatgagtttttttaaaggttcctgtagaaaaatatgtagataaccaaaaataaaagtactcattttattataaagtgttacatgtgcatttaatacatgcacatttaatgcatttcctaccaggtgccaggtccttttgagaaatgaaattaattattgaaaatattggaatattgaaatattgaaattattgaaaatattgaaattaatattttcactgtttgtctccatcaaatgtcttattaaaggtaagtagaccttctgctagcctatttaggtaagaatataaaaatgtagggttatgggcctggcgcggtggctcacgcctgtaatcccagactttgggaggccgaggtgggcggatcacgaggtcaggagatcaaaaccatcctggctaacatggtgaaagtccgtctctattaaaaatacaaaaaattagccgggcgtggtggcgggcgcctgtagtcccagctactcaggaggctgaggcaggagaatggcatgaacccgggaggcggagcttgcagtgagccgagatcgcgccactgcactccagcctgggcagcagagtgagactccgtctcaaaaaataataataatatagagttatgtacatgtggagtatttactaaattgatctgatcttatatgaattatttcaggcactctcgtcttcatcttaaaatggaatgggaatctacatcatttgggacttcccattactctcagaaaatagcccacctctgctttttgaaaataattctcggccgggcgcagtggctcacgcctatcatcccagcactttgggagtctgaggcgggcggatcacgaggtcaggagatcgagaccacggtgaaactccgtctctactaaaaatacaaaaaattagccaggtgctgtggcgggcacctgtagtcccagctactcgggaggctgaggcaggagaatggcatcaacccgggaggcggagcttgcagtgagccaagattgcgccactgcactccagcctggacgacagagcaagactccaactcaaaaaaaaaaaaaaaaaaaaaagaaaaagaaaataattctcctcagctgtattttggttcccctagttttccagctactcagagtttagtattacaattatcttattattgttctcatcttgaatcatttcaataatccttaaaacatattcaggttttcataaactaaaaaaaaagataagcatatataaaagaaaacatctaaagaaatctgtattagttgtctaacatcacataacaaattacccaagatcttagtgacttaaaacaataaacacttattaattcacagtttctgtgggtaaggaactcagttgtggcttacctgggggttctgccttaggatcacttaagatcttagtgacttaaaacaataaacacttattaattcacagtttctgtgggaaaggaactcagttgtggcttacctgggtggttctgccataggatcacttaagatgttgcagtcaggatgtcagccatttctgcaggcatcagaagacttgacttggtctggaaaatctgcacataagacagctctctgccatggtgctggttggaaaagttcctctttatgagttacttgagtgtcggcatgacgtgatggctagcttcccccagcatgagcaacctatgaaagggcatgacagaacctataacacttttatgatctagaatcagaaatcatacagcattattttttcaatttactatggcttacacaagtcagcactattccatgtgaaagggaattacagaggggcatgaataccaggagactaagatcattggatgccatattggaggatagctatcataacatttttctcttgttcccacctatctattatatttgctaaacaatgttcctctctggttttgctgccaagctcctaaaatatttgatctacatctttcacgtcctctctttaaggattctaattccttcttatcctttttgtcatctacttcagtgcatacaactccatgaaactatttcctcaaaggttactagttatctctttctgctaaatgtatgacgtttgcctttcctcagacttgtcattcaacattttaaagtgtttgctactatgaacaaccccctagtgacatttcctcattctttggcatctttggcactttatgggcttcttccatctctttgatgccacttagcttctccactgtgtttctatctatggagtgttctctaagttcacacctccatttttctccctatagtttggtctcatatatcctcactgctttggctgtgacatttagtatctggccattagtaaatatgtatctccttccctactcaatcatggtatgttcttgccagctgcctactagcatcttcattctctaatctctaagaaattcccactgattcttccttcaatacctctttgaagaatctgccttatctctttcgttccaactaccactactgtagtccaagccctctctatctcacaaccagatcaacacagcactattttagctgatatatttactggactcgagggctgaccttgccttttctttaataaaactgtcatacgcttttccactacatcttctttaaaaattccttttatctttttatttttaatcatgaaaagattcattatcatctgatttcaaatctaaactccttagactagtttctgaaacacttaatgtgttttggaaccacaccatttggctaccatacttaattccttattttctttatttcttactcttatttaccttatttttccttaatgaggttaatctactcattgtcctgcaaatacacaaatttccacatttcctttctttaattctattctccaccacacacacagaaaaatatgctcttatttatgtcctccattttatgaattttccagtctcagtttccacaatctcaatgaaatcttctctgactactttgtttcatactaaactgtttgattttttggttcctgatgccctattagtcacccacatctctgattcttcatatgttagttttatttccacagctcagttgtcggcttctaaatgctggatttatttatttcttctcatatttcttttaaaacatctaaaatagtctacaagtaccatgctgagcacataataggccatgaataaatatttattggttaactaaatgaggaaaacaactagaaaattcccatggcatttggcagaatgactacaggcaaaaggctccttctcaaaatatattatctaaaagtgcattttccccatgtgtcaatgaaaaaacaaatgactttcttctagcatagccaaagttagctcttaaagcatgtgtaaaatccaaaagacagaatttctgaaggcacaactgtttaactaaaaagacagatacgcaaaagaattgcttcatttaacaagtacagaggaaatagatcacattccaaaagtaatttgataattttggcagctggaaaataattttataaaaatttaagcaataaggctgttgtcttggatttgttaagggaaaggaaattttcataaagccaaaaaagtaaaagaagaacttacatatgtgagtatcaggaaaagaaatagtgaggataattgtatcactgaagaaacatctttttttctaattcaagcatataaaaaattaatgtgactattaacaactatgacctctctatagaaagaaaatatatccgtacttcccccagagtctcacagttgttgtgtcctcctttggaagcaatattatgtcttggaacctgtttgaggctctgcagtcagtggaactgttcattactagctgagtgaccttaggcaagttactgaatctggaggaaacttaccaacctcacagagctgttgggaaaattaaatgagattatgtatctgaaggaacctggcatggtgtctgactcatgctggccaatacatcttagtctctttccattctgattagcagagataaagagatattgggagacagaaccacactagagtaggaaggaggaaactgggactattttccaggttgagctgctacttagatattatggcaggaacagcaaattttcttacagattccattttcttcacttaaaaagattttttagttttaatttttgtgggaacagggtgggtatatatatttatggggtacatgagatattttgatgcaggcatccaatgtataataatcacattatggagatggggtatccatctccttaagcttttaacctttgtgttacaaaaaacatccaattgtaattgtttagctatttttaaatatacaactaaattattttcattatagtcacagtgttgtgctatcaaatactaggtattcatttttctaaatattttttatgctcattaaacatccccatctaccctcagtgtccccactactttttcaagtctctggtaaacatccttctactctctatctccatatgttcaattgttttgattgttgcatctcacaaataagtgaaaacaggtgatgtttgtcattctgtgcctgagcctgacttatttcacttaacataatggcctccagtcccatccatgttgttgtaattggcagcatctcattttttatggttaaatagcactccatcatgcataaggaccacattttctttatcctttcatctgttgatggtcacttaggttgcttccaaatcttggcaattgtaaacagtgctatagcaaacatgggagtgcagatatctcttctacatactgatttcctctcttttgggtatatacctgggagtgagattgcaggatcacatggtagctctatttttagtgttttgaggacgctccaaactgttctccatagtgattatactaatttacattcccaccaacagtgtaaaagggttcccttttctccacacccttactagcatttgctattgcctgtcttttggataaaagccatttttactgggatgagatgagatctcattgtagtcttgatttgcatttctctgatgattaataatatggaacaccttatcatatgcctgtttgtcattagcatgtgttcttctgataaatgtctattcagagctcttgcccagttttaaaaatcttttaagttcaggggtacatatgcaggtttgttacataagtaaacgtgtgccatgggggttggctgtatagattattttatcacccagatattaagcctagtacccattagttatttttctggtcctctccctcctcccaccctccacccaccgataggtcctagtgtgtgttgttcccctctatgtgtctcagcatttagctcccacttataagtgagaacaggaggtatttggttttctgttcctgcattaatttgctaaggataatggcctccagctccatccatgtccatacaaataaggtgatttcgttctttcttatggctacagagtagtccatggtgtatatataccaccttttctttatccagtctatcattgatgggcatttaggttggtttcatgcctttgctattgtaaatagtactgcagtgaacatacacatgcatgtgtcttcttaacagaacaatttatattcttttgggcatatacccagtaatgggattgctgagtcgaatgttatttctatcttgaggtctttgaggaatcaccacactgttttccataatggttgaactaacttacactcccaccaacaatgtataagcatttctttttctctacagtctcaccagcatctgttttttgacttttaataatagccattagactggtgttagatggtatttcattgtggttttgatttgcatttcgctaatgatcagtgatgtttgtgcccatccttcttgaggatttccaggtatttgaagggacttgggccccaagtccaatatcactgtggctttggcagactgaaagagataccaccttggttgtcttggataagatctgcaagaattctctgggtaaccaggcagagactcttgttcttttcccttactttctcccaaacagagtttctctctgtgctgagctgtctggaactaggggtgtggtcatgaaagcaccatgctagtgttagcacggccactaggtcttgcctaaggcccgctgtaacaaccacctggctaccacctttgttcactcaaggccctagggctctacaatcagcaagtgaagccagtgcagtttgtgtccttcccttcaggatgttgagttcccccaggcgggtccagagatgctgcttgggagccagggattggagtcaagaatcttaaaaatttgccttatgttctattcttctgtggctaagctggcattcaaaccacaatatatatttctccccattcttccctctcctttccataggcgaggagcctccctgtgagcactgccaccaccactggcctatcatggggttctgccaggtcaccactgatgttcacttaatgcccaagggctcctcattcatcttgtggtgaatgctgccagtcctgaaactcagccttcagggccatgggctctgctctggccccagggcagatccagaaaggctgttcaagagcctagttctggaatcgggaaccccacacttttgcttacggctctaccccactgttgtggagctggtaccttaggtgaaagacaaagtcccatttacttttctctctgcttttctcaaacagaaaggtctttcactgtagccaccacagctgggaatgtgctgagtcacgtctacagtcagcatgtttcagagtccaaggaccacagcatactacttggttatctctgctggttattcaggcaccaaggactctttagtcattaggtgatgtatcctgccaggactgggtccttccttcaaggcaatgggttccctttgactcaacatgtgtctagaaatgtcatatgggagacagggcttgaaaaggggacatcataaccctgactggtgccatatcctactgtggctaagctggtaaccaagatgcaagacaactcctctttactctttgctctcctcaccttaattagaagaaataggacacttttgttgtcacaagctgctctgcctagggttggagtcgaattggctcaagcacttcttcagccactccagctggtgtctccctaggtcatgtgccccctagtcctctggctctgagcccagcccagcactaggatttgcctaggaattgcggtccttctggactgcctttcaagtttacctaagactccagagtactttggcctatggtgccaaagctttccaagaagctgaagttctgaccgatgggatgagtgattccccttttgctaggtctggtccaaatgctttctccatgtgctggcactagctgagtccaggctggcttttctctctgctatgacagagtagcaatgagttcagtgtatgcctcccagtcactgtgctctccctaccctaaatgcacaggctctctgcactacagagccattgccaggaaattgggaaggggtgatgtcgctgattcaagactgtctctccaacccttctctatgcctctttcaatgatacaaagttaaaaccaagtactatgattgctcacctgagttttggtacctgtgatggttcttttctgtatccagttgttaaaatttggtgtttctgcagggaatatgaatggtgtaggcttctattctgccatcttgctccatccctcctcttcttatagaagcccctgagttttaatgggtagccaaataaagatatatttcttttggcttcctggagtttctaactgatttatttgcaatgccgtttggtagaccagatactactttactaccattcaccactaacttcagtcctacgctcagccaaatgacaacattcatgactcttttttgatacctatgggctcttctgtgtatgaccactggaccagatgatctctaagaaatcttccagcaatcagtggttctgggaaaacacatgggatgatgttcatttctcttagtcgatattgcaattacttagtgggttttctctttttctcaaaatttaacaggaaatttgaaatgatcttggttttaaaattctcagatgtcttctgcatgttaaacctatcaaatatttatttaggagacggatggcatattgtggttgctgtaacaaaataccataaacctgatggcttaaaacgatagatttttttattctttcacagctctggaggccaaaagtccaaattccatgtgtcagcagggccacaaagactctaggggagaatcattcctttcctcctccagtttctggtggctccaggccttagtgggttggtggttgcatcacttcaatacttgtttacatcttcatatggccttatctatatctttgtctgctgtctcttaccaggacacttgtcattagatcttggtctcatctcaagaactttagtcccatctgcaaatattttatttgtaaataatatcacatccacaagttctggggattaggacttggatatatgttttggggagtcaccattgaactcactacagatggctacataaacaatcacttataaaatacatgcagtagagctatctcatactctaacaaggaaataatcatatttccctttttaactatttacaaaaaaatgaaaaatttgttttaagatattttcatatgaattgtgaagctacacatttaaatagcaatcttttcaatctatcaatatcttctacattatcatagcattttcattattgtgaattttgttctaattttggaatttactacttcttaaatagataacaattatttagaaagaagtcttggaaaaaccaatttttttcttctgtttaaagaaacaagtacacataaatacaatcttaaaattcaacataaaagtatggagaaaaaaattattctccttcaatattcctttcttaatccctctctcttccttagacaaataacagtttaaaatttctttccgaaacttttgggcatacataaaggacagttgtttgtgggtttttttgtttattataaatgagattatggtcagtgaattgcattttctctttaccaatacctcttgaagatatctgtctacatggacatctatactattatttttgtaactgcacaatattgatagaaataatgcgccataatttgttgatgaacatctaatttactttcaaattttttatatcacaaaaatgttttaatgtcatatatctttaagaacgtgcaaatatttctataggatagatatttagaggtaaaattctttggtcaaagttatgcacatgtccactttgatttatcctgctcatttgtcttgcaaaatgctctgtgaaagggacaattatggctaaagaataatccttatgtggtcaattaaccagctatattcttctataatagctggacagatcatgtgggcaaaaggatatacatgtatatgtttatatgcatctgtatatttttatgtacatatgtgtgtgtgtgtgtgtgtgtgtgtgtataatatactgtttgttttttctatctaggtgttatagaaagccacttagcatcagctggataaattagaaaaaaagtcacttatgctaatatccccccatccacccaaataggctaagcatcatacactcaaataaggaaaaagagagccatttttttcagtgtagtaaacaaaccacaataaaaaaaaaaaaacctaaaagaaaaaagtagcatctgttctgctttatggaccagtgccatggtcccaaggcagaacactctctcagttcaagaattcgccctgagaatggaggcagctccaaaatatctaatggaggcatcttaaatcaacacaagagctcaattcaacaatgccatcacaactctgtacttttttcccaacagttctagcagaagaaaacttgctaaaagttatatgtaacttgaattccaaggtgatctgaataaaatgagtgcagcaccacaaattatgtatttagatgcttttcagctaatctaggaaagaaagaatatcttttcctcaggcaaaaggttaaactggagtgacagtagcataaaaaaacttattgtggtgcctcaatagctgtcactcctgacttcggcactcagcataattatatcaacatagtaataaaaataattccaaagtatttgaacatggtatgtccttaaaacaggttgacaactaaggatgcacatattttgaaggtagcagacttacagctctttaaaatgcagcaggaaactgcatttctaaaatacaggaatacatagaattatttatcaagtcattatagaatatttacagccttagaaaatttatcatgttccattaagtagagtttgcttccatcaagctattccttatgcagagcttcaaatacccttcatctaacctcactgaagtccagtgtacactttctgcctctgaaatatctccacatatatccttatcacatatttggcaaaatagggggtcaagcaataaaaacctgataggttgtattgcatggaattgctttctgatcaaaatctaagatgcataaaatgttgggttgttgcagagtttgttgtatttacaacaaagcagaaaagttagtcaatttaaacatatgaaatcggctgcgctaaagattagaacaccctggggatcagagacacagttcaggatggctgagcactgacagtgtgacatatttcaggacaaaaggattttgtactgggggaatgattccattctaccgacgagcaaatggagcaaatgattatttttgcattctttatgtgttattctttgacttctcttttcaccatttggagatcaaactgtttttggctgttctgtgacttttttaaccaacgatcggatacctttttctctgcttgttttcacttgttttttatttatttattttgagatataattaacactcagtagtatgcacagccaggcacagtggctcatgcctataatcccagccctttggtaggccgaggtgggtggatcacttcaggtcaggagttcgagaccagcctggccaacacggtgaaaccccatctctactaaaaatccaaaaactaataataattagctaggcacggggcatgtgcctgtaatcccagctactccagaggctgaggcaggagaatcactagaacctgggaggcagaggttgcagtgagccgagatcacgccattgcactccagtctgggcaacagagcaagactctatcccaaaaaaaaaaaacaaaaacagtatgcacaaacttcaactgttcagtatgatgagctttaataattatatacagctatgtaaccaacactgaaaaaatacatttaaaaaaatcccttgtgctctgttccagtcgatttctgtccccatccccacattaactatgagatttctatcagcatagattacttttccctgtattcagatttcatacaaatgaaatcctacagtatatgctttttatcacttaatataatgttgttggttatcctttctatcacttaatataacgctgttggttatcctccatgttgttctgtatatcaatagttttaactgctaaatagtggtcaattgtatgaatatactacaatctatctatcaagtctcccattgtttgatatctgggtttgttctagtttttgttattataaatctggttgctatatctttttacatgtcacgttaatacctatgagtagtattgctaggtcatagggactgccagttttcctaagcatttttatcactttacactccaccagcaacatatgagaggttcttcactccacattctcaccaaaataagatgttttcagttttttttttaaatttcagccactcctgtggatgtttagtatagcatctcattgttgctttagtttgcagagccttatatctagtaatgttaaagactttttaaatgtatttattgttcattcatagattttcttttgtgaagtgtttaagtctattgcacatatttcaattgggttgtctttttgtagttgattggtaggaaatttttatctattctgtatacaagtctgttgtcagaaattctttgaattttatttatcattttgagatttacttattaatttttaatggagtcttttgatgagcagaattttaaatttagcctaattttagtaattaacttattgtctcttatggttgatgctttttgtgttctatcaaatacatctttgcctaacctgaggtcatgaagatatgtttcttttttcttctagaagctttataagtgtcattttatgtttaggtctgggatccattttgaattaatttttgtatatggaataagagtgaaattacattttcttccatatagatatctagttgttccagcaacatttgttgaaaagactttggccaaagaattgctttggcacttctttgaaaatcacttgactacatatttgaagttgaaaatcactttactgagtatttgtggtttgtttgtgttctattaatttatttgcctatgcttatgccaataccacagttccctgattactatacgtttatagtaaattttgaagtcaggtagtcttaagtcctccaattttgttctttttcaatataggttttgcaattctattttcttttcattaccatatataatttagaactatcttgtctatttcttcagaatagcctgttgacattttgatagagattgcattgagtctatctatcagtttaggaagcctagacattttaacaatgttgcattttcctatcgaggaacatgctatacttctccatttatttagatctttaatttctctcccaaatattttataattttcagtgtagaggtgttacatatcttttattagatttactctttcttctccaaggttttttgatgctattacatatttttaactgctattttccaactggtggtgggatggcaatttgctctatggctggggcccttgtaattccaatctattacaagagcccacacacggttattaaacatgcattagcaggtcagctggtttctgcctatcctgtctgtgattaattcttctagaaaggagaacagtgataaatctcttctatcctataaagagtttctcactctctgatgtcttgttcatttgggtttctttatgtgctcagctttatgatgttttttaaaatatcatttttataccttatctggtttgtttgggttattaatttaagactaacggtcttttgtgactttttacatccaaactagaaatcaatcaattatgtggttttttaaaatagttttaaggtaaccttcctctttactatgtctgaaagtacaaaaaggaaatgaatcaaatagtggtcaggacaacaaaatcataaagaaatctgttgacttatggcttgctatgtgctaggtcctagatttacaagtatcaccaaattcagttcttagaacaaccctatgagggaggcatgacagtcattatccccatttcacagctgagtaagctgaaatacagagtacataactagtttgtctgatgaaacacagctcttaaatgaaaaaactgggatttaaacacaagtagtatgggtttcgagcctacattctcaccaccttctcttcaatttccctctaacaaatcttatcatttctacatttaccctcatttcccaagtacgatagctatctggaatttttaactgtaagtgctcatttctttattgagttgtgccgcttctgcaattttcatctgcaattttcatctatacaatctcttacactcacttagtatttttatataatagatacaacttattaagtgctcatataaaagatattgtgtgttattaacagtagttttgtatatattattcacaaatatcacaaaaattcttaaagatagatgatgttgttctcactctatttgggggtccaaattaagttccaaagcaagcaattgtcttaattcacataaaaattagtcaaagggtgaaattggaatctgaccaatcttgggtttaaagcccatgttccctttaccactccacacagcctctctctcatgaatgactctccgagtcttctgaactcatcgtcacaactccctttcctcatattttattaggtactctaactgggtatttatttaaatgctacttctttgtgtatcattactttatttttgcttctgctattttaaattcatttgtttgaagttaaggcctcaatgtctactggagcctcctttggaggatattcttaaaactgaaatttagattaaaaaatataaatgacgagttaatgggtgcagcacaccaatatggcacatgtatacatatgtaactaacctgcacgttgtgcccatgtaccctaaaacttaaagtataataaaaaatatgtatatataaggaaataatcattaatggaaatgagtgaaagaagtcaaccaagcagactttcagatgtgtacagtagattggggtctggggcccatactatgggcaggacctggttctcagctactagagttaggagaaataatgcagaatctctctgctcattctcataaaggtatgaaattacatatgattccacattaccattattaccattttttttcaaacaacccctcataccaactttatctacttcaaaatacaatacacaattaatgtccattttaacatggattcaacagaatgaaaggagatcaaaaaggctcccaaactcctcagggctgactctgatacttgcactccaccaccattactgccagtaaaacttgtccaattctagcctcatatatcaaaaatctcatgcatagcttccacatgcatatagtttcttgaatcatttagataaaagaagaaaaactctataataagggcttgcaatcggagagactgtcacttgatctactaatactcaatttatggtaggccctatgcaaaaatctataattcgtaattttgcacctatttctgaaatttaatggcacttaacaagatttaaaaatactgaacgcttatcttcattctcagtacagaaacccttcagagaaaaaattctgctactctcttaggactgaatctcatttcagacacatgttcctttctatagctcaggtgtaattatttaaatgtcattaaatccttcaaatctgtttgataaagtaattgaaattaattcatgtaatttattttactttcaatgatagaaacgtgtgcacataaatgtcactgcactgccaaacccagtggatcgcaactgagttttctttctgaggatttctagtcagcagggattttaacttccaaatgcaaaaatttctctcttgcagcacataagtgggctgaggcactaattagcaagtttcattagtaagaaattctctcattcaggcctatgaccaaagagatgaagctaggacgttattgagaccaagttcctgctctaaagcgatccctgtaatactatcacaaattataatagtgctttttatttttttcttttattatactttaagttttagggtacatgtgcacaatgtgcaggttagttacatatgtatatatgtgccatgtcagtgtgctgcacccagtaactcgtcatttaacattaggtatatctcctaatgttatccctcccccatcccccctgcccccaccccacaataggccccgctgtgtgatgttccccttcctgtgtccatgtgttctcattgttctattcccacctatgagtgagaacatgcggtgtttggttttatgtccttgtgatagtttgcagagaatgatggtttccagcttcatccatgtccctacaaaggacatgaactcatccttttttatagctgcatagtattccatggtgtatatgtgccacattttctttttttttaggtttacttttattattattattattattattatcattattattatactttaagttttagggtacatgtgcacaatgtgcaggttagttacatatgtatacatgtgccatactggtgcgctgcacccactaactcgtcatctagcattagatatatctcccagtgctatccctcccccctccccccaccccacaacagtccccagagtgtgatgttccccttcctgtgtccatgtgttctcattgttcaattcccacctataagtgagaatatgtgttgtttggttttttgttcttgcaatagtttactgagaatgatgatttccaatttcatccatgtccctacaaaggacatgaactcatcattttttatggctgcatagtattccatggtgtatatatgccacattttcttaatccagtctatcattcttggacacttgggttggttccaagtatttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgctcctatttctccacatcctctccagcacctgttgtttcctgacatttaatgattgccattctaactggtgtgagatgatatctcattgtggttttgatttgcgtttctctgatggccagtgatggtgagcattttttcatgtgttttttggctgcataaatgtcttcttttgagaagtgtctgttcatgtactttgcccactttttgatggggttgtttttttcttgtaaatttgtttgagttcatcgtagattctggatattagccctttgtcagatgagtaggttgcaaaaattttctcccattttgtaggttgcctgttcactctgatggcagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaattctttaatacatcttgaattgatttttgtataaggtgtaaggaagggatccagtttcagctttctacatatggctagccagttttcccagcaccatttattaaatagggaatcctttccccattgcttctttttctcaggtttgtcaaagatcagatagttgtagatatgcggtgttatttctgagggctctgttctgttccattgatctatatctctgttttggtaccagtaccatgctgttttggttactgtagccttgtactgtagtttgaagtcaggtagtgtgatgcctccagctttgttcttttggcctaggattgacttggtgatgtgggttcttttttggttccatatgaactttaaagtagttttttccaattctgtgaagaaaggcattggtagcttgatggggatggcattgaatctataaattaccttgggcagtagggccattttcatgatattgattcttcctacacatgagcatggaatgtttttccatttgtttgtatcctcttttattttcctgagcagtgttttgtagttctcctggaagaggtccttcacatcccttgtaagctaggtattttattctctttgaagcaattgtgaatgggagttcactcatgatttggctctctgtttctctgttgttggtgtataagaatggttgtgattttcgtacattgattttgtatcctgagactgctgaatttgcttatcagcttaaggagattttgggctgagacaatggggttttctaggtatacaatcatgtcgtctgcaaacagggacaatttgacttcctcttttcctaattgaatacactttatttccttctcctgcctaattgtcctggtcagaacttccaacactatgttgaataggagtggtgagagagggcatccctgtcttgtgcccgttttcagagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatattttgaaccagccttgcatcccagggatgaagcccacttgatcatagtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatgtatccatttcttctagattttctagtttgtttgcatagaggtgtttgtagtattctctgatggtagtttgtatttctgtgggatcagtggtgatatcccctttatcattttttattgtgtctatttgattcttccctcttttcttcgttattggtcttgctagcggtctatcaattttgttgatcctttcaaaaaaccagctcctggattcattgattttttgaagggttttttgtgtctctatttccttcagttctgctctgattttagttgtttcttgccttctgctagcttttgaatgtgtttgctcttgcttttctagtttttttaattgtgatgttaggctgtcaattttacatctttcctgctttctcttgtgggcatttagtgctataaatttccctctacacactgctttgaatgcgtcccacaggttctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtccgcttggtacagagctgagttcaattcctgggtatccttgttgactttctgtctcgttgatctgtctaatgttgacagtgggatgttaaagtctcccattattaatgtgtgggagtctaagtctctttgtaggtcacttaggacttgccttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttctccatttgcttggtagatcttcctccatctttttattttgagcctatgtgtgtctctgcacgtgagatgggtttcctgaatacagcacactgatgggtcttgactctttatccaatttgccagtctgtgtcttctaattggagcatttagtccgtttacatttaaagttaatattgttatgtgtgaatttgatcctatcattatgatgttagctggttattttgctcgttagttgatgcagtttcttcctagtctggatggtctttacattttggcatgattttgcagtggctggtaccggttgttcctttccatgttttgcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaattttggcccccactctcttctggcttgtagagtttctgccgagagatcagctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctaccttgctagattggggaagttctcctggatatatcctgcagagtgttttccaacttggttccattctccccatcactttcaggtacaccaatcagacgtagatttggtcttttcacatagtcccatatttcttggaggctttgttcatttctttttattcttttttctccaaacttcccttctcacttcatttcattcatttcatcctccatagctgataccctttgttctagttgatcgcatcagctcctaaggcttctgcattcttcacatagttctcgagccttggttttcagctccatcagctcctttaagcgcttctctgtattggttattctagttatacattcttctaaattttttcaaagttttcaacttctttgcttttggtttgaatgtcctcccgtagctcggagtaatttgatcgtctgaagccttcttctctcagcttgtcaaagtcgttctccgtccagctttgttccgttgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgtcggagtacccgccttgtgaggtgtcagtatgcccctgctggggggtgcctcccagttaggctgctcaggggtcaggggtcaggggtcagggacccacttgaggaggcagtctgcccgttctcagatctccagctgcgtgctgggagaaccactgctctcttcaaagctcagatggaaatgcagaaatcacccatcttctgagtcgctcacgctaggagctgtagaccagagctgttcctattcggccatcttggctccttcccctgccacattttcttaatccagtctatcgttgttggacatttatcttggttccaagtctttgctattgggaatagtgacacaataaacatacgtgtgcatgtgtcttatagcagcatgatttataatcctttgggtatatacccagtaatgggatggctcggtcaaatggtatttctagttctagatcactgaggaatcaccacactgacttccacaatggttgaactagtttacagtcccaccaacagtgtaaaattgtccctatttctccacatcctctccagcacctgttgtttcctgactttttaatgatcgccattctaactcgtgtgagatggtatctcattgtggttttgatttgcatctgacaaaaggctaatatccagaatctacaatgaactcaaacaaatttacaagaaaaaaacaaacaaccccatcaaaaagtgggcgaaggatatgaatagacacttctcaaaagaagacatttatgcagccaaaagacacatgaaaaaatgctcatcaccactggacaagcgcttttgaaaaaccaggaaagaccatagcagcaaatagaatccctttagaaactgattttggcatgcctggaacagatgctacaatcacttctagtcagtaagcactcatgaacaacaaaactgctacaggcaaaatgagctaatatctgacccaaactcatgttcacaaagtcgcttcaagatctcacttcatacatttccctacatattttttcaggtgaaactacaacctgccttttcttgagtaacccgcccttttgtccgcttacaaagcacaacagtgtagatagtgtttggctggcctgttagaaagttgatttgtcattgccatttgtctaacgcatgcttgttacagaacaaggaatatgctttcaaataagggtatgaaatgtggtttgatgaaacacagtgagtgaaggaaaacttagtccttgcctgtgtacttgtaacatactagtcagtctggtgtggaatataataatctacaactgatctgagcaaatatttctctctgattagaggacagtgatgatagaatattccagcaaagttaaaaaggaagaatgtggtttctccctatggtgtaatcccaggaggagttcactgttcttcctatttcagaattgctgacagttgaaaattatcttcagttactttattatctgtttagatttgaagataaatgaatcaaacatctaatttaatgcagtcatttaattctactggttacctattctcttctatacaattgagttttgtatttcatatcaaagggtatctttatagcagattaatatctaaaccactagaaaaaacctttataagtgaagatgtttatatgctcatacatatttaaaaaatacttgcattctgtgaaaactacaaatgtcaagtgacttacagacaacaggaaatcatattgaatttgtgattaacattatagtaataactacatcgcacaaatacacagatgtatatttgttgccatgataaaagtttccttaaattatgtgatttgtaacatatcttagcacaagtcatattttccttggtgacccatgttacctctaaaatatccactggtaaatatatggacagaatgtttattttctgtttggactacaaaatctacatagacgcatgcaacctttaaagcaatgcaaccattaagtaaagcaaatgactaaatttctgtgttgtactttcagcagtgccatgtaaacatgaggcctgagggcacgctttagcagtttgctcttgcccttcttcaggtctgcccctccacatgggtaagggaactgcaaggccaaggctctgggagcttggaactctggaattactaagtgggaagctatggatgaagcttgcctatgaggaccaaagtgtacacacatatgtacaaaaggcaccaagcatcttgtaatgcaaaactgatcttggcaaaagaactaagaagccataggcctacatctcggtatacctgtgaagatctaagttttctaagaatcttcaattctgacatggtcttccagttcattccaaatgcatattcacattttgtatcaaaatatgaggatagctcatattttgtaatcattttcttaccttgatttataacttttaaatatttagatatatgatatttaattactatttttagttataccttcatcctaacacagttaggaccaggttttatctttaataaagaccccaatcttcctaagcatgactcacttttccacttcactgcagaatggtttgattacaggctctaaaaaaataaacagaactaattgcctatacataatacatcataagtgccacaatatgcaagcaaaagaggaaacatgctgcacacatatattatcagataaagtgcaacaaagaacataaatgtattattcatgacatgaagtgaaatgactaatgtctttaaaactacattgctccctacccatggacataaaatgaattgttttaaatgtgtacatgatgacattacaagcgttactaaataaatttaaacacttcaacgggagctatgaaaaaaaaaaaacggtcaactataaaattacccaaattacattttctcaatttttaacaaaattataatcatgtttttgtcttgcttattaaaaatttcataaagtcaaaagatatgcagaaaataaagaatacatgtgtataactccagaaaatacatggaaagagaaggagtttatcattaaagtctttgccacaatacacttctcttcataatgcttgaaagaaatcttcatagcagagtgaatcaaatggaatatggtagactggtaacagaggcagaatctatctgcattagtgcatggaatgcatcaaggacctgactttttaacttattaaacatatctgtaccagattttaggacaataagaaactcgctttaagtcaaaggattgagaaatctcatattgatgggaattacacattctttttagctagtatcccaagtgttatacccaaaatggctcactaaagtaacatgaaaatgctttaaaaatagaatacttgatgattcataaaaataattaaggactgtgttggaccaaaattttatcatgatgaagaataattttgctaccaacagaaaaataatgcagcatattttgcaaattcttatgcatattttgctcttttgaaagtctatataaacatcgacttacattctttaatttttattataatcacataactacaataaacagaagctcagatttgcttctgactgtcactgacagaatcaacatatattgtctgaaatttccaaagtcagaggcagtaacattaattaatgaaaattacaatggttttgctttgaaattgtgaacttttactttttttctttttaattattatggatacataatagttatatgcatttatgaggtactttgatacaagcatacgaggtgcaatgattaagtggggataattgagatatccatcacctcaaacatttatcatttctctgtgctaggaacatttcatatccactcctctagttatttttaaaacatacaataaattgttgttatagttgccctgttgtgctacagaacactagctcttattctatctaactgtatttttgtacccattgaccatcctctctctatccccctcctcaccaccctccccagactccagtaactatcattctactctctatctccatgaatttaatttttttagttcccacatatgcatgagaacatgcaatgcttctccttatctgcctggctaattttacttaatataatgtcttccagttctatttatgtagttgaagatgacaagatctcattctttattatgggtgaataatattccactgtgtatatgcaccacattttttttaatccagtcatctatcaaaggacacttggaatgatttcacatcttgactattgtgaatagtgctacaataaacatgggagtgcagatatctcttcaatatattgattttatttcttttggatataactcagcagtgggattgctggattttatggtagttccatttttagttttttgaggaaactccatactgttctccatagtggctgtactaatttaccttcccatcaatagagtacgagggttccactttctccaacatcctcactggcatccattattgcctgtctttttttataaaagccattttaactggggagaagtatctcatatagttttgacttgcatttctctgatggttagagatgttgaatattttttcatgtaactgttggctatttgtatgtcttcttttgagagatatctgttcagatattttgtccatttttaattggattaatttgcttttttttctgttgtgatgttgaatcttgtctttttcttgtacttttctaaaacgcttggtaatgtaagaacagaatatcaacaatgtagaattttactagtatgttcatacaaatgcacttcagaaacaaaaaaagagccaaaagcattactacaaaataaaagaaaatcattgtcaatattcagttatgattttgcaaaatctgtatccatagcaaaaactgttctttggttaatttgaactattccctctgatatattcaattttctgtattaaactaaacaagaaatatgatcctaaactaacagggaatgagtataggaaggaagaaataaaataatatcccactgtaatcagagtagaagaatgtattagttacatggaaaggcatttgtgcagtattcttctcaggttcctttacatttatccaatgattgaaaagacagcatctactgtagtaaaatgacgcctccaatttcacagaaatacaagggaacaggaaaaagttttaagttgcagtaagattattttagcttaaagtacaaagaaattgttgaaaaaataatactctacacagaaagtttttggaaggaaacacattataactggtctgttgtacatatatttcttgctagcaaaacaaggtctcttttctaacccactatataatttgctctgatgtaagttgaaccttatgtagttcatcaatgttagaaacataaactagggcactgagattgtataaaactaagatgtacttctttgctaacacagacattattccataatcatttacaacaatgtatcatttatctttaattctagattttccttttgaaattttgaaatatatgactctagctgccttctgcatgaatatagaattttttaagagtcagtgtactttttaaagaataaattgactccttttcacacataagtcaaaaatggcagaaaatattttgctttgatttaaaaaaaatgacaccagctgaaacccaaaaatgtcaagtagatactcattccatttttaatggggtttcctttcaaaaaataatttcaatattgtttaggtattcttaacgcccccaagacacaaggaagagtagaagaaagacgagtgccatgaagtgagaagaatccaaaattaatgatatataataaaaatcaaaaaagcaaagaatagtcccattttattaatcagtttgattcctgaatatctactgtgtcgtcacaactggtctagctatatattatctaggaatgtataaagaaaccaagtaaatacacatgcagcagaaaacaattgtttactacacagtttagtagtggctttgtaagcaataggagtttcaagtatcaagaaatctatgtttatagggaatgttcagcaattattttcaggatggagaggacaaaaggaaatagacaatgaaagcaccaggaagtggaaggagactggaactcaaattcattgaaaatgtccaacaaaacaagcactgtcctttgtgtttttgttgtatgacagaatttccctcgattatggttattcatgtgggagggagtcatgatatattcaaaagaagacaaacaatgtcacccccttgaagtggctctttacaagacacagtgaacttaggtatcaaagagaaaataagagaatatttaaactaattacttgtaaaatgagtgaaggaggaagagctgaataaaacaatatgtagacagtaataaaattcatattgaaggtgtcttctggaaaagataatgcattcaggatcaatgagtatattttccaattccacaactcagaaaccagttgtgatgattcaaaagaaatgagaataacactaaaaacaaagaagggtgccaaacgccaacacaggaatacctgcaagatataatgcagactgaaaaaaaatatggattaatacacaactcctgttttacaagaaatcaaaatagttctgcaagaagtacaaagaaaatttcagcaactggttttaatttgaaacagtaaaggctagaggaatcgtgttgtcacgggaaagacaaaagatatgtcactttaagttttactcctcacaacactctaaggccatgaagtagtacctatgatgaaagcatttggctacaaccccagagagatgcaggatgtagcattcccacactgagcaagctaaaatccagacaaaaggattatatacagccaaactttcttggattaaaagcaggctggagagaaaacaaaataaggaaaatcagcctgaattcagtagtttcaaaagataataagaattaactttacaggaaataattcaccataaatgcagatatcagtatacttcctcagcctagttaataattaaagtcataacatttaactgtaaatcttgcctttcaattgcattttgaagggctaattatgagacctttatagacaaagaggagaaccaaggagaattcacgtttagtgtttttgagcagatggaatacctggttagagctgccccaatacaaagtcagtcttataaaaactcatgaagaaactctgcaacataaacatgaaactaaacataatatgcaaagtacaggtacaaaagtatgcttttgaagatgtactaaaggcagcaaaagaaaatcattttaaaaactgctttcctctctcaagaaaattaaataaaatagattcaaacgtgataagcaaatatgcttacatgaaaaggaagattatggggttaagctaaaatattttgtttaaatctctgaagagcttaaaatggcattagaggacatataagcttagaagctattgaaaaataaaagtagaatcaaaagtgtcaaaaaatcaaatcactgctttggataagaggctttaaaaatcactcagaatatgatgtaaagaaaagtaagagacattgagaatagacagcagaaatccacatttaggaataggatttcctggcaaatcctatttgaaaacagaacagatggaataaaaataatatccaaagtatattaaaagagtatttccctagtcaaatataaactgcattcacctcaaaataaaaatcaaacattaacttgaggcaagcaaaaattgaaacacagcatgctaaaagttatagggtacggcaaaagcagttcaaagaggggattttatattggcaaatacctacatcagagaaaaaataaatatctcaaataaacaacccaactttacacctcaaggaactggaaaaagaacaaactgaccccaaagttattataaggaaggagataataaagatcagagcagaaataagttaaatagagtcaagaaaaacaatggaaaagatcaactgaaataagagttgattttttgaaaagataaacaaaattgacaagactttacctagactaagaaaaaaagagaagattcaaataaataaaatctaggtgaagttatttaatgagaattgtcatctcaattgaatctgggtttattcaatttttgaggacaaagaaagaacgcttcaagcatccaaagagaagagacatttcacccacaaagaaaaaaggatttgatcacatcattttttctacttgactttattaaatgctagataatctctaccaatgtttgcaaatattaaaaggaaatggttctgactcatgaaatctgtagtctactaaatcacgattctggaaaattagcaagggatagaaattttttattgaaaaaatgatgtaggaactacatcatttatgtgacatttcaaggggaaagaaactgtttgaagatatacaccagtgaacgaacacataaatcaaaatctacagcccacaaatgattaatttgttagtgagcattaaatatatattcatttatttttaaaacacacacacacgcacacacacatatatatattatgtatacagagagagagagggagagagacagagagacagagaaagagagagagcatgcacgaaagagagaggcaagtatagtaatggtggaaaatccagttacaaaatataaattaataagagagattaaagaaattgaaagttttccaagtctccatcttatagagaagaagtcagttatcatagttgatatttttaataatacagaatcctgaaagttttttaaagtgttagaataaatctctagcaatttgaaggccttccaaattaaaaaagaaaaaaaaaaatcagagaaactcaggccataaaagaaaacaaaacaaagagataagaagtattaaacaaagttgcaatatcagtaagaggcaaattcagatttatcatacaaacttcaaaggaagaaagaatgatacttctatggataaaaggacaatgttcaaaggctattaaattgtcatcacttttctgcatcaaataaagcaaaaaaaaacaaagcaaaaaggattggaaatgaaagttgacattaatggaaatgagataatgcagtaaaagcttgtttaactgactttctagattaattgacatcgtctagtcctctgtcaaatataaaacatatccatagccgtttaaacactaaccactgacaggttccttctactgtatgtgcatactcttctgttcacatcagttgagttgtatgcttaccaagagtcagttatgtttttccagaacatgcttacatttgttacacttgatatctatattaggcatgatatcgtatataaaatattatgtattcaatgaaataaatgtgtaaaatgtttgtacttaattgaaactaaatgaaacactttgtgaggctttaatgtggttcccttaaaatgttctgtcaagttaggtgtaagctaaaaaacataaattattgagagatgaactatcaactgcaaaaacctagacatattattgtacactcagatcactttcaaaaatgtttctaaattctcactccacttaaaaatccacaatcaaaaataacagaccttacataatgggtatgatttaagccagaaaaataatagaactccagtttagggcccatattcctagaaaggccgtgtatcacagaattaccaaacaaatatgtaatctgtatgttttcagccaaaataaaaggttttcaataagtacagatattcttctttatctactaccttagcagacattttttgattaattgatttactccagtcctgatcattttagatggagtgcttctattgttgtgaaaattttaacactcctctctcagtatttgacattaaatagtttaaataaagtgaggttatggaggtgactaataataataaataatatagtatctaaatttggttttatagatttatgcctagacctattccctgcaaaaaaaaaaatactcctttttaaacttcccttgaccatttataaaaactgaccacatattagaccatttgctataaaacgtacatttttacagtagtgatattagagtttacattacttggctatggtgaaaatatcctgaagccagagaatatcttctgtgtttcaggacacaagggattcagtataactaaagcagaatggccttataggccagttataaggactttaactcaaactttgaagacttaaagtaaaattatctatattttatggttttctttttaaaattttcatagagtaaaatgtattttgtatggattttactaaatgcacagaatcatgtatctaccacctcagtatcatataaaatagttttaacagtctgacaacttcaacaaaaataggatgaaagaatcaaggacatgaatagaggaaccagttaggaggcaatggcgaaaatcagaaataacgtatggcttgaaccaaaatggtggcagcagaggtggtttaaagtttttagattcaataggtaatttttaagggtaaagcctgcttgatatcctgccagaatggatgttaattaaaagcgaaagaggattcaaggatgaatctaagttcattttaaaaagcaaataaaaggacgattttgagatggggatgatagaagggtgagttcaagttgaaatattaattttgaattgtctataagatgtctaaataatgaaagaatcagtatttgaatatatgactatgaagcaaagaaaaaggtcttgacccaatatataaatttgagagttgtcagtatatagatggcatttaaagtcatgaaataggataatatcaacaacgaactatgtgtagacaggaaggaggtccaatgccttagcttaggatgttagagaggttggagagattaagaagaaccagcaaaggagactcaaaagaagcagtcattgtaaacaaagtgagtaataatttgtgagccaaagcaagaaaatgttccaaggataaaggaataatcaactgtttcaaattctgtagataggtcagttaagaaaaggactaagaaatgccattggatttcgcaacttggaggccattggtgacccccaaggacacccttaaaaaagttctgtgtatacagtctgattgaagtaggctcaatccaaaagagaaaagaagaattggagccaatgcaaacagccaaatcttttgaaaagctttattataaaagaaaagagagaaataatggtggtgatagtaggaagaaaaagtagaagcagttgggtttgttttgataagataataaaaaatcactacatgctcattcacaagtttaatggaaaggaagaattgataatacaagaaagagaaagaactgctagagtgaatttcttaagaggatgagagagaatgagagagaatgtgtatgagtatgggggttttctttgctgggaatttagacagttcatttataaaaaaggagtctgggcataacacatgagcatggatacaggtaggtagagagaaaagaatggatagactcaggcaaatcctctgattgttttcattttatcatcaacagcagagagtgagaatgagggaggagatgacagaagttttatacgaaacaaaagaatctgaaaggttatgtgaaaaatgaatatatgagggaaatataatataatcgttagtcatcattagggcacacttgagtttagatgtcataaatttaaagtgagataatgacagtgagggtattgataagattttctccagccatgttcaactttgcaggcacagtcacaaggtaggcagacagatggatttaactgagattgtgatttctccaggaagtataatgaaataagagagacacaatgaagttgtggatttatggcaaaggaatgattaggatgatgaaacatggaattatcactgaataagaaagggtgtaaagacatgtgctgagttagggacaaggagaaggtggtagacccattaatttcaggtctctatgatgggtaaaaggattattggaattagagtactggggagagtcgactaaaataacagaaggtgatagagaatgagaggctttgaaatcaaaattatagaatggatattgttaacaataatggcaaaatctaggctataaacaggagtgagttgtagaaataggactaatagcagcggagagtataaggtcaagaggatgagagaccaaaatatcagatagatgatttcatagatcttgactgcaccaggaattatgacaggcagtgctggtgttggaggaagaaacaacaatacaagagtttaatttttcaggaaatgaagagaaatgaaatacagactgtacacaactacaaaaagaaggaatagtgggtggtagagtatactaacaggagattcaaaattggaaattctcttaggggagaaagaaaattatagtcatcagtgaggagctaagaaaactcctaccccacctccattctcggtagctcagaagggctttttctgagcttggccttggcagtcgctgaggaaaccagtcactctaaggaagcagtttcagaaaaaagcaaagccattgcagaattaagcagagaaagggcctgagctagctcttcagcttggctatcatggcatggaaggaatccagaaactctcacatgccctcaggagggtcatgcaaggtaattgatgggatgattagcagggggccaacacctgtaactgtgggcagccgaccatgcaggctggagatcaaaaggaaatcacagccagacttcagggacagctgctgaattttgaagagctgaaatagggtcaagacagcagaaagcatcacagtttccatccaagccaagagaggagagtatcacatattcttcagtctcaaatttcagcagaggtggccaacaaagcaaaagctgcgacagactagtaagggacatcattgctgcagaattcagtaccaatacagagagcagtacaaggacacacagaaagcagagaccccttctctgaaatgaagagagacaatgaacacccttgcatactcactctaccttgggaagaaatatgagaaggaggtagtatttgaaaatctgaacatattcccaaagggaactgttttaacacagtcagtagcttgtgatgaaggttagatcatttatcacaaatgaacaagctgtttcttcacagatctgaatgcaaagacccttgtaacacatgcattgagtaaataaaaataaaagtaaaataaagaactatctcatagatagttatagattcttttatagatagacaggctatcttcaactaagctctaaaatcagcctcaaatgttgaatcaaaaactgaattatgatattgtggtctgtttggaagaagatttaggtcaggagtatgaaacagatgaaaccacactgcagtaatgaaggtcaaacatgaaatgattacagtgtatctaagaagaattaggagatcaaatgctggaacattacaatgctgcaattctaggtcactacttctgggaattggattctatcttagccaagtgtccaggttctcacaggtccagtggcgaaaaatgtgctggggacagggatggagatagaacaagtacatcatcttctatgctcctgcatccaacaaccccagttcccctgacatagtagtgcttactctacaggttgacagaacaaataggtaatcctttttaatctattggtcggcttcagattataagcttttaaggtagcaaagaaagctatatttacatgtgaaaagaacagttcataaagcctggatttaaaaataaaaagcaaaacaaacaaacaaaaaaaatcacctcaaatcttgtgagatgtctgtagaataaaatcacaaattgataagaacaatctcaattaaacctggctgatattagcaaatattcttatccagtttcccaattcttgttaagacacttaataatcctaacaataactaatgtctatgagtgcttaacattttccaggcactaggctgtaatacttacacatacatattatctccttttattcttacaacaaccctatgagggagctgttggttttatccctattttacagagaaactaatgtttagagaggttaagtaatttgtagaaggacaaataccaaataagtagtgaaacagcaatttaagcccaataatgttcatttcagggcccatatgttttacaagtgaagagtacctcccatatgattagcatttatagaagacttataaagtcttactattaaagacttaaagtttatagttgttttgctcatctcactttgtgtcccttaaaacatccctgtgaaacagggactggtattatcctcatttttcaggagagaaaattaaggttaagagaggtactgagcccaaggttatctccagctatagagaaatgaagcaggaagtgtggagagagaagttaaaacagggaacactcactcaggtttaatgtggatttttttgtataattttacagaacacaaaataacatgtgaatccagtaacaaaaatacaccttccaaatctggccaaattattgtctaatctaatgactagggcactgatcctttctcttcctaattagcaagtaaatatctggagagatgctgtacttgcctaacttattggggtggtgttactaatcttctacaaatgcctcttcttccccagatgccattgccaaacttgactagtcacattgttgaaagaatatacccaaatgcccagaaaaaagcgtctacttcttcagttaccaagtgactcagaggcagtttaaaagaaagggaaacaagaagtatcttaggtagggaccacatattcattgctcatgagtgccccagctatagctgccaccccagtagcctgttttgttcagcatttgtccaggaaaaaagcctcatgatttgtaggatatatgatataatcatcctaaccatagctgagattgtcttatctatgattaggtccccttgtttagaaaacttgtcagccacatccttatcagcttgtgacccagacagccttgctgcagaggttcaggccaggatgtgacagaaggcacgggaggcgaaaggctgtacagaagcagcagcattgaaggaccaagttctcattactgaggcacttctgcacaacccacaacttccaaatctatttctccctatgttctagattttttgaatgggttcaaaagggaaaacagaactgcataggtgaacattcattttattggaaaaattttagaatccgctctgcctaaaatgtgaggaatgtgtgtatttaaattttaatactggaagattgatactgtcacaactaagaaacatacaatggctatggtaatacagtattaaaatgctctattttcctctttttaatactacttaagtaataataaacaatacatgtagaatgaatgttcaaccttttaaaactccttttattttcatcattttatctgttctctatagtatcttgtaggtaatagggatgataagatcttattttcctgatatattttcaaaattatatttttgccttattctcaataaaaggatacaaagctgtagttagacaggggaataaattttttgaggccatcatacaacatggtaactacagttaatagtaatgtattgtatatttcaaaatttctatgagtaaattttaaatgttttcaccacaaaaaaagataaatatttgaggtgatatgtatgttaatgagctttacttgattattccatatttttaaatatatcacaacatcactttgtactccaaaaatatatacaattatatatttttataattgtcaatttacaccaaaataagaaaacatatttcagaaatcagaaatatgccctttaaaaaaattatgacatgtttgagtaagatgataatactgatgtcatgttttttggattttcccaatcctccttaaaaagctaacagaaatgagaagcaactgctaatcagtggagggtttctttttgcaatcatgtgattgtgcaaggttgcacaatctgtgtatatactaaaaagcattgaattgtgaccattaaatggaagaattgtataatatatgaattgtgttcaataaagttgttacttttggcaggaattaaacaacagacatatttctcacagttatggcggctgagaagtccaagatcaagatgccagtaggtttggttcctgctgggggctctcttcttgatttgcaaatggccaccttctcactgtgttctcatgtggtaaagaaagagagtaagcttggccaggtgctgtggctcaaacctgtaatcccagcacttggggaggccaaggtgggtggatcaggaggtcaggaaattgagatcatcctagccaacatggtgaaaccctgtctctactaaaaatacaaaaattagctgggcttggtggcacatgcctgtaatcccagctactcgggaggctgaggcaggagaatggcttgaaccagggagtcggaggttgcagtgagctaagattacgccactgcactccagcctgctgacagtgaggctccgtcaaagagagaaagagagaaagagggaaagagggaaagagagaaaagaaggaaggaaggaaggaaggaaggaaggaaggaaggaaggaaggaaggaaggaaggaaggatggttaaaaaagctcttatttttaaaaagctaacagagtaactaggatatcatgatgggttaaaggaggccacagacattcctgtcattaagagggaaagtctgttttccttgcccttgtgtctgggctgtcttatggctgctttgaataatggagtatgtgaaagtgatgctatgccagttccaggcctagtctctcttaagagagctggctgactccatcttggtctcttggagacttcactgctatgttagaatgttatcttgaagtcactccagtctaaggaaacttaagttagccatgtggagagagaaagagaaaaaaaggatggttggccagtccccaggtgttacaactctcaactattcaagccatttcacccaggttgaggttgcaacattgtaaaacagagacaagacaccggtgccatgccatgcctgcatctatgacccaaaaacattctgagatataataattgtccttctaaggcaataagctcttggtatgtttgttatgcagcaacaaacagaatagattgcaaaacaaggtgatgaagtatcctgtacatcccaggaaaagagcaagagagtttgaaacactgagcacagcaagattctaggaagaatagcagctgtgcaggaataaataaagaggatacaaacggaattctgacaagttcttaagggcaagaaacccaggcatttccaaaaagcattcattcccaaaggaggaggtttccactcagggtggagtgtttaaatgaccaaacttagcacagtcataacttcagggagacttcacaggttcctgcttatagattagtacaaggggattgcagaaagttctgagggtgttgggacagactgggccctctgggatctcaagaataaccaaagccctacaatgaagagaaattgctcaaagcagaacaccacttgttcaggataaaaagctcccgggtgtcagagggacagaagatttagattccagtgaaaaaggagagtagaagaggtggatctcagaaaatattagagattcatctatgctgataaatttctttcttttgtttttaagcatgtcacagtgaaacctaagaggaaacctggaattatgaagctggaaaagcaatcttgactttcatttctgctaagcaaacacttgcttctaaaatacaggaaactgcttttcacttaaaatgaacaattaaaaggattgcagcaaaattcaactaaaaaaattgcaagttatcaaggagaaaaaaaaacctaaatcatacactaatagaaaataattcacataagaaaaatatggctacaaaacagagttggaatccaatataaccaaaaaacactacaaaattatagaagctattaaataaaagacaaatccaaattttaaaacattgtaaatgttgatggacttagggatcattaagcaacagatgtagatgaaagtaaatgaggattaaactagacaaaccaataaatagaaattaatatcacagaatgtaccactgtggaagcagagagaaaagaaaaatgaaaaaaagaaattaataattttttaagttagataaaatagtaaattaacaaaaggcaaaaacaatgcaacatagatacataaagaattcctaaaataagtggaataagtggaacaggaaaaatactggaaatatataattcaaggaaacatttcttaaataaaagaattaaattgcataattaaagcacatacaataggaaactaataaaaattttgtttttctttttcttgagatggggtcttactctgttgcccaggctagagtgcagtggagtgatgatggctcactgtagcctttatcttccaggctcaagtaatcctcccacttcagcttcccaagtagctgagaccacaggcatgcacagcataccagactaattttttattattatttgtagagacaaactctcactatgttgcccaggctggtctcaaaattctgggctcaagcaatcctcccacctcgccctcccaaagtgctgggattataggcatgagccaccatgcccagccaaatataaattttagaactgaaagatacaatagctcaattttttaaactcaataaattggctcaacagcagaatggaggggacagagaaaagaatcaatgaaccagaagataaaacaatagaaattacccaacctgaataacaaagaaaaaattcttttaaaaagtgacattcagggagctgtggagctataataaaacattcactcaagaaatcagagtctcagaagaataggagaaagaggatgaggataaaaaattactcaaggaaataatagctgaacactttctgaatgttgcaaaagacataaacctataattaaagtagccaagtgatgaaaaacagaagattttaaagaaatctgcatcagaagacagagtaaatcttctaaaaatgaaaggcaaattttaaaaatcttcaaagcggcaaaagagaaatgtattccttttctataggagaaaaatatttaaatgacagtggattttttatcagaaatcatggaagccagaacagagtagcacatttttcaaatacttaaagaaatgaatttccaacccagaatcctatacctaatgaaaatagctttcaggggtgaaaaagaaatcaaaacatcctcagatgaaaaattattactagaataatttatcaccagcatacctaccttacaagaattactaaagaaagttgaatttataattttaaaattcccccaaaaaggaatattcaggcccacatgatttccttctgtaattctaacaaatgtttaaaaaattaattctacacaatctcttccagaaaatggaggacgaaggtacgcttttcaattaactttatgaagttagtactaccaaaatgcaaaccagcaaaggattttaaacaatggattgacacactgatttatacagtaaaaaaatgataacttgggtgaaaataatttagcagatataataatttagcaatataaaaggcagataattcaattaagaaggaagtatactggtccaagaaacagactgtgaacgtcagagttatggctctattgatatatatggatagaagagaacagatcaaaagagactcaagagaaagaagccatggaatttggagaattgtcattaatgggaattgggaatacaggaggagaaatcgttttgtaatgaaaatagtaagttcacgtttgacactctgtggacactctaatggtcatgaacttacaaccctgagtctcaggagacagatacgtattctggagacttcgatatattagcagtatagccatagaggcagatggaattcactcaataatcctatgcagagggccgggtgtggtggttcacacctgcaatcccagcactttgggaggctgaggcaggaggactgctttaggccaggagctcgtaaccagcctgggcaacatagggagaccccatctctacaaaaaaaagaaaattagccaggcatggtggctcactctgtagtcctagttactctgaaggctgaggtaggaggatcactagagctgaagagttcaagactgcagtaagctgattgtgccattatactgcagcctgggcaacagagcaagcccctgtttctaaatttaaaaaaaaaaattaaaataatttttaaattaaaaacaacaagaatcctatgcagagtaaaaacaaatttgtcttttaaaaatcagtgtttttagaaccttatttattcaagtaccactttcagaacttttgacatctagcacaccatatcacccacactattgtatatttaataattttcttggactctcatatcttctacttaaatttattttaaaacaaaaccttttatcagcactgtaaaataaaatcaatgttacctctcataataaatgggaaatgaccataaaaataaatgtggttctaattgtttatattttaatccaatattattacctgtgatactccagtgcctgcttcagctcctggcagctgttctctttgttaaaataaagggttttttaagaaagacttaccacaacctaatataataagacaaactttccacaatctaaaataataaaaattaaaaataatttaaaaggagaacaattgaatttttactatatgattggatatgatttaacccactgtgatattggatactggatattatttcatgccctgtgagccacctaaaattatttcctgtgctacctttggaatgtgatctccaattggggaaaatattgctttgaaggatagacagaggaagagggtcagagatgtactcagagtgtcagaaagggtcagagttccaaggtggactagagtaaaggaggagaaatgaatcagtagacatagaatcaacagggtcaagttatatagaatagtgtcaaatagcatagaaagattagctctggggatttatagaggcacattcaggatggctctcaagagtccagataatgattaaacaaacaagtaaacacctacttgctcctgagctatagcttaaggaactgagtgaagctaaaagatcttacacttgctccccatcaggtgaccaatttgaacctacacctaacattagctctcctccagcatctcttcctctcctctctgtcccctctcccaagcccaccatcctcttgctgtacctgatgcgttagtaaagaagtatgccaagagcatgtagtgtaggacccctcacctgtgaggaccatttgcaactgaccacattctcccactcagcagtgtctcccgcaataaaagctttgtgcccagactaatcacctttcagaagaagtcaaaagcgaggcagtcagcataagatgtaggagtgaaatgaaaaatcatataggagataataaaaatatacaggagctttaacttgctacaactccacactgctctacttactttcaaataaatgtgagccttaaatcattatgcagactctgtgatgagtatgcactgcataaaaaatgttagcttcctttactcttccaaaatgtgattgatcatcttccactccatccgctctgcacacttgactcgttttaatatgtggtcaaaaataatttttatttgcaaagtgtggtcaacaagtaacactttggggaaaaaaatgtttgtttagcaaatctgaaggtcttcatttgcatttttctcttttgttcactgatctctgacaaaatgatatttttcaacctttcctttttgccaaacccatgaaaccttacgtgtcacctacattaaatatacacaatttccttttaaatgtattcacacaactagtttagaaacagacttgtgtataatctgagaagttataacttcttatactcaatagttttcattctaaatagttttagtatttttaagcctcattcccactgaaaaacatcctcaagttaatgacataaaatagatgataaacagatgtgaatagagcaactcaaattctgtaaaatattatatctcccaaatgtccaaatttcaatttaaaacttaaatacaaatttagacaactattttcataaagacttgaacactgtgcataatcaacagagaaaaataatttttgtttcaccaaactacaataaaggaccagagtagtgtgaacatttgcattgaaatgaaaatgcaatgttcattccaatatagagcagaacctctaaaatgttgtacagcttatatattctatggtatttttgtaatctaaactaagacaaacaagcacaaacttagtataattataagtagtcaaagaagagttaaaagaaactcagaaccaccattctcctgaatagctccaagagagaaagcgggcaagagggagaggcaaaaagaaggaaggaagggaagaagggaggctgaggagaaagagggagagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggccaacagggagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggacaacagggagggaaggagggaggaagaggtggggacaacagggagggaaggagacttcaatctgtgactttgtcatttggctgtgtgtgtgtgttccttcctcaccactgcctcttgactacaagtgatttcttaattatcctataaaacaagggtcagcaaactatggcccacaggccaaattcagcctgctgtctgttttggtataataacattttactgaaatataaccccactcatatgtttacacaatagagttaagtaactgcaacaaaaagacacatagcctgcaaagcctaaaatatctggccgtttgcaaaagaactttaacaacctctgctctaaaacattacccaaatggcatttcatcccctgtgaaattttcctgactctcattaatattatagtcctgcatttcctgatagaagatggcaaatgttatttgcattgcacgattacagtccattataggttttggggtgaagggattatatgtatcttctccctacactgtgagctgctcaggagcagaggctctgccattttaacgtcacctacctctggcccaatacctgccataaatagaaagctcaattcatgtttctgcatgaatagcataaccttttacatgatggaaaaacatcatagtacctccagaattaaaagaaacatattaccatgttatgattagtcattctcggggtgtgactgagaaataggctcagaattagtagatgacatgatgttcgtggctgttttgttttttgtttttgtttccaaagtggcttatttgatttggattccagaagcaaattctgagaaggagatgtgtgtgtgtgggaaatgtaccgggtactgttctagggaaataccatctgtgatggagtaaaggtggtaggaatgggcagaagttgaattgcaatgcagttgccaccaaggcctcagccaatcccatacagaacgttggaactaggatagtcctgcagagttttccaggattgaggcaaaaaactaggcctctgcaccactgcttagcataatcaatggttatgggaacatctggaagagatagcatagaagagtggtctgcatagaagcagttcccttctgccaaggaagctgaaagcaagtccttctggaggaagatccagctgtgagccatcagcaggcaaaaacttagtgaatgtgtgtgtgcccatgttggctgtgaagaaaaatctgggagggggtctatagcagccaacatgagcaggcggagacactccctcagaagctcatacctcagaagttatgagaataatatagaaccctgagcccccagccgtgatctttctaaaataggctaaatattcacaaaagcaccaacagggttcaagcccaagtaatcagttctccagcctctgtggctgtcaatctgccatgatctgtcccttcagtcttaataaaattactgcagacaggggaaattgccctcctatggaactatgggaaatcacaatcggtaatagtcttttaggccaaactgtgagatttcttataacttgcacagcctaaagttgatcggtccacttagaattaggaagcctagcaggaatgattaaaaagcatccattcagaaaacattcccagactcatcaccatctggtcagatctgattattacacagtcaaggaaactcccaccggagacaccacagggagaattcttctgaggctgccacttagcatttgttaacggcagcagggaataagtgtgatgtacgacaggcactgtatgccaggtacctgcacatcatgctgcactccactgactcgtctttcagcaagtccagagataaggagatgcatggtgatattttaaagtgctttaatgattttttaaaaagagtggaagatacatacttttgaaaacaagaaagaaaacaaaacaaaaaaaaaatatgctgaatgcagagcagcatgcccgtctcattccatactggtcagcagcctccgcgctccaactaggaacacgaatgccatttttcaaacaccccagatgcttccctgcatgcaagactttctaaccaatttttcaaactaagtacaaccctgaaatgtgactgctttctcaatctgctttgaaagagtttcagcagttttgatttctgccagtaggtttaggatccccacagaacacagctacaaataaaagctaaagataaatagaaaggagaaagtaggttttgccagggtgctaactcttctgaacttcacataggagaggagacctgctgtgatgagactgttggttagaaaaaaagacatatcaacaagattcaccaaaaaatcccaactgcaactcagaaaagcttccaaaagttgacattctatactaataacaagtgaaaaacatcaattacatttacattattgaagctgagcataaagagaactggataaatcaaagagattcctcgggtttttccaaccttcagagattctacccaggacatttagtaaactacaagcaagaggacatgtcaaataggctaatctgacaattcttaggcattcatttgcagtcatgaatggtacacagataatcttcctattgaaagtttttcaataaaattcaagggccagaagttgggaaagaattggtcatttgttgttgtagctgtcttccataacttggctagtgattgaaaaacttctcaaatgtaactgcagcaacttcgctggagtacagcctggagtacagctgtgatcagcaaagctgactaggctcatggcatttgaatcaaatcctcttgatgtgtaatttgtctaaaatattttcttcattatgttgtgttaagaactcttactctgcagaccaagtctaccttgcatgtgacaaacatgatttaaaccagtggttctcaaacaggagtgaatttgtccccatgggacatttggcaatgtctggagacattgctggctgactcaactagagtgtggggagtgttaataacatctaatgcagggttgaccaatcttttggcttccctgggccacactgaaacaagaattgtcttgggccacacataaaatacactaacattaacaatagctgatgagctaaaaaaataaaaaaataaaaaaaactcataatattttaagaaagtttacaaatttgtgttgagccacattcaaagccttcctgagccacatgcagcctgtgggccacaggttggacaagcttgagctagtgggtagaggtcaggaatgctattaatcattctacaatgcatagagcagcctctttccccccaaaaaattcaatagtgtcaagggtgagaaattctgacttagatcttgctcaggttgagactatagaagccctgtggaagaaaatgctgcaaagcagttcagttgtgcgcaatatgcacatgaagtatatgcagtatgcacaagaagggcaacagagctttgcttcaatggaaatctactgagcagatctattttaggatcttgtactgtccatcacagtttgcatcaatctaatcagtctataaagcagaagaataaaaaaattaagtgcctacattctgctttctctgattcctgcccaggattttgactcttcaaagacaggagcaattttacaacctcatcctcagtttagtgactagttaatgctgactgctttgccttgttacacaagaggtttacaaacagaaaagcacagatgacttttaaccattaaaaattgtgcctatatgtttagtgaagaggacactagctattttccaatccaagatttacatgattaataacacatgccattcctcaacccttccttatttggggaactccttcattatgaattcaaacctttttaacctgaacccaggcctctatttaactgttattggatagttctccataaattcataatgaccagattttaactcatctgtttgctaaaaaactgatatctttccaatgtattttcctcttccactattgtctgttgaccagatcaagcatttataccttctttctctaatcactcctatttagttaggctctatagattttttactttgagttatctcttctactctcccttccactttatttataatatcatactccacttctaggtctcccagagccttttttcaggtgttcctgctgactcgaggctttccttttccttcctacaccatcccaactacatcttttatataatagtcatcttcatcaaacctcacccattttaatccatttgtgttatatttatttaagacttaaggagatacagcaaggtagttggttgaataggttctcacagaaattcatatccacccagaacctcagaatgtgacttattttaaaatagagtcttttcagatgtaatttggttgtactagattagggctggccctaaatccaatgactgttatccttataagaatgtgcgtggacacccagagaaaaagggcagcctaaagatggggggcagatattagagttatgtgtctacaagccaaagaatgctaagaattgccagcaaacaccagaagctaggtgagtagcatggcatggttcttagagtctccaagaggagtaaaccttgccaatgtcaatgccttaattttggacttctggccttctaaattgtgagagggtaaatttccattgttttcaacattgagtttgtgttaattagttctggtagtcctaggaaactattacagcggtcataacaaaatgcttcagtcttccaactacaggtagcataattgtccaaagaccccaggtgctgctctaatacccacttggcgtttgctccaaggccacgtttcccataggctgctccctgccagtgactaagagcagcatacacacaaagcagaacaattcctgggaggcacagactactttgttggccagtttgactccaagactctttcaaagccttgttacactattcttagactgaatactgtctgaaatgctctcatcctgccttcttttcctctcttcttttggaataagtctgcctcctggtctgatgatcctctaaccttccccaactcccctcctaatttttcccgtaagtgtatccctaataaaatgcatacatattaaattgtaccttgctatctacctcctggaaaacctgaactgacccagaagagaatgacagactctggtttctatttgaaaaatagaaaatagattgctctgcctggtttgtggaaagtaaattagaatttggcaagattgaaagggaaagaccaaatagaaatataatgcagtagctaaaggagagaggcttgtggcttgcagtatactagtgatagcagtagatgcagtggtcagattccagatatacttcggcagtaagacttataaaacctggtgatgcatttatgtgagggtgtaggaaaaatcagtatcaagttgattccttaatttctagcaagagcaaatgcaaggatgttggtgacattcactgagatgtagaatgctggaagagtaaatccaaaactaaaaaattaaaattttagtttatatatgttaagatcaaaattatttgcagatatctaaacagagacgtcaaagagagaattgattcttaagaagctcaaaagagtggaccagacttctacatgaagttggcagatataagaatccagtgtttaaagcagagggagtaattcaaatcttttaggaaataatgtagagttagcaacaaaagggcagtcatgaggccttccaaaatgtaaaggtcaagaccagaaaaggaagtggacaatggagactgagacagaatgaaaagaggggtaggaggaaagtgtgaacatggtatccacaaagggaagggaagagtgcattttgaggatgagtggagggttcactggtcaaatgctgttgcaaatacaagaaagatcatttaaaattgtccattggcttcggagacagttaatcttcatgttggtggaatggtgatgatggacgcaagatgggaggggtctgagaagagaataggacttcagatcaagttgcctctgtcagtatgtaaaccgttatgccccaaacacacatcactgatagaaaagcttgcattcataacaaaaaaaatatagccaaggggatttccactttggtatttttgaatgtaaactttaagcactttcccaccaccacttatcaatgttttcttttcatatttataaccataataaaaaagataaacttttgtgtagccagaaggccaacagaaacaaacagcaataatagaagctaaaacaatgtgtttctggataaggagtcacaagagacaaaggcagagcagagatatcgactctctgtgttgtgtcatgtgccgcattttgagctctctgcattgaaggatatctgctacttgaaggcaggacaactgtttatttggaatttacctctttactgtttggtcaatagtctctattccaatatactcacaaagtattgttttaagcataaaatcatattaagattaaatatacaaattcttagattatcatcatcatctgatctctctgaacttctttttcattttactacattctttagtccttcctggcaaaacccaactcctccattttccttccaataccactgttataacctctttgacgtcattagagacaacattattcaaaatatttgggctactggtgatcattgcccataatctcagtctctactgtcacatcagtaaaagcctgatgactcttatttaagagaaaataaggaggttctagacatcagaaagactacctgatgactcttatttaagagaaaataaggaggttctagacatcagaaagactatcagtctattgtagcctaaaggaatactattcaagtttaaagtcaatggaagccttaaaaggttgatatggtattcaaagtgcaatcactcaatataatcaagtgtcttactctttacagataaaagaccagaaacaaaaatgtaatataaagtttactaggatattacttggcatttattgcaggtaatataaagatattttaagaaaaaatgcatattttgcatctatgtgagatttacaagcacatatctccaagtcaaaattaacactgaagtccacatggccagagactagtacacaagtacacatgaaatgagtttggtagtgatctcccagataaaaccacagcaaagaagcatcaaagcagcagcattgtgaactctacttcaattctttaatgtaccatctaagtttggatagtttggaggtccatacaaaggcattggttaccctggcccacatcaagagtgctggatatttttgcttgcagtaatgaagtatttacacacatattacatgttgcagaaacactccagctacctgaagaaagggctagcatactaaagaggagaaaaataaaacagaacaaattttgatatgaataactatgccttaatagcaataccaagggccatgtagctttctggacaaggtttaagatggcagtggtggccctctacacccggcagaagaataaatcttaaggatattcaaaaggcacatgtcctgttttcagtatatgtaataggggaggtttctcccctggacctccaggtgcagttaggctgccaacaagtcagaataatgagtaggctcaccccacacatgccctgctctctgtaccccaggcaggcatttgtcagagtataaattatctacagtggtctccaaaggctctggaaagttagtgtatatccttgaaaaaaggagagaaaccctagaactaatattatagaaaataggggctaagtaaaggtatattctaagtagaaaatgttgctctggttagaaaacacacacacaaatgcattcttgccaacaccaagtgaaacatcagatgctagttattcaattctatattccttcctagtcactttaaaatctaaggacatgaatagcaatgtttaaatgtcagcattgaatcttgacaacagcttaaggcctcattattttaacgtatcttcactgagtgataacagacaccaaagaaatacataattagataattactttgtattggctcaatctttttaaggactccaaagaatattaaaaactttgaaagatcaaggatgcagcaaatttaactcttcaatgaaatgcaaatttaaaatagcactgcagtaatgctgacattctgccttacggaggagggtagggaaggaaggaaaccaatcatctatattaaccaacaaatcagtgaccagaacattttccacagaaagtaacaaaatatctgatcatttgaagcttaaatgataaagttactccatttcctcgtgtaacaaaaagcttgaagtagtaattcagaagtggttcaatagtgcaactatgccaaaccactggactgtgagactgatttgctcagccttcttatagcctcaaggtgcctgtggccttccccattgagagttgaggtgtgagtagatgaagtacctaagggagcactaagacagggaaagtaccttgcatgatcacatccaaagaaggaagagaaaaaagagcggaagagtattttcccttcatacaattctctcttatcaagaagaaaagtaccttccagcagatttcccattacttctcatcggttaaaactaaatcatatgttcatattgagactaatcaatgcctaaggaaatgggattgccacattggattagatatatcagcccggcctccgaggacttggtaattgaggtctgaataaaatcggagcattgctagcaaagaaaaagggagaacattagtagacaacaagcagtgtcagccacaactctacattttatactagaggtcaaaatatttggctctattggatgttttaagtaaagtagtttctctttctttccaaagtaatgcagagtttcaactttataaatataagaaccagttccctggatgacctccctgctggtataataaagcactaggagataggtgcttgcatgctttccaaggaatttagaccccagtcacgtgagactccatggattacaatcatcactgaacttcccccaaagcaaataagtaattagtgcagtctccagaacatagagttattgtggaaaaatacagctaaatacagcaaatgctctattactggcttccacttctgtgcagtcttccagctctaagtacaagtcattgcaataatctgatcaaatggtatcaaaggtgaggctaactgcagcaaagaatttctgtgctggccagttaaatattgattattccccaaaatggaatggccactttagatcatatcacagaactaataaacattatctccttgaactcaaaagggacccagaaataagctcagcttgagacttaaccaatttattctttgttactttgattctctcttatttcaacttggatgctttgctagaattagtattatgagaatacagtgttatttccagtaggtccttcagttgtaaatctgaaattccaagtatagttctgatctctctatattgagctaattcattcagtgtcactgatggagggtgaagcatcttatgtgcctgagataagagataaatgaaagaattcttcacagtctattgggaacacagagaggtaaacagttacaaggtggtatgcaagaagaaacaatctggaaaaaagggagcatgtcacacatgatgtggtaaaacagtgctatgtactcagggtgagctttggaggcagggaggaggttgttcagatctatccagggccacttactagctgtgtgacagagcatacattgctctctctctaaaacacagaaaaatgtgttattactaccagagaggttttaagcattaaatgagatgaaaactgcaagtgcatggcaccctgcccccacacagaagaaaagctagataaatgtttttccgttccccttcttgttcctatcccttcctcagggagagaccaggtcagattattctggagagcagaaagctccaggatggggcacagtggaccagggctcaactgccagagatgagtgctgtaagcactgaataagtctttgagtaaattcaaactgaggtcagaaggaagagttgggaaataagcattgcctattttcttttttcacaattagttttataaagttttatttattttttaacatgtttattgtggtatcatttatatgcaaagaacagcacacatttaatatgtacaatttgatgagtttggacatatgtgaacactcatgaaaccatcaccataatcaaggtaatagacatatccatcaccttctaagtttccttgtatccgtttgcttttttgggtttttttttttttttttttttttttttggtttgggagagggggttgtttgtttttgctaaaaacacttaacatgagatctaccctcttaacaaattttgaagtgtacaataccgtattgttaactatgggcactatactgtgcagcagacctctagaacttatctagcataactgaaactttatacctatttaacaactccccatttacctcagcccctggcaacctaggggctagagtagtctttgcttctgtgagtttgactgacctcatacaagtggaattgtgcagtatttgtccttttgtgactagctcatttcacttagcataatgtctttaatgtccagctatgttgtcccaaatggcaggatttccttcttttttaaggtggagtaatattctattgtgtatataaaccacattttctttatacagatattttaagagctagtgtgaggaaccaaaggcccctgtgtttgctgattggtttcactcaaaagtaaaattttttgtatgccttcatcacaggaggtagttttagaacttgaagcaagcaacccaccaaagttaagctcctaccctccacagagaatagcagattgggatgctatcttctttgatgactacatttctaagggatggctcctaggtcctaaagacagtcctgtgttgtaaaaggagctaggagcttttaaaaatatgtacatctcaaaggggcagagtaagaatttggaagtataagttttctaaaataaactccctaagaaaggaaggggaggtacttctgcagttaggccatcaggattctgtcagggctggggttgacaggggggtcagagccctaaaaggataaggaaatctgtctaaaatttattaaggtggaggaaaatgttacactcatttttgtcaataacaaagggccaaaatttttaactttgattaagtctaagttatcaataattatcctatatggcttgtgctttctgtgtcttgtccaaaaaacaaaaataaaaacaaaaacaaaaaacttagtttatcctaaggtcacaaaacttgtcttctatctttcctctggggatataacagttttaactctgatatttaaatcattgagcactttgtaattaattttgttatgtggtataaaataagggttaaaatttttttctttccgtatgcctattctaatgtaggcatactatttatagaaaataaaaggtattctttcctcattgaattacctggccacttttatcattgatcaattgaacacctatgtttgaggaaatttcagatatctctattaagttccattcccaataggaatctatcttgattaatgtagctttatatatagtaaattatgaattcaggcaacataagtcatccaatatttttctttttaaaaattgttttggctatactaggtctctagcatttcaatataaatcaaagcatctgctttttttttcctgccaaaaagcctactggaattttgattgagattgcattgaatctatagatcaatgtggggagatttgatatcttaacaacattgagtctaccaatctaagaacctggtatatctctccatttatttaggtcttctttaatttcagcaagctttggcagatttctgtgtagaggacttgtacatctgttattgaatttatccttaattgctattacaatttttttatttttcaattattcatagttagtatatagaaatgcagttaagttttggataatgattgtagtgatttgaatagtggcccctaaaatctgtgtgtatccagaatctcagaatgtgaacttatttggaaatagtctttgcagatatgaatacttaagaatatcaagatgaaattatcttggatttagggttggccctaaatacaataaccagtgtccttataagaagaagagaggacatacagaggcacacacacacacacacacacacacacacacacacacagacaagcacacacacaaagtccatatgaagatggaggcagagcctggaattacgcctggagccaccagaagctgaaagaagcaataaaagattatttcctgaagttatctgggaaggttgttctacattttatccagttttctagttggttatgtggataagtctcatacagtatcttggtgtacattttgcaactagtttattttgacttgtatgtcagctatcaatttattacttcttagcttgaaatccatatttctttatcttgcattgtcagaatgaagtggatcttactttttttatttttatagactttgtggctacaaatgtagtttgtttctttgtttgttttttttttctttgagacggagtcttgctctgtcgcccaggctggagtgcagtggcacgatagctcactgcaagctccgcctcccgggtacatgccattctcctgcctctgcctcctgagtagctgggactacaggcgcccgccaccatgcccgcctgattttttttgtatttttagtagagatggggtttcaccgtgttaaccaggatggtctcgatctcctgacctcgtgatccgcccagctcggccccccaaagtgctgggattacaggcgtgagccaccatgcccggcctacaaatgtagttttgttacatggatatattgcagtggggaagtctgaggttttagtgtaactatcacctgaattgtgtatatagtatccattaatttctcatccagcacccccctcctaccctcccatcctctcactcttccaagtctccaaagtctattattctactctctatgaccacgtgtacaaatttttagctcccacttataagtgagaacatgcaatattgactttctgtttctgagttattttacttgagaatggcctccagttccatctatgttgctgtaagaggcatgacttcattcttctttatggctgaatagtattccaaggtatatacataccacattttcttcatccaatcatccgctgatggacacttaggttgattccctatcttagctatcgtgaatactgctgcaataaacacacaaagcagacatcttttttttgagacagagtttcactctttttgcccggactggagtgcaatggcaggatctcggctcactgcaacctccacctcctgggttcaagcgattatcctgcctcagcctctcaagtagctgcgattacaagcatgcaccaccaaccccagctaattttgtatttttagtagagatggggttttgccatgttggtcaggctcatctcaaactcctaacctcaggtgatccgcccacctcggcctcccaaagtgctgggattacaggcatgagccagcgtgcccagccagacatctttttgatataatgatgaactttcctttgggtagaaactcagaagtagaattgctggattaaatggtagttctattttcaatcttttgagaaatctccattttgtttttcatagaggttgggtcaacaaaattaagacagaaatcaaaaattttttgaaattagtgaaagtggagacacaatatacccagacttcttggatacagcaaaagcagtgctaagaggtaagttcatagcatcaaatgcccacattaaaaaaaaaaatagaaagctcaaaaatcagcaacccaacatgatacctcaaggaactataaaaacaagaacaaaccaaacccaaagctgacagaagaaaagaaataacaaagattgcagcagaacaaaatgaaattgagactaaaaaaaaaaatacagaagatctatgaaacaaaaagttggttcgttgaaaagataaacaaaatcaatagactgttagctagagtaaccaagaaaaggaaagagagaatccaaataaatacaatcagaatggagaaaggagactttacaattgaagtggaccttgtaaacatttctccttagttaagtggaacacattaggctttgtcaatagagggaactggagaaactggaaagggggttctttctctcctcagtcctagtgtgatttttttccccttcccctgatgtggctgctggtggcgtggagaaggcccagcagtgctcacctttcaacgtttctctgacacctcggatggcagcttcctgcagaccagcttcatcccctgatgccatagagaacttctccaccacccagcaatcctcagccacactgtatcctatggggtctcaatattagccttatgatgggaggggacatctaaattctttctttcttccttggctatgctccgtcatccatggagatagtacttactcccatattctttagagtcaatgcttatcctttttggcagttacccacttttgcaagttaatgattttttcattaaatattgcccactcaatggagtgacaactttaaagtactaaaggaaaataaactgtcaacagaattgtgtatgcaatgttatcttacaaatcatacaatatcacttacaaaatgaaggggaaagacttttcaaataaacaaaaacagaatgtatttttagcagacctgaatataagaaagattgaagaaatttcttcagggaaaagtaataatactagaaagaaacttcaatctacacaaggaaataaaagcaccaaaaatggcaatgaatttcatataaaactcaagctttaaatgttcttaaaggtctattgattgccaaaagcaaaaatgacagcaatgtcttgggaaataatagcataggtaaaattataataggtgataagtcacatattatcagtagcatgaaaggtggtggtgaaattgggaatacaatgtggaaacgtcttcacatcacacataacggggtatagtattatttgaaggtagaatgtaattaattttaataccatatagcaattcccacaacaagctctatggtaagagaaacaaaacttattttcatgccaaaacctgtaaaaaaatacattatatggctttattcatgataaatagaagtaatctgaccgcatctcacctgcagaatggagaaacaagggggcacatcattaccatgggacactagtaaacaataaggaagaacaaattgcttatatatgaaataaaaaggatgaatatcaaattgaatatgctaagcgaaagcaaccagtctcaaaagattaaatactgtgtgatgctatttacatcacattctaaaaaaggtgaaattacaaggacagaaagcaattcagtggtggccagggctgggggtaagaagagagattgactacaaaggggtttgtggaaactttttgaggtgatggaggtattctatatactggttatggtggtgattacatgcctggatgcatttatttatcaaaaatcagagctgcacactaaaaacaataaatcttattgcatgtaaatttaccttaatttaaaagaaaatgaaaaaaatttccgttttcctgttcaaattactagtgtcatatctgtctcctgactgaactttgcatgtatatcagaaagtttactatattttattgagaatatttttgataatctgggtgttcaattatacatgtttaagtttaaattcctttggccattgtttatgacataaatttcaaggcttctactgaccaactgtttgttagaagagttcctaaggtaccccctggagtaaaaccctggctgctataatttcatctcagtccacaatgcaaaaaaaaaaaaaaaaaaggtgtattgccttctcttcaggaatgtgcccttggtaagcatctcatttttttacagtaagatatcaaccttgtcttcagtgtgactgactgtacaagcacacgtccatgtacataatcagcaaagtcaaagaacatcactccaacacctgttaggagcataacctcaaattcactgtagccaatatccatcaaaagcttgaatgtaaaacaatatttatggaggattgcctaaacacatgctatctatcctctcatctggtctttaaaatttatccctaagttaaactagaccatcctagggagtaacctacctacacaacaccactgtggcctctacaaattgatgtgactgacatgctattaaagacctatattaagggaggttgtaagaaagagcttaatgaagctcattgtttttgtcaaggacattgttcactgtggtacatagtgtttcttttctcagtataatatatagtcctgtctctcttggtcaatatttatgatacagaaaccaagactagccctattctcattttttttcactcactactagaaactttaaagagaagtcttgctcagcatcaatgatattgcacggaggatgtaggagtatgcatttttaagcctgaagaacatacatgaactaacctacctgtagtcactttacttttactcctttgttttcaccatgtctcagttttcttactcttgctaattcaattcatcatgctattttatataattgctacttcagaaatgataaaatataaatagattcaaaattaatacatgtccatagactagtgattggttttcttctaagttaaataaagcaaacatgctttctgtccactggccataataaagctcagtgctaagcatagagaaaagaatgaaatagacatctgctttaggctatacttttaccatcattctgtagaatttttgcctaaatctcaagtctcaaaaattaaaaacagagattccctttaagaaaactttctttttctggtagttcagattattggtacttattttgtcttacttgcagtggaagatccaccacagtttttaatacaagaaaactatttgatgatactgtcactaaaataatatccaagggagctattagactaacagcaaaatggaacttggaaaaaagatcacaccatttgttttacatggctactatatacaagaatatgcaaaagtgagctaataacattacaatattctttctcctgatggctgtaaaagtgtcatagtaattacttcttatagtgtgttgttacttaaagaaacttaaatgtagttttacggcatgatttttgctttctcaagacagagataacagtagagacaagactgaagtgagtgttcagaagttcatttcaagagacctgggttctaattctgtgtcttctatgtcaccctgagtaggttacagcttctctagacttcagttctatgacagcagatgagagtggccttgaacataaatgaggtcccttgagctaacaacatccatacattcaacaaaaaaattattgaaaacctgccatgtttctggttagcactaataaaacacctgtcccatcttcatggatatcatccatgaaacacaatatctaacacaacctattactgcaacaaacaccaaaaatcatgcactaacgcctacatcggtacattgaagtacctacttcaatgactcttatcctgtaaagggctttccaaccccaaagtgctacctttcctccccgagtaaacttcctgtcagttgcctcctgttttcttttcccttttggtggggaataaagatagattcttagtgcttaggttaatacatctttctgcctgtgaagtgatttgaatcctaaagaggtagtaaaccctagtactctctctcagtccatgtattttgatcttgtattcaagaagactgcacacatgaagagtttgcaatgcttgcttttgaggaaaaaagtgtgtgtgcgtgtgtgtgtaaaacaaagagaatccctgtgtaaaatggttactataagaaaaaaaaagagtgactatttgaatatagatacaactaagggaaactgagccatattttgttaagattgaaatgaaaaaataaatgaaacaagattttcattttcttctcatcattttgcggcttcaattgatgaagaggagtgcaagaaactgtctggaaactcaaccatatttttacagtcttagtgagtccagataggataaagcccagaatgtgcaatttgaaaaatgatttttatattagtgaaatatattttagcacatgagacgacatctttttaatgcttcctgcaatacatagcctcatcctgtcctataaagccttcattttccccagaatgacctggcagccagctgaaaggacacagtggactgcctgactgattacacccttggaatatttatgtaacttttcgatggcagcaaaatgctgaaaagaggatacagcagataaggtaatggaagccggcctgacttaagcctcatgtaatccctgacatctcctaaatcactaggtaagattagtcagtgataaaaattctccaacagtgggcagctctctgaaagcctgcatcttcctgttgagtggaatgtcaaatttagagaatgtattatctgacctaccaaagatactacttttaagtccttgaccagttaagtaaacagtgcagacaactattatgtggtttttattttactgttgttgttttatagctgagttatatcccagccagattcacattgtgaatgtttagttgaatgctgcaccaaatgatagttgcacctattcaggccaaacctcaagaaatgtttttcctctttacttctgtctttgaatgacttctattccaaatgtgaaaaggacacattttcctttcctactgtgtggcaaaaataaggcaatctcagatctcttcaaaattgtctcaatttttaccttttacaaagaaagaaggagtcacctacctctttctgtagactaagaagaatgctatataaaaatccatacagtacaatgtaattttttaatcatttcatataaacagggaagattcatagagatactcagaaaacaaagtattgggattttatgcaaatatatcattatagtatacatttttatataattttgatcattgttaatattttctgcattataacatttatttgacaacttctatctaacccagttattttattgcaaggtaatatggatatattagtcttaagtcaaaggtagattctactatcatgaatttaagtggtattctctatccagaacccaaatggtcttatttgttaggtttcttgctaggtgcaagatacagtgaagggagcattactctttgttaaatttaagaagcttgtaatatataaagccatatacagtatataaaactagagaaattctctctcttcacttttttttctaatgtgtggtccatggcctaccaaaaatactatgcatcagacataacgaggatgcatatgtttaggagcattactaacatttaaatatgttgtaacaattcaggcacaaaaatccggcgcagaaaagctaatactttttccccatgattctgaaatactggaatcaatgtcaactctcaaacacatgcacatgagttataggttcacccaaaagtcaacaacatagctaaacagaaaatcacaacccacagttggctccaatgagtaagaattaaagagaaaaagcctgtttctatcttgaattttgttcagaagtgttttttttgttttttttggtttttttattatcattatactttaagttttagggtacatgtgcacaatgtgcaggttctgttttgactcagcaggtgagggatgaaaaaacagtaaaaaattaacttcaagagctaggtgcggtggctcacgcctgtaatcccagcactttgggaggccgaggcaggtggatcacaagatcaggagattgagaccaccctgactaacacgctgaaaccccatctttattaaaaatacaaaaaattagccgggcatggtagcgggcgcctgtagtcccagctactcgggaggctgaggcaggagaatggcgtgaacctgggaggcggagcttgcagtgagccgagatctcaccactgcactccagcctgagtgacagagtgagactccgtctcaaaaaaaaacaaaaaaaaaactaatttcaattttcaagttttaaaacagccattgttaatagtttagaattcagatctagaagaaattaaacagtaaacaacactgccaatatggtaaatgttaatattaatgtaaatattaaggattaggataattgctgtgttatggttccagaaatctgagtgctatggattaagggatttattatagagattagaccttatgcaactgtgggagaagaagaggaaataaaagtacagaggacaaaagttggaggatcagttccactgaataggatggggcctgattaagaagtctattgacagctgttgactctgcatttgttgatgaactcaaagtcactgtaggtcagtcagcagaggtgacaaagaagaagaaaagctgaatgtaaaaaggggtagagcaataaaaactgaaacctgcaaagacaaagttaaaccagtgaactcactagaacgtgtgtttatctctcagtatttccaatctcaatcacatccataacctacagacaaagctggtacccttcgtcacagagctgaacaagtatctggcctgggacttgaagtagctaaaatcggaaatctagataaaccagcagatcagcatcatacccctcatttaatgttctgtaatatacattaagcacttatcactacatcttatgttagtaaagaaatggaaaagaattgatatataaatatacatatatatacacacacacatatctacatatacacacatatgtttatatatgtaaaaataaattcatatcaaaataagaaattatcataacaattatagttctcatttctaatcggtcatgttgttgcagctggtatctagaacttctctatttcactacccatcacacattctctttgctctctaaagcaatttggttactaaagttttcttgcctggtaaggtgacccaaaccctcaattctaaaatatttggcctatttatattctatcactatagtttttcattaacctttttttttctgtagagatagcatcttgctatgttgcacaagctgatctcaaacttctggcctcaagggatcctaccaaagtgctgggattataggcaggagccactgtgctcagccatttctttattaacttttatcacaggtgatgaatgtactaagaggcaccccaaggatgtctgcattcctgacatattccttctaaccttccacagcataacagcaatacaattatcctcttgataatcaagagaaacaacctgagccagcacagttgtcttctttgcctgttgattaacaagcataagaagcccagagtggtcagtctcaacttccaaattaagggaaccaatccagtgtcccctggtggaaacataactccctcaatagttaagatctctaaactagaaaagcgtaaagtcactgggtcaggaatccaacattttgctagtggatcactagggaaattatgagaggaccgtctcctatttttattccttaattccaggagtcatgaatcccagttatgagagaaaaaggaccctgtgttggacactaacctagagcatgtaccacatcctagacaacattgtcctaaacccaaattgcgttgtcatctagctggtgctgtaataaaatatttgaaagaccattttaccactctctctggtctttgctagctatcattcatggttgtttttaaaaaggcattttccaggtaaatagctacataccaagttatgggggtaagtcaatttgcttcaaaaacaaaaccacatctgaaccagctgctagaattggagttagcacatgattaactgtatgataatccactgacattctccaaggtccatctttctgctatacaagccaaaaggcaaactgaatggagatttacatcaccatttttcaagtctacagtggtgattataatctctacaatgatccaagtttgtggtattgcctttgacttattagttggtagacagaagttccagaggctaccacttggcctttcttacaataacagccactattccatggattagggaactaatgtggaaactatgccagttgctgaatatgcctgatacaactatgcattcctgaactgaagaaatcatcacataatggattcaggtacccattggtccactcaaatccaagtcaaaactccattgattgctttacatctacaactttactctgtctagaagaccacattgcatttagggtttctaggaataggtgtcaactataagactattgtccagtaattctcaaaaacactggttatttttccttcttcaatttaccaccctggtaaatagcaatagatccctttgaggaatgttaagatttccattatagaattatggctgtgtcaaaggactgttcatcctcaaagggacctggcctcctcttcactcaagggactctggttctgaaaactgaatcatgtttggaaattgattgacagggaatgactctattgttgtgattcaaatcagacttttgttccaagacctagagtttgccacttaaacaattaaagtaagactagaagaggctgaataaggcttccagttttacagataccatgatcatcaatgtcctctctccataggtcaaatctgatgactgctttgctctgctatccagtatgttaactgtgcccaccttacttctggcaacgacgtgccaggttttggtccctgccacccagggatcccctcatctcctttgaattcagggactatagtttgatgacagctttttttcactgtcaatcctgaactatagagaatgacaaccacagagctctccaaggacactgactttttttttttttttttttttttttttacaaatatttcttacagctttgttcaagagcatcttccttccttctttcttacagttttgatgagggagtgttctctggtcccttctgagggacagaattcagaactgggtacacaactcttacataacaaatctacttttacattccaacctttctgaccctttgcatatcttcctctatggtaaagcaaggaactcctgaaatttcaaattcaattagtgtaggccacctctgggcccatgtttcagtaaactcaccaagaaaactcagagccatgctaactgtctaagctacaaaactaaacccagaatctctccttagttcatccatatcaacaaattcagcccaatccaatatttcatttcttcttcaccgttccaacttctgtattatccatttccatacatgtaccccaggattctatccatgtaaattcgtaaaatcttgcagttatcttggcatgtctggtacctttcatgtgtcacattttgtacctaacatccagggctggcctgaggattttagtctggatatagatctagaagacaatatctaggggtagattctaaggaggatcagcagggccttgcaatgattttaccttaaaggaagcttcatgttcttcagacaaggggagactaacacccatcggcaagggatgaagagctgcttctcctggcaaaggagactcagcagaattttggtttcccatgtcccccactttatgaggatctgttcgtatgtccccatctcaattattttggttttcacttctcccaactcaaattactaacttttaacatatgaaactctgaaggattgtgaattcaatttgtgttgaatttcaggcaattttaggactagactttggatttaactttcagaaatctcatccctgtgattacagtaggtaaaagcgtattttaagatagtcataaaagcattctagtccattccttgaatcttgagacttgaagccaccatttctttctttttttttttttccttttctttttgagacaaagtctcactctgttgcccagactagagtgtagtggtatgatcatggctcactgtagcctcaaattcctgggttcaagtggacctcctgccttagcctcccaaagcactgggattataggtgagagccaccatgtgtggcccatttccttattcatgcttcccgaacacttagaaagagctgagcagcagcattatggcctgtgttttgaacaaaatttcaatggcagcaagtatctggccatgcaaagccttgccttctatagtcacttgattgcagttgtccacagttgatcatttaagatcctattttgccatggcatggcatgctactagtatcccctttgtcactggagactaggtcattaatgcatctaaattttatcagatcagaaaaacatttgcagattattcagaaccaatacaaagaccccattctcaaggttctgttcctatggaagctcaaaaaacaggctacatttggtaccaccgagtgagaattaaagcgaaaaagcctgcttccatttgggattgtgtttagaatgatctatttgactaagcaggtcaaagattaataaaaacaagcaaaaacgaatttaaacctcaaagttgtacatgttgaacacatttttgatgcccaaaaatttccgttcaattaagcaaaaatatagacaatgttcaaaaccgccaatgttttctacatcatatgttttaactctaaaacaaactacagaggcctggcacgatggctcatgcattgtaatcccagcactttgggaggccaaggcaggtggatcacgaggtcaggagttcaagaccagcctggccaatatggtgaaaccccatctctactaaaaatacaaaaattagccgggagtggtggcatatgcctgtagtcccaggtactcaggaggctgaggcagagcaatcgcttgaacccgggggtggaggttgcagtgagccaagatcatgccactgcattccagcctgggcaacagagtgagactccgtcaaaaaaaaaaaaaaaaactagaaaatgacagtgttttcaatatattaaatgttagtattactgattagcttgagtgcctagactaaatcctaggggaaaaaatgaaagatagctatactagatttattagggaaagcaattttcataaaggcaatgtatttgataaagcaaagcatatggtctagctggcaattaatacaagccctgtggtgtgatatttgcctgtacgtgtgtggcaaaacatctttctcatatcaccctattacaataaaatgcattcgcagcaaaagtaagtgcactgtcagcctggaaaaagccaatgattggtatctctgaatccctttatgtatagaaaatatcttctctctccttccccttgagcttttagagtcagggttttaaaaacagcagaaaagaaatcctctttgaaatttcttttaagctgattagctgacacttaatgagtattagatattgcactggacgacaataggcatatatatatgtagacataactttcaggtactaaaaaactccaccttcaaaaccagctcttaaagtatttaaatatttaacagaactgagtacatttgtccaaatgatgctttccttaatatcacacaaggcactagcatccaacttgtccctccaagtgccctagacatggtgccaagcaaatgctggcaggctcttctaagcatactctttctaggtatagatccatgaaatagtgccagttcaatgtgatgtggcttcttgcaaatgctcttttaatgcattgtattccccaacaaataatgtctcatgtctggtatgtcaatttctttctacaacatgggaatctttcaatctattcattcttgtttataaatgcaaactttgcattattctattcacacatacacaccaaaaagaaacatatactagtgcattccaaaatatgttccaattatactaatttagtcttttggatctattcaagtttttcaaacattagctcttactgaactccttcaaaatacagtcacattttaagactgcaggattagttaagtgcaaggtcacattgcaaagtcagtagtacagagagcaaagattctcagaatcactgatctctcttcccttttagtgaccttagacttgcccccttcttccttctcaccaagcaaaagacactctcacttccacaagggtctcaatcccactatgtccaatactaatgaggagggagagaccttcatcttagtaacctcatcacaaaagaacagaggggaacaagttcgttattatagcaaaggtcaacataggtctttatagaaaactaacatatataaagatgtagctcatcaggggttggaaaggaaagagaaccaaatgtttataatcacctgcattatcctgcagctattgaagaagagaaagttgtcaccaatgcatctacatttttaaattcctttagtctcctttaaaggtgcctacctcattttacatagaagtgtaaattaatacagagaagtgctgaaatcatgaatgtaagacttaatggattctacaagctaaatacacctgacattattgtccatatcaagaatcaaaacaataccagaatctctgtgcctttttttccctgttttgaaccatcacagctgtcctgggtacaaaggagtcagtgccaggacatttctcatatttcatttatacaagctacttattacagagcagcatacagaacttttagggaatgtaacttatacaacactgagcacagaatatatctaaaatttctccacttctcaccaccagatactgctaccatttctagcccggaattttgcaataacctcccaatttataatccctgctcttgtctttccccttcagaaaatcttcaaactagcagctagagggaactttttaaagtaggcactccatcatggcattcagatcgtatcattcccccacttatagtaacatttcttgctcttggctgcacattgggtagcttcaaaacctaccattgtctggagccacccgccagaaattctggtttaattggtctagagtatgtactgagctccacaggtgattctaatatccagactttgctatgacctcaaggcccaacatgaaggcaagttacctttttaatttcagctcttactgtgctccctcatttagactatctcaaatacactgacctcctctctgttccatgaagtcaacgggcccacctctgaaccactacacttgatgttccatatttttcttcattgcttcttttcctgtgacagctagctccttcacttcctttacatctttttaacttttaagttcagggtacaagtgcaggcttgttccataggtaaacttgcattatgcaggtttgttgcatagattgtttcatcacacaggtattaagcctggcacccactagttgtttttgtttatcctttccctctttccaccctccaccttccagaaggccccagtgtgtgttgttcccctttgtgtgcccatgtgttctcatcatttagcccccacttataagggagaacatgcaatatttggttttctcttcctgtgttagtttgctaaggataatggtctccagctccatccatgtccctgcaaaggatggctgcatagtattccatgctgtatatttaccacattttctttataattctcgttctcagtgacaccttcactggctacccctgacattttataccccccgtcctgattcatattttcagcaataatcactatccaacatacaatatatcttctttatttattttgttccacctgaagaagcctgttggttcaggatggtgcccctaactcatggagcaatgctattacacagccggagctcaagaaatgtttattaaataaacaaatggcattttcaagtaatgaaaaccctgctaaagaactttgagacagcatctaacagccaacattggaatattcattgtgatcataagccttaagcacattctcaaccaaaactggctaaatgaaaacaacctagataagaagttgccatgtacagcaaaatacagatacactgtctgcacttcatccttcagacaaaagaaacccctagagcaaaggttatttcttcttttgtggagcattcagagctttcaggactaccagacatctaaaagcctacagaaattaaaaaaaaaaaatcaaatgggaaatagaccatgtttatcctctcccttgcatatatatttttttcatatttcctttgtaattcactcatttggggtctgagaaatttctttatatgtcattgtggaggtgcactcattcacaatgattgctttcaagcacatgacatggcatccacttcacccccaactctctgctgcctcaagaagactgtcctagagaaagttaacatcctgattccttttatttttttttggtcaagaaataaatcttgaaataaaaactcctgaactttctaccctgcctaaaattttgggctaaataaaatatcttctgaattaccaatccaacaagagagagattttttaaaagagagaaaaagagaacaactcatcagcagagcagaaaaatcacaaatcactaaacacagggctatttccagttgcacccataagcagtgctgctaaaaactaggtctcaattccactgggtctaagccttcctcttgctcgaagaagcagctaaaacattgttcgttccccacttgcctcagagacagtgagattcttgaggcttctgtttagaaaaattgttacagtctctcaatacgtctgtgtttttattatcactgttaataatgaaaaacaaactgtggtccttcgtagctccgatacacatgctgataaccaatctacctgaacactataaaattcctggtagtctcaataaatatttgataaaataataaaactctcacagttctgaattcttttctacttcctatatgttcaacttcatatagggatttctgattatagaactagcataaaaagagccttctaaaatttggatttatatttaaattctgttctagtgatgaaatttcattcctaagctacaaaccagcaagataaaccaggcaaatcattttgcttcattttttcttttcatgctcccatccttagacttaaaataatcccagcagaaaatgataaaccctatttcctagtattctatcattagacagactgttctaataagtaatattttaagaaacaaaataaccaagagttcattgattaaacaaacaactagtttgttcaacaaatagttatagaatgctatttactatactcatatttttggcaatacagcaataaacaaatacacacaatcctttacctcatgcacattatcatctaaagggggagagaaacatttattacataaacttaaatatatctatctacattcaaaaagtatttatcaagctcctttacggcataggagttgggtaaaaatggtgcacaaaatacatatgaccaatgttttcatggagtctaatgaagaagactgtattagcctattttcatgctgctgataaagacatacccgagactgggcaattcacaaagaaaagaaggtttaatggagaatcacagatccacatggctggggaagcctcacaatcatggcagaaggcaaggaggagcaagtcacatcttatatgcatggccacaggcaaagagagagcttgtgcggggagactcctatttttaaatccatcagatctcttgagaaccattcactatcatgagaacagcacaggaaagacccacccgcatgattcagtcatctcccactgggtccctcccacaacacgtggaaattatgggaactacaaaatgagatttgggtgaaaacacaaagcaaaaccatatctttctgtccctggcccctcccaaatttcatatcttcacatttcaaaaccaattatgtcttcttaacagtccccccaaagtctcaactcttttcagtattaactcaaaagtccacagtccaaagtttcatctgagacaaggcaagtcctttccacctatgagcctgtaaaatcaaaaccaagtcagttaattcctagatacaatgggggtacaggtatcgtgtaaatacacccattccaaatgggagaaattggccaaaacaaaggggccacaggccccatgcaagtccaaaatccagtgaggcaatcaaatcttaaagctccaaaatgatctcctttgactccatgtctcacatccaggtcacacctatgaaagaggtgggtttccatggttcaggcagctccacccctgtggtttttcagggtagtacttccctcccagctgctttcatggactggcatggagggtctgtggctttttccggcacacagtgcaagctgtcagtggatctatcattctggggtctggaggatggtggccctcttctcacagctccattaggtggtgccctggtaggactctgtgtgggggccccaaacccacatttcccttctgcaccaccctagcagaagttctccatgaagaccccgcccctgcggcaaacttctacctggcatccagggatttccatacatcttctgaaatctaggcagaggttcccaaacaccagttcttgacttctgtgcactggcagtctcaacaccatgtggaagttgccaaggcttgaggcttgcaccctctgaagccatggcccaagctctacattggcccctttcagccatagctggagcagctgtgacacagggctccaagtccctaggctgcacacagcacggggaccctggacctagcccctgaaaccactttttcctcctaggcctctgggcctgtgataggaggggctgccatgaagacctctgatatgccctggagacatttttcccattattttggggattaacattcagctcattacctaggcaaatctctgcagtcagcttgaactgcaccccagaaaatgaaattttcttttctatcacatggttaggctgcaaattttctgaacttttatgctctgcttccttaataaaactgaatgcctttaacagcacctaagtcacaccatgaatgctttgctgcttagaaatttcatctgccaaatactgtaaatcatctctttcaagttcaaagctccacaaatctctagggcaaaggaaaaatgtcagcagtctctttgctaaaacataacaagagtcacctttactccagttcccaaaaagttcctcatctccatctgagaccacctcagcctagactttattgtccatattgctatcagcattttgggaaaagccaaagtctttaggaagttccaaactttcccatatttttccatcttcttctgacctatccaaactgttccaacctctgcctgttacccagttccaaagttgcttccacattttcaggtatcttttcagcagggacccactcctggtaccaacttactgtttcagtccattttcatgctgctgataaagatatacccaagacggggcaatttacaaaggaaagaggtttgatggagaactcacagtttctcttgtctggggaagcctcacaatcatggcagaaggcaaggaggagcaagtcacatcttatgtgcatggcagcaggcaaagagagagcttgtgcaggaagactcacatttttaaaaccaccagatcttgtgagacccattcactatcatgagaacagcatgggaaggacccaccccatgattcagtcatctcccaccaggtccctcccacaacacatgggaattatgggagctacaagatgagatttgggtggagacatggagccaaaccatatcaaagacaaacattaaataaagccagcaacagcaataagttctataaaggaaactaacaaggttctacgagagaaaataacgaattttttcaggaagtgacatatcagcagagaaatgaaaaatgagtaggtgttaaatgtgtgtttagcaaagagcagtctgagaagataggaaggtttgcacaaagaccctgccagaaaatacttgccagtttgagaagaactgtgaaactacactaataatgcctggagtgaagataatatttgaagatgagttaaacaagctgggtgcagtggctcatgcctgtaattccagcactttgggaggcagaggcgagcggatcacttgaggtcaagagtttgagaccagcctggccaacacggtgaacccccttctctactaaatataccaaaaaaaaattagccaggtgcagtaatgcgtgcctgtaatcccagccactagggagattgagacaggagaattgcttgaacccagaaggcggaggctgcagtaagccaagatcaggccccccatctccagcttgaatgacagagcaagactctatctcaaaaaaaaaaaaagacttaaacagagttcatatcagaacttttatattaaatttctgaagaacattaatttttttcaaaatttccgaagttcgcatgtaacagaattttatgcgtcactcactaatgtactgcttcacaaagcatccttcatgaaccatcattttcattttaaacagttttatagcccagtgcatttagaattgcagctgaaacaaaattaaatcaataccttttgtgcagaacttctcaaatatttagaatgataaattgtaaatattcatatggagaaagaggggcagcacttaacaaacattatattatggaactcttttggagtatttcagcagactactgcataaacagaacacattctgaaaaatagtgcattaatgcatttttccaaaaagtatttattgaagacctaccacattacagttcctattctggattccagagatacggtgattaatgaggtagaccacctgccctagggaaacagtgtacctagtaggaaggagtgatacccatacatcagattactatgagtgttattccagacatatgtgcaagtaggtatggtaacacataacacaagtgggagcatctagcacttatctactaggcttaaaggaggataaatgttgatactaattcttgaaaatagtaatcaatatacagtatactttaaaacttcttatttttacaactgtggaattatacaatttaaaacctgaatgagatcttagaataaactatctcaagtttctcttttatccataggtagaaactaaaactcaaacaaaacatctttttacataataatttcatgatagagttaagatgaaaatttgatttctagtatacagtaatgagggcattttattaattgtattgcatcatagtaacaacattcagaatattagagcattttctctccatgctttcaagaccctaaaagacattttcatgtcttagccatagactctcacacttattgggctacatttccaaccaaccagccccaaaaatttggtatgacaaagtttaggccacatggcatgaaaatgtctttttttaatatgtatatataatatatattaaattataatatatatttttaatttaaatatatatttaatttaatttaaatatatatttaattttaaatatatatttaatttaaatatatttaattttaaatatatatttaatttaaatatatttaattttaatatatatttaaatatatacaatatataatatatattaatatataataaaatatatattatatatttataatatataattatattataaattatatatattatataattatatattataaattatatatattatataatatatattataaatatatataatatgtatatattatattttgatatatataaaatataatatataataaaaatataatatatatattttaatttaaatatatatttaatttaatttaaaaatatatatttaatttaaatgttctatatattatacataatgtatatataatatatatacattacattatatatacacatttatatgtagagaacaggcagatgctgtttaatatgcatattaaatgtatatatacatttaatatatattatatatacattacattatatataatatatattatatatacatacattacattatatatattatatgtatatataaaatctatcctagagatatagataaatgatagatagatagatatagagatagagatatatatcctatacatatacgcacacacagagatggtatattttctatttttctattcaagctgaaggcctaagaactaagagagccaatagtatagttttatcccaagagccagccaactgagatcaaagaaaggccagtgtttctgttcaagtgtgaaggctggaagagacccatgtccagctcaatgtcaggctgaatgggatcccccttactcagtgcagagtctgcctgtttgttatctacgggtcttcgactgattagatgagaaccgctcacattagggagggaaacctgctttactcattctaccaattcaaatgttaatctcatccagatacaccttcacagacaggctcagaatgttggccaaatgtctgggcaccccacagcccagtcaaattgacacataatgttagccatcacaagtcaaccccttatcaatttaatgcccatactcacctccttaaaccacacttaatctccaaataaaagcaataacaaggtcataattccacctaacataatacaattattctatgtacaattacaaacacactaactttttccccagaagacaagataaggtctttgagtgagattcactcaaagattcacccataagattattaccatttttactgtacattttctatgtttagatatgtttaggtacacaaatatttgccagtgtgtaacaattcccaacagtattcagtacagaatgtgctgtacaggtttgcaatctaggagaaacaggctgtaccacatagcctagttgtgcggtaggctgtaccatccaggtttctgtaagtacactatgatgttcgcacaacaacagaatcacctaaggacacatttcccacaacttatctttgtcattaagtgatacatggctgtactacgatgtaaaattaataatacttaagaactgcagtatcaaatcaattcatcttatgttacgtggttagaaaataagggagaaaagaaaacaaagatatttgtactttttcattattcattctgtattccttttgccctcagcaagcacatctgctagtaatggttttttacctggtgggagtgacccaatctttcatttctggagggtctgggccattagtagtcctgcctggactgggttgttgtagttttcctttaacctcaatcacagggtatagtgatattaagagatgccctaggcagggcacagtggctcacacttgtaatcccagcaccttgggaggccaaggcaggtggatcacctgagatgaggagttcaagaccagcctggccaacattgtgaaaccccatctctactaaaaattcaaaaattagccgggcatggtggtgcatgcctgtaatcccaattactagggaggctgaggcaggaggatcacttgaacccgggaggcggaggttgcagtgagctaagatcatgccactgcactccagcctgggcaacagagcgagactccgtctcaaaaaacaacaacaacaacaacaacaaaaaagatgccctaagggatcacctgtattcctgatacattcttccttacctccattgtgaagtagcagtccaatttccccttggtagtcaagatcaatcaccccaacaagcacagtagcttgcttctttgaatgttcacttggaggcatgaggagctgaaagtaccctgctgtagtcttaacttccagttcagtggaatcattgttgtatctcctggtagaagcatttctgtatttggaactaaggcctctaggccagcagagcataaggtcatggaataaggtcatggaatcagaaagcaaacttttgctagtgaatcactaagggcaatagtgagtggtgccacttccatttccatcccttcattcctagacccatgaatcctgactatgggagaaacagcaccatatattgtatgctcattcggataatatatagttggccctctgtatccataggtttcacatcgagagattcaactaactacggatcaaaaatatttggaaaccaaatttcaccttgatatggtttggctgtgttccccactcaaatcttctcttgaatcatagttcccataatccccacgtcatgggagtgacctggtgggaggtaattgaatcatgggagcagttactcccatgctgttctcatgatagtgagagagttcatgagatctcatggttttataagggccttttccccctttgctcagcacatctctctcctgccaccatgtgaagaaggatgtgtttgcttccccttctaccatgattgtaagtttacagaggcattcccagtcatgtagctctgtgagtcaattaaacctatttcctttataaattacccagtcttggatatttctttatagcaggatgagaatggactaatacattttctgaacaagtacagacttatttttcatgtcattctctaaacaatgcagtacaatagcaatttacatagcatttacattgtattaggtatcataaataatctagagatgtttaaaggatacaggaagatgtgcatagtttatatgcgaataacacaccattttacatcaggaacttgagtttccatgaattttggtatatgcagggggtcctggaaccaatgcatggctactgactaacaactgtacagccttctgtagaaccttgcccaaatcctgcaaggtattaccatctagataacaatgtaactgagtcttcaaaaagtcattccccagttctatcaaaccagctgcttcaggatggtagggaatatagcaagactgttgaattccatcatgatgggccaattgccacacttcttttctgtaaattgagttatatgatcagaagcaatgttgggatatcatgatggtgaataagacattctttaagtctttggatggtagatttagaagaagcattatgtgccagaaaggcaaattcatgtccagagtaagcgtctattacagtaagaacaaaatgtttccccatccatgatggatggaagtggttcaatgtaatcaacctgccatcaggtagctgatcaacctggggaatggtatcaaactgggtactcaatgttgggctctgctgctggcagattgggcactctgtggcagtcatagctcaagtggctttggtgaatggcatccatgttgctgagcccaggcatgatctccatccatgctaccatggccactttgttcatgaaccaacgaggtgataacaggctatctggagaaagaggctggctggtttcccgagaactggtcaacctatgcagttaattattaaagtgcttctctgctgaggataccatttggtaagcattcacatgggatacaaataatttcacatttttgcccattcacagagttctgtcttcatacctcttccctaaattttcttgtaaccaatttcccaatcatgttacttccaagtccctaaccatccagccaaaccattggccaccgcccatagtcagcatgcaatcacatgtctagtcatttctctttgcaagcaaaatgaacaactaggtgcactgcttgaagttctgccaatggatcacaggaaattccctatgaagccataggtgcaaggctgggagagagaagggagtgtaacagcagtggggaccactggcatttgaaccactttttcatttaatttacttgtgttttcagtacctcctctggcctgatcatgtacaaactacttccatttgatgatgtagcactgctaaacatgcccaacgttatgccttggtgggtctctttactactgtaaatgtgtcattagcatgtttaaatcaaatcatattagcgatcaaacttcagaaacctcacaacgaattcagaaaacttacccttaaaattctgtttctctagaaccactgtcagtaccaaaatctacgggttagagttcctcagagaaacagaaccaacagtatttgatttatatccaacttattgtaaaaatttggttcatatgattatggaggctgagaagtcctaaaatctgtagttggcaagctagaggcccaggagaaccagtggtatacttccaatctgagtcagaaggcctgagaaccaggagcactgatgttataaatttagtctgaaatatggcaggctcaaaacccaagaagagccatttttcagtttgaatccaaagacaggaaaagactaatgtctcaattcagatggtgaggcaagagttctctcttactaaagatatggtcagcctttttgttcttttcattcctttaactgattggatgagggccacccacattaaggagggcaatttgtttaactctgtctatgaattcaaatggtaatttcattcagaaacacccttgcagacacacccaggatgtttgaccaaagatctaggcctactcaggttgacacataccattagccatcacaacaccttaaataatagacttaaacagttccttactaaagcctaaaattttgagtgtggtttggggtagtaataaatttaggactctcatctttctgtaaactttactaaatattaaataaatgttaatactgttacagtaggtagttaggcataagtggggcaggagagggctctcccaacccacaagaaatgttgggtgatcgttcggcagttatcacattgcctctgtaaaagtgataaattgggagccagtgccagggagaagccatttcctgatggtccacaactactgcactaaagtgttcattgaaagcagaagccagggagaaggaacttcctgggcatgcacgttaagagacaaaatggcagagtatgatattccagggtcactctactggaaaaaggaagaaagcctcagatgggcatatgtacaacttcctaaacacaatgcacttgttcacttcccaagggtaaggagggcactgtgcatgtgggcagcccaccgtaagggaagaatcatgggaaggaggccagtctataaagtcctagaatcaaggttaaatgtcacacttgaacttctctctctttaaccttcacatgtcatcttgggtctctgtcaagtgaattttccttcctttcctgttctaagatcttttaaataaacttccactcctgctgtgaaacttgcctcagtctctttttctgcttcatgcccctcagtcaaatttcttctgaggaggaggaaaaaaaattgaagttgccacagatgcatatggattcatcaccagtaacttggggtaactcagatctcttccatcggtaacaatactggtattttctagttcacagaataaaggggaaaatgtagaaggatgacaaatttgtaagagaaaaaaatgctgttatcaagtcaaacctcaattgcttgacttcaggctgctggagagaagttttaatgcgtaaattctagtttgaaaccttagtaatttggggaggagttggtggtgctgataaaatattcgtgaagagtaaaatgaacagaataatgtaaaaggggggcaatctggttgaccaattgggaaacataaactaccatttgcatggtgataaaggccagtaacctacttaaacactgtctcaggagtcccagagctttgtagtgtcttgaagttgcttgtttgtttgtttgttttgagatggagtctcactcagccactcaggctggagtgcagtggcacaatctcagctcgctacaaccctcacctcccgggttcaagcaattttcctgcctcagcctcccaagtacctgggactacaggcatggctaatttcatttaatataccacacctggctaatttttttttgtatttttattttcatcgtgttagccaagctggtcttgaactcctgacctcaggtgatccacctgcctcggactcccaaggtgctgggattacaggtgtaagccaccgtgctggccatgccttgaagttctctaagctctctttggttgtcagggactggctgatgctagcaggaacatcaaagcaggaggccacccagattagacaaggaactatgggaaccctagtccttgcttctcttctttgggactcttgtcccctctacagcctggagttgaccagaggacctctgggactcatacatttagtgtcatctcacatctctatggatggcctctgtttcagaattcctcccagtgactgccatggcacatgatttgggatgtcttgctcagattttaaaatagacaagttctggaatataggatacctacagtctataccaagcttcagatttgagcaactcctgccttctgtacatccattcttaccagcatgttccaatgatgttgccacctctatctgtagtacccaggggcgatagaggtggtggcaggcattacttactctgtgccccccacacccacatggcaacaaaggtggacacgtcaccctctcctcagcctgcagcacaaatgttgtgtctatccccactgaagctttttgagactgttgctccccatccctaacaaaaccttattaatgtcttctcttacttccaatcacagtgatgttatctcctgcaggtcttaagtcatgccagatgaaggacaaacatttcttacatctgggactgctctttatagcacctcagctattctttcgctggtggcagtgtagggaagacaggagtgaggtcatcattgacaaagatcacactctaggaatgttgtgattgccacctaaagagttggagagaagatatggttggaggatgcgttgttctatgtttactctacaagctcttgaaagataaatttagcatgtccagaaaatgaatgacatatgtttcacattttcctgcacaatctgagtgagccttgcatttatggtaattaccaaggaagcacagtgtcaaccttcagagaatcgtgggaagtcagtatttataggtggaatgatgaatggtgcagcatcatgagtgatgatgtaaccagcattaaatagatggcatcaggaaattacagaggcaaaaagatctctaatgtttcgaagtaaacagagccatgacattgtgagtaacaacaactttgctacctctttctcctggtaagaaatgaaagtaaccaggaacactacatttcatctgaagagatggttcataacaaatatttgcctactgtctcagtttgcacaggttgccctaacaaaaatatgacacactgggtatccgaaacaacagaaatttattttctcacagatgtggaagctggaattccaagaccaaggtgttggcatgtttggtttctcctaaggcctctctcctctgcttgcagatggccttcggctgtgtcctcacccagcctttctctgggtgtgtatgggacaggtgtctctgtctcttcttataaagatatctgtcttactggattagggcctcatcctactgactcatttaatcttaatcacctctttaaaagttctatctccaaaggcagccacactggaggttaggtcttcaaaatatgaattttggagaacaacaattcagtccataacacataaagccctacacaacctaaggatagctctattaaaaatgttccttttataacacctcaaaacacctcactgctacctattaattataatttggcagccatggatattattttagggtgtgtctgaggaattaaaaaaaacagctttttcaagttaaaagtacatgtgaataacaagacatatgtttctcaaagcttaagatggtctccaccagcagttcagcaactagcagcacaaagtatgagcaaacactcaaacacaagcatgagctaaagtaaaacttagggtcaaatgtacctctcaaagtatatgattggagctaacttttttattttaagttacagaaaaaaaaacaggagaactgaagagaaatcttcatctaatatgttgtttaaaatctggaaacatattttctgtactcttgcatcattttttttttctaccaagtaacaaatggatgtgtcttcttgcaggaccaaaaacaaaaagaaaagtaaaacacagagttctcaaaagcaccataatccctttaaatttgtgtttgagatgtcattagttaacgtactgttcaatgtactaataaaccacataggcctgaaagaatccatacaacttgaaatttgtggagatatttaagaaaaagacttgacttatcgaaagcattataaagcattctcattcacagaaaggcttatattaggattgattctcagatctcaaatttatcggaccacctatcactaaataaatacctttatcaataaattatactgcaaagcctttgctgaaagtgctgagattaatatcataaaagatcaaaaaacttcttaagaaagacattatagtttcatgtacatctgatgcaaaaagaaataaagctctttaacctgaattctaaatttcatgtttggcataattcatagaagaagcataaatatttgacagattgagaaggagacaatatggcttttatccaaataattttctaataatttatctgaagcaatcatttacaatgaggcacactaactagattaataaatagtaaatctttagaacataaaaaaagttatctctatattatcaaatgaataaatcaaagttaaaatttaaaatgtgagcatctactgcatctactatacagtcccatttaatatggagcactcaagacactgacaactggttctgtaaaatttaaaatagcacctatgttaaggctctgttttcacagatacctgctttcccctgccctccattccaaaaaaagatcaaattttaaagagcactttatattcatgtggcatctgtacacaagttctccagagagaaagaaccaataggatatcataggtaaataagatagatagatagatagatagatagatagatagatagatagatagatagcttttataatgaattggttcacatgattatggaggctaagtcacaagacttgtggtcaagaagctgaagaaccaggagggtcaatagtgcagtttctgtctgaaagccagcaaggttgaaacccaagcagagctgatttcagttcaaatccaaaggaaggaaaagacccaatgtctcagctcaaacgatcaggcagagctctctcttactccctcatcactcttacagctaataatctagttaaaggcacaaaatcacctttggaagaatatcatcaaaggcacggaaggaacaagtctttcgacttaagccccataactgtctgttaaaaaaaataaaaaatatttattaccatgaaatactatattcttaaaattatacttatatttcagcagaccctatctcatatcctgttttatattgatgcaatttgatcattctcctaaatcttaaattttaatacatatttctactattggcaaagaaaggagaaaaatagttattaaatgctaaattgatctttaattcattcaaatttttattgagcacctacctcacaccattcttggttaggagaatctgtgctccttgtcatcagattgttctaacttgtaagtagagctagaaatgtagagtgtgtgtgtgtgtgtgtgtgtgtgtgtgtgtgtgtgtgcaaactcacatattttcattatggtcatttaatctaacttttaaaacacagtgcgggccaaataaaagacactggtgatccagtttttgaccccaggctgtcacttgtttcactttgtattataccatcatttttctctccaattctgtgcatcctttaactgcctggcaactttctcttatacaataaaaatttgagacttaagatctcagtcttcctctatgtctcaagcattgccatcattctcggtggatctaacaaggaaaggatttcttagtcaatcactttagtaacttcatttcttaacatcttcagttccagtgacataaacttcatcttaactccaacagccacatcctggaccttattctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggccgaccttattcttaatctggttcactcactcaatactgacccaccatagacttcctgaatcaaaacattcatttctccacacacaaactctttcctccagaatctctcatatagctatgtccacagcatttattcttttacctttctgagaccactagtccttaatcctttcaaagggagcctctctaatcttcagccttcacttcctgttctattttccctagactccgtggtcccccatatcaaccactctcttgccagtgtctgtaaaacatcttttgtttttcttccatcagtttttcttaactaaatgccagtacaggatcaattcacaaactcttattttctctatgcctgcacccagactaagagacacctcaagcaaaaattacgcaaattggcacattgatatcacaacacattttatatctccattgttggcaaactgctacttgctgcttgatctttttttccccaactttactgagctatagttggcaatttagaatgtatctatttaaggtttacaacttcgtgatttttatatacacatatattatgaaatgtttgccacagtcaagcaaatgaacatatcacctcacatagttataattttgtgtgttgagaacacttaagatctaccctcttagcaaatttcaaggatacaatagtattaactatagttcacattgttatacattagctatccagagcttatttaactagcataagtgaaattctgtaccccttgaccaacatctccccatatcctcctccccccatcctctggcaccaccattctactctctgtttctatgggtgtgacatttttggagtctacatacaagtgagatcatacaatatttgtccttctgtgtctggcttactttacttagcatcatgtcctcaaggttcatctatatttttgaaaatgacaagatttccttcttttttaaggttgaataatattccataggggtgtgcgtgtgtgcatgcatgtgcatgcaggtatatcacatttatttacccattcatccatagtagacattaggttgtttccatatcttgactattatgaataatgcagaaatgagcatgagagtgcacatatctttaagatcttgatttctttttcctttttaaaatatatacccagaagtgggattactggatcataaagtatttctatttttaattctttgaggaaccttcatactgctttccaagaagatataatagggaaaagatagtctcttcaataacagtgttgggaaaactggatatttacctacaaaggaataaaattgaaccgtatttcacactatctacaaaaataaactcaaaattaattaaaaacctgaatgtaatatctgaagctataaaactacaagaagaaatcagaggaaatacttcttgatattggtctgggcagtgattgtttgggtatgacaccaaaagcacaagcaacaaaagtaaaaattgacaaatagaatggcataaaactaaaactcttctgcacaacaagcagaataaagagacaacctgaggaacacgagaaaatatttgcaaaccatgcatctaataaggtattaatatccataatatgtaaagaactcatgcaactcaatagcaacaaaataataataacctaattttaaaataggcaaaggacctgaagagacatttcttcaaagaaaatatacaaatggccaacaggtatatgaaaaggtgctcaaaatcactaaccatcagggaagtgcaaatcaaaaccataatgagatttcagctcgctcctgtggctattatcaaaaagacaagaaataacaagtgttgatgagagtgtggggaaaagaaaacccttatgcactgttggtgcaaatgtaaattagacaacctttttcatgtttccttccttagctttctcattaattctgcaaaatatgtacttgaaatctctccattattttcaaactccaccaactcatcattcagcaaatagccttccctccacctacaaagaaaaaactacaagctgcagaaggaaaccttcaattctttgcaacttcacctattctttttcctttcttcctgtcagagagaagaatcagattcccaaatctaacgcctcccccagtgctctagatacacccacacctgcctcctcaggagcctccctcattatttatccttttgttcatttccctatagttttgtttactcttgttctatcattcattcaaagaaaatttaaacatgctcagagttctgctgtgcaaaaataaaaggatcctatatctccctccacaactgccttttctcatttactttcatttaaaaaataagcacatactacataacagccacagtctttgaaaacgttgtccactctttttgtctcctactcctctcttcccatttacttctccatccactgatgtgcagtttctaccatcacttcatgtagttctaactgttttgaccaagatatccattctggtgaatccaacagacactatgcagttctcatcttatttgatgcctctaaatcatgtaacactgttgagcactccctcctatgtgaaattctatcttcccttgatatagacagtgccatgctttttaaggtctttgctgcttttttttttcagatgggatgggcagagaatggacatcttctgttcattgcttaaaagttgatattctcataacttcttctcataacttctgtttttagtctacaaactctctccctaataacctcatttattcccatggccttaattactactactagttcagtgtactcctgagtttcagaaaagtatatataattgcaaggacattaatctgcttaaatatctcaaccaccacttatgcaaaaatgaaccaataattgctgccacaaatgttttcctcctctgtgtttcctatctccatgaaaagcagcaaaattctgccagctaaatagccacacttccatgttttccatcctagtaaaaagcagcaaaatcctgctaactgtaaccctccagtgttttctatcaccagataaagtcacaaaattcctgctagctgatcaagcaaaaaccaatttaactcttcttcctcttctagttgattccacctcctcaaaatttggcaaagcttacgcttcatcaatctttgctgctatttccttctaaattcgaaatgtcattatccccttgtgtgatcactctaacagcctcctatatgatctcctcactccatctgccaccactctcatcacctctgattccattttcacatgacagcctgagtgacctttcaaaagcttaggcacacttatgtcactctctggtttaaaatctctcagcagcttatcattggtctctgaataaagttaaaagtcctagaagggcttgaaagatctggagaatttacacaggcaaatgtgtttccaattgcaagcttgccagtggtttttaagagatatttaaggacataaaattctaagctctattatctgcccccaaataattataataataatacttaatacttatatagcacatctatttttaaagcactttcatatatattatttaattcgtggctttcaaaagcccatttttgggataagaaaattgagaactcaaggttaagtggtttacacaaggtcaattatctgctaagtgacatgattggtactcaaattctagtaaaattaagtcactttatagaagagactgatataaaaaaaaatttttttagagtttcactaagcaaattgtttggaatgagattaaagccagagtcatcttatgttgaattttgatagatgatagatagatatagatgagtttttataaaaagatcccagtgcagaagcaaaataactgtttaaaaacaagtatcggatatttagaggaaatattatttctaggagaggacacagtattttttagcttcactttattttgtcgaagactagctctggcactaaacttgatgcatacaaaagatgtcagaaaatataaagatttaactatttgcagctttgtcattttatttatttcaacactagaactgactttcagaatgaaaaaataaaaataaaaaagaagttcctgccataaaattaatcacttgtcaataaataaaaagtaaaatgtgtgttggactgaagtgaaggttgactaaagagtagctgaatagataaaggagattcaacattgtcatcagaagatatgagcaccataccacaaggggaacttggggaactctgccaagaacagaatgaatgcccactgccaacacaaactgacagagggagccatgggagccagtgtgaaataaaagacagaacagagttaattcaggtcaaccaggcctaatgaaagaccagataagagaagagatagaagccaaccaagtggaaatgcctgtctagataacagctaatgaaagaacccaccaaaattaactatgaacaaaagattgttcttatagccaaccctccaagtgattgaaatgcaaatgctttcatgaaagcagtcttctccaagtaaagagaaaatcttaaatgaaactttttttttcttttttttagaaagagtctcttctctgtcgcccaggctggaggtgcgatggcacgatctcagctcactgcaacctccgcctcccggatttaagcgattctcctgcctcagcctcctgagtagctgggattaccggtgtgtggcaccacgccaggctaatttttgtatttttagtacagatggagtttcacaatgttagtcaggctggtctcgaactcctgacctcgtcatcctcctgcctcagcctcccaaagtgctaggatgacaggcatgagccaccgcgcaaaaccgaaacttttaacatcacgttttgagacaaaaatgattctgaaagacattttggcttaagaagaaatcactttatattccattagttccctgaatttagcaaaaacctttgagaagaaaaaggtcacagtgataattgctactgttttcccaataattaaataaaaacaaaaataataataaaaattaaaacaaacaaaatcttccggggatgaaaaatcacagtgtgactatatgaccatccagaaccagattcctcaatgaagagaggtgtggttaaaggagcaatccaaaaaccactcaattttgagagaaaggttttatgcccagtttaaaataataaaataaatgaaactaaagggtaaaataaatttttggaaagccctttttttatttcatggccactggaatagacagagttattcttattttgctaaatattttatcgtgaaaagactaggaaatatatcaaacattactagctttggtaaccaaggttttcctttacagcaaaagattaagaaaagtactaagttggcacaaaagtaattgcagtttttgccattacttttgtgccagcctaataataagtaaaaattaattgactaacaaaaatcgtaacagacaccaaaaaaagtttctcctgagactaactaaagaaacattcacatcttcatgctgccaggaagacaaactgccatacaaccagaggctaacttgggattgcatgcatttactagctttgaatgatgatagagataaactctttaattctgctttgaaatcctgtgaaccctataacttcattcacagatatgtggagaaaagaatattgctttcttttctattagtttaccttgcaaaatttcaccagtcaggttatacttgcccaaacctctaagtttgctattatatatgaccagaaactaaaagctacttttggtaagagcgaaaaatgagtcactcttggataccattggtgagactccaaactagctacaaacttttatagtataatttggcaaaatcaccagaatttaaactgtacctgccctttgactcagcaattcaactttggtgaatttattgtatgtatatacttgctgaagatataagcctgggtatttggagccacatgattcatactagcaaaaaaaatgtccatcaataaagaggctgattaaatagattattacccattcgtacaatagaatttgcacacattgaaaagattgaggtagatctgtattcgttgctaaggaaagatctccaaggtgaactaagatgaaaaaaatcaagtgtaatatactgttaatgtatccttcccttcatgaacaattttgaaaacattttcctatggatatataaggatgtattcatatatggatatattcaggtatacaatgtttttgtagatttatacaccaagatttcaaacatagtaaactttgggtttaggacctgaatggaaatgggagggtacgtttttaattttcatcttacatctactataccatctaaattttattatcatgcacatatacaacatcttccaaagtttctatgggatttatcctagaagctggcatttgagaccacttttatttgtctttttccgataaaatatagtttcaatgcagcaaaaactgtcaaatatgaaataaacagggtcaaattagtcatggtaggttgtctttgctcaaaactaagcataaacaaatgcttatatctaatctatatcatatccacagcaatggctgatatgatcttattctctccctcattccagaataagcatgttcgatagggcactagtgtttaattaagcacaattttcaaaggctggatcaggccccactagacatataaatgcaatatacttagtaccataaagtttgctaataatgcgcattcataaggtaaaagccttttaatatcagggtattaggttagctggaatccaatttatgaaaaaaaccttctatatgtgctcattggtaagcaataatgcatttcaattccatgccggcacaaaacctctcaggttcccttatgctcttttaaataagaatcatagaacattaatagaagtgctctcctaggtctctattcaaatgttctttgatttatagatttcattaacaaagatcaagcaaatttccttttgctagtattccagagtgagacaaagctgctaacacttgttttgtgaaaacttgcattatggcattttaaaactactttgttttagggctttgtcaaactcagacatgatctcttttcagggttaggcctattttgatcacttttaataagtaatagatggatgttttaacataccaggagacagaaacagtcaaagaaatattctactctttcctgtatttcttccctgagggcaatgctttaaaaaaaatcaattgtgatatatgtcacattgcatttcagccctctgctgaagagggaaaattctgaggagctgggacccctccagtcctaactctgagctggcatggcccacactggtcatagggtgcagacacagagaggactgcctacaactagggacttcttcaaaggcaagagatattctgaccactgttttgcacactttgaagtagaactaggagtggtggtaatagccaatcataactcatttcctctctgaggctggttcaaggggcatgtctttctcttttccaaaaatgatgttaaacagcaaccaagcctaatttcccccagaacatttctcacataaattttacaagcattgtattttctgtctgttatgttttgtttcctggtaaaagtgcacacagataacagcttgattgtgacacgtgcttgtgaacaataaatatttattatcacaacacttctttgttcccagcttggtgagtctggagagattttaggcaaattaagggcaatttgagcctggatctctcaaaacagtgctaagtagaattactgaagagatacttctcatttataccagaacaaaaattcttattttcacacatatatcaacatttgcttaattcatgctcaccagataatagtacaccatgttaaagaaaatctgtagctatagaactacatgttgaatggaaagcgatttattttgaagtcctgaaactgatgactaagacggaatgttatgcatctcagagcaccttgcattttagtaacatgtaaaaatatttttaattagtatgagtatcatttatcagcattgtctactcacaaagtatttagacacacagctatctacacacaaagtattttgcacatgtttaaaaatagccttgtggccttaattcttattaatatgaactctatatagtttatagagtttatattgtttatgtataatttatattgtttattcacaaatactctatctcatgagattgccataagaataaggcatatactgttgtatttccattgtggaaatttcagaaatacagactcaaaaagatagagttctcagaatcacacaagaggttcaaaacttgagcctttctgtctccaaatcctaagcctttctgtaataccttacttacctgcaatttagtaagacattatattaaaaatattttggttcatatgctctatgtacatcgagctataggatacaatgccagtcttcaaatagcacactagtcagtcagctaacaaatacatattgagtgcccactacatgccaaacactgttttaggctataacagtgaagataaataatccctcttcttactgagctgatattctaggaagataggatcaaaaatagaacacattaagacaattttaggtactgttaattgctgggaagatgtcttagtataatgtcatagaaagtggccactgtgggactctgttttagatagggaggtcagggaagggctctttgaagaaaatggcatgtgagttgatacccaattgaagagaagaaaggagtcatgctttgatctggggaaaagatggatccaagcaaaaggatagcaagtgcaaaagttcagatctgtgtgtatccaaagtaatggaggcctagtgtgaaaggggagcgtataaacagatgaggttggagagatggacaggggcccatcacataggccctaaaactttagcctaacaaaccaagatttatttcttacgcatgtcacattccaataagaattgtctggggtgagaggtttgctccaggaaggcaatgaagaccccaccatcctttcatcttgtgggaatatcatgtttaatatacgctctccaattctgccacacaataggaaagagacaggaggatcctagctgggagagttttatgagacaggcctggaagtgatgtccactacttctgcttacattccattgcccaaacttggtccacatgaaagatgaggaggatgggaaatgtaatttagctgtgtgcccatgaagaagataaaaaaaaaaaaaaaaacaggatattggtaagtgttagcattctttggtgcaggcttcatataataatttttaaaatgatctttcatgtacagtgagaagccactggacattttaagcagaagagcaacacaatctgattgttattctgaaggatcacttgcctgttgtgtggaagctaagctattatgagcattcagtcaaagagactagtcaggaggctaatgcagaactcagggtaaaattttagttgttcaattagattgtaacaaggtaaattaagaaaaattgtcagattttgaatacagttatttgtgggcacaggtagagtttactgacatattggttgcaagaatgagagaagtgtcaaaatgacttattttttcccttttttttttttgattgagcaattggtgtaatttattgagatatagtggcttagaggaaattagatttggggttggggtaggagagaccagagagtctctacttctatttgaacacactaaacttgaaatacctattagaccttcaagtgaagatatcaaataagaagttggatgtgtgaatctggagctcaggagagtaattcagttcggagatacaaattggtggtcattcattgaattgatggaatataaaaattcagaaatgtcattttataatatttgcaaggaactagagaaacaatgtttaaacatatatattttactgaatatgtataaaatataaaaaaattaagataaacattactttcaagaaaaactatttgttggaaaaatacagattaataaaaccatactatgaatttacatcacaatatgggtataatttcttgtttgcaaataatataaacatagtgcttttggctataataataagaaaaaatagcttttgtgtaaatcttcttaaatagggatagatggcactatataagcatatcatatattttctgattttagctcttagaaaaaataaaagccatggctcaaaatttaaagtgatatataggaaatcaagcttcttgatattgccactaaagcctagaaatattagacaccaatagaactaaacccaatcacattcaaaagaaatagttgaccttcaaaaagtttattccaattgggaaaacttattatgaaagtgttccactaaatgaaatgtaacacattttatttttagttcataaaagcctacttatatatttctaaatttttaattcagtgcatgaaaataactttaaaagcttcagtagctgaaattttttaaaaattgcatcaaaatattttaagagtatcttttcatcttgaactcagtatagcaggaaaatgttcactatctcatgggtggcttttgcaatgccaaaattggttcttccctagtatattttacttcatcttactaccagttttcacatgaattctttgagggatggagtgattttgcttctgttttttcactgggaattacttaatcctaaatcttgtggaaagataaggcaaagaaaaccaagagaactcattgaaatagaaaaagaaggcttagttatgttttagatatcatagcttttttttgtaagggactaaacagttcattttacctgtgttaactgatcaaccaagcagccagtcacgtatctgactttaatgatttgtcttgaagacacaagttttttaagtaattagttgctcaatataatcaccatttaaaagaagaaaaaagcattaccaaaactttaggcaaaaataaaaagaaagtgaaaataacataaacttcaccaatattaaagaggagttattgaaaattataaaactcttcctatgaagttgaaattgtgttattaatagcttctaataatcttcttctctgagtgtaaatacattgtctttaattaaaatcccagtgaggggcctttatagcatgacttaactcttccccagtgactatttttaaaagtgcgtatttggagtggataaaagagctctggatcacacaaatatcaagatcttccacactccccacaagagagcatatagacaaatgctgcctggagcaccataagagcaatttaatcaaggtcagtctcttatacaaaatgcttacaagttcatcccaacatttccttaaccaagaaaaaatagatttattacattgtaacattatattgcactcacccctcagaagcaaaccaaatccccacaaatgagaaacagttttaaggacacaatccttaacatggtattcaaggccctccttgatatattccacaaaccccaacatatcccccaaaaatcttacatgtgcactttctatcagtcaaacctcactcgattccccaacccatggctttgtctgccgtcttattccaccgtatctgtattttccaaatagtacacataccaagggctatttcataagatacatcttcctaacaaatgtcaatgatcttcttctgttttgatttgggcaagcacccagatacacacacccacatacacacacacacacacacacacacacacacactcactctacacccttcagatttccaccacactgctacacctccacagagcacttatcacattctgatgtagtattttgagttcattttacccattttaagtaggcaaaaagcctacttagaagtatagcacaagaactcactcaaaagagtaagtagtagtgaagcagatactggagtaggggtcagaagactactttgaaacccacttagcagaagcttaacttctctctctctatttctctccctcactctccctccctctctttttctctctcaacttgcttttattgatctgtaaaaccagtgtatcagaaattactttgtagtaggattatgaggcttaaattggtaatatatgagaatcctacgatatgaagcagatagaagcataaagcattattattattattatatactacttacaatgtacctcttatacagcaaatgttcaaaagtcatttttatattcctatcacattgaaaaaagaaagacatgaaatattgtgaaacaatagtaaatttacagtaagtccaggtccaattggaaatcaggcaaataaatcaaaggtctcaaaaatatatgagtttgttgatgtcaataaaataaatgttctctcatccacccttccattctatttggttgtcacaatagcacaaaaggacacctgagggttagaaaatgtaagaaataattctgatgtggatcaaggctcaaccgcctagaaatgaagatggtgtgttcccttgactgctctgcagcgcacttgctactaatcaggaggttctattcccgccaaaagggttaggatagattgaaaacatgatttatgatagaggcaaaaatatagataacaaaggtaaatgtgtcgtttgaatgctatttttttaagaaaagaaactgaagaaaatgtgaactcagaaaaagaatgttttcatagagcaaattattttacataccaactgtatgaagagtcagccctctgtatccatgggttctacatccatggattccacaaaccatggatcaaaaatatttgggaaaaaataaaaaataacagaacaacaataaaaatacaaattttaaaaacaatacagtataacaactattcatgtaacatttacagtatactaggtattataagtaacctagaaatgatttaaagtacacaggaggatgtgtaggtacatactgcaaatattacataagggacttgagcatctgtagattctagtatttgcaaaggatcctaaaccaatccccacagattatcagagatgacgatactgtatcatagcgtaaaataataattgatatttataataaagattctaagttattaatagttgtatgttctatattctttaattaggtggagatgcttatagtacttcataaaaatatttcatacaaaattatacaaaaatgaagtttcagtgctttcattatctagaaaatttactcttgtgaaaagaattatttgcagcaatatcagataaatgaaacattgagctaattaagcaaaatattttgtataatttctgtctaactatttaaggaaagtgcttaaagagtactttaaacaagatttcaagaagctgttagtgcctgcattctccttggaatagttaggaataagcaaaagagaagatgagactccaggacaaatgaacaccattattaaagatgtggaggaatggacatatgaggcctgttcataaaaacatagagaccaacgtggggaataataattaagagtaaataaggtgcccagaatgtaaagagaggcttaaaagtcatgccgagaaatgtagttgtaacagaaagtgagatagagccattgaaagcttctgatctagcagcaatcttatgaaagcattatttaaataacactttgttgtttttttttaattcttttttttattatactttaagttttagggtacaggtgcacaacgtgcaggtttgttacatatgtatacatgtggcatgttggcgtgctgcaccaatcaactcgtcatttaacattagatacatctcctaatgctatccccctcccctctccccccaccacacaacaggccctggtgtgtgatgttccccttcctgtgtccatgtgttctcattgttcaattcccacctatgagtgagaatatgcggtgtttggttttttctccttgcaatagtttgctgagaatgatagtttccagcttcatccatgtccctacaaaggacacgaactcatccttttttatggctgcatagtattccatggtgtatatgtgccacattttctttatccagtctatcattgttggacatttggcttggttccaagtctttgctattgtgaatagtgccacaataaacataagtgtgcatgtgtctttatagcagcatgatttataatcctttgggtatatacccagtaatgggatggctgggtcaaatggtatttctagttcaagatccctgaggaatcaccacactgacttccacaatggttgaactagtttacagtcccaccaacagtgtaaaagtgtccctatttctccacatcttctccagcacctgttgtttcctgactttttaatgattgccattctaactggtgtgagatggtatctccttgtggttttgatttgcatttctctaatggccagggatgatgagcattttttcatgtgtctgttggctgcataaatgtcttcttttgagaagtgtctgttcatatccttcgcccactttttgatggggctatttgtttttttcttgtagatttgtttgagttcattgtagattctgaatattagccctttgtcagatgagtagattgcaaaaatgttctcccattctgtaggttgcctgttcattctgattgtagtttcttttgctatgcagaagctcttcagtttaattagatctcatttgtcaattttggcttttgttgccattgcttttggtgttttagacatgaagtccttgcccatgcctatgtcttcaatggtattgcctaggttttcttctagggtttttatggttttaggtctgacatgtaagtctttaatccatctcgaattaatttttgtgtaaggtgtaaggaagggatccagtttcagctttctacatatggctagccagttttcccagcaccatttattaaatagggaattctttccccattgcttatttttgtcagatttgtcaaagatcagatggttgtagatatgcagcattatttctgagggctctgttctgttccattgttctatatctctgttttggtaccagtaccatgctgttttggttactgtagccttatagtatagtttgaactcaggtagcatacctccagctttgttcttttggcttaggattgacttggtgatgtgggctcttttttggttccatatgaactttaaagtagtcttttccaatcctgtgaaaaaagtcattggtagcttgatggggatggcattgaatctataaattaccttgggcagtatggccattttcatgatattgattcttcctacccatgagcatggaatgttcttctatttgtttgtatcctcttttatttccttgagcagtggtttgtagttctccttgaagaggtccttcacatcccttgtaagttggattcctaggtattttattctctttgaagcaattgtgaatgggagttcactcatgatttggttctgtttgtctgttattggtgtataagaatgcttgtgatttttacacattgattttgtatcctgagactttgctgaatttgcctatcagctttaggagattttgggctgagatgatggggttttaagaagagactgaattagtgagactgaagataaggaagccagtgagcaagttcttggtgtcacccagtaattaagttctgggatattattggaaaatgatccttccttatttaaatattcaccaatacatgaagcaatcttatgaaaagagttatcatgtagacagtacacaactgtgaaagaaaaatatcttgggccctgaaaatcactaagctaaatagaaaactcaagctggaaactgctcagggaaaacctgcctcccattctattcaaagtcatccctctgctcactgagatagatgcacattctgtttgcctcctttggaaagtcttatcagaaactcagaagaatgtaaccatttgtctcttacccacctgtgacctggaaggtctctccttgcttagagttgtccctgcctttctggatggaaccagtttacttcttacatatgttgattgatatctaatgtctccctaaaatgtataaaaccaagctatgccctgaccaccttgggcacaagttgtcaggacttcttgagactgtgtcatgggtgcacgtcctcaacctcagcgaaataaactttctaaattaactgagacctgtctcaaattttcagagttcacacaacatatatgaagacacaaaagttaattagtattgcttcaatgtctccagccctttactttcttgcctaccaaagaaaattctagcttagcccattctgtccttcccatcatgctctatttgggggattcagaagggttctttggaagcttttcatttgaataaatcaacagaagagtcagaagtctgcagctagggaagaggttttcaggggattctggaaaatgtagaaagcataaagtatgggaatatcaaagcaaacattttactggacaatgttaaacaggcaacaaaaactttattcaagactattgcaatacagccattttggagaatagtacagtggttcctcaaaaaactaaaaatagaattactatatcatctagcaataccactgctgggtatacacaaaaggaaatgaactctgttgaagggaagtctgcactcccatgttcactgcagcattattcacaatatccaagttgtggaaacaacctaatagttcactaatggataatcaatttttaaaatatgtcatatatacacaacaaaatactgtttagccttaaaagaaaaaaaaaacaggaaattctatcatttgtgatatggaagaaacttgaggacatttagttgaaataagccaggcacagaaagactaatgccatatgatctcacttatatgtgggatctaaacaggttggactcacagaggtaaagtgtagaatggtggctcctagaggctgggagttgaggggaggaagatcgggaaaggggagatgttgttgaatgggtacaaagttacagttagaaggaataagttctggatgttctatttcacagcaaggtgactacagttaatatattgtacattttaaaatagcttaaagtgaagattttagatattctcatcacaaataaacaataaatatttgaggtgatggatatgctaattactctgatttgatcattccacaatgtaacatgtgaacaacactttttttgttttgtttttgtttttgttatggagtttcactcttgttgcccaggctggagtgcaatggcgcaatcttggctcactgcaacctccgcctcctgggttcaaacaattctgcctcagcctcccaagtagctgggattacaggggtgtgccaccatgcccagctaatttttctatttttagtagagatgcagtttcaccatgttggccaggttggtcgtgaactcctggcctcaggtaatccacccatttcagcctcccacagtgctgggattacaggcatgagccaccacatccagcctgtaaacaacactttgtagcccataaatatatacaattattgtttgtcaattaaaaataaagctttacaaaaagaatattgcaataggagaaggaggcctgaactcagtgtaaatgcaattcttctgaaacaaacacctgggaagtttttaagagctgagacagaagggtcttagaccatctgtgtttgctagttggttttacccaaagagagagtcaacattctcataccttcatgacaggagatagttttacaactggaagcaaggtgcccaccaaagttaggttcctactctcccacagaaactgggatacagaaggtctaacttccttgacaattacatatcaaagagatggctgtagatctttgagaaagacaatcctgggtggtaaaactggcagaaggcttttaaaaaagttttgcatcacaaaggagcagtgaaacatttataattacaagttttctaaagtgaatgttttaccttagaaagggagatcaggggtctagaggtcggtcggaagcagcctatttaaacgtttgggggagctgaaggaaacactaaggctatcttggtcaaatgcaattgctttgaataaaaaaagtgaaaaaaaataatttaagagttattactggcataaacaaaagtagtgctattcataatgtttgagaaatacaagtggaaaacttgagtttttattgtaaaggaaaatttttaaatcccagggtatccaaactctttatgtaaaagggaagtttaagcttgaaggctgagtctccctcttccagatgactagctatgacaacattatgcatcagcccaagtaaaaggcctcaggcatctatgaagggccacccccacagatcatttctaagtaaattctcccataaacaaggacatcccaattgtaattttaggtctacaatctaagtctagctcctaaaactatagtctgttcaattccacactgaaaacgtccactacaagcttatcttcccaggtgcagaaaaacacaagatgagattgtctttgttcctctacctaactgatttttcctttactgccttttttctctttatttaccttatcttacataaaatggtagtctcacaaaaatgtaaccatttgccttactgcctacctgttcctcttcctacctacctgttcctcttcctgcaggtctccttccacccactttaatgaaatagataaatactaaacctcctgaaaagctccttggaatgacagccacagatatggcttatgattttcccagatgtgccctaaaactggcttagtaaacctcgaatgattgagatttttgtctctgttattcatttcagttaccattatgaaattattttttggttatagtttttctattacaatactacatggggactagactgtaagcctttttgagtgttacacactagtattaaaataccaactgccagaataaaaactagcacatccgattaaacttcgagtagcctcccaaaaatgatcctaactgaaaattattttccaaagaaagaaaactatcttgatctgagatatgttgataaaagaaatcaatacattagaaaaagtttttctaggaatccagaaaacaaaatttaataaatagtattaatattgtatcccaatgaagaaaatattgaaaatcttctttgtctgtggctattaaaatagctggtgagaagatatcccatttaaactatatcctctaccaacctctctgtttaatgaagatgtacaatattatatatttgcaagttcttagaaaagaagggaagatttttttaattccaggtacataaggttacatatgataaattgtttttttctagcaatgttggttttacactcacaatgtttcattaagagtttcacatgagagactgaagacaatccataattggcatagctgttttctttctccaacccagtccacaccaccctcacaccaacctatctgcttgcatgaatagacaaaaatgccaaaagatcctcaactcaggccaaattgcacgaaaaaaaaagttactgaagcaagaaagtactaaagattgtttcctctgaagcctttatgtgacgtccctaacctgcaaagtccccaacctctaaacttcccatattcttgctcttacagtgtcaaggaaatggactggactttttgcatatgaatgaatgggtaagagtaggaggggctgtaaaaggaggttccctcaaagtctccattaaatactcattaaagtcctcctctgtaaactgtaactccctcatcagacatcactgatcatctgttgggcttaatgacctaccaataaaaactaatttgatcttaattgaatctcaatgtgaatgtttttttagaaataaacaaattacaattttctatatataccaatttttctcattgctgccttttcagtgacttttcattaaacctcagatactggttcatcaaatgagtaacatgttatgggcttccttatttctctaactccctaattccttcttttcccatattttggggtactggaaaatttaggaatcaacaagcaataaccaaacaattccattaataaatgggcaaaggacattaacagacactcaaaaaaagacatacatgcagccaaaaaagatatgaaaaaaatgttcaacatcactaatcattagagaaatgcaattcaaaactacaatgggatatcatctcacaccagtcagaatggctattctttaaaagtcaaaaaataacagatgctggtgaagtggtggagaaaaggcaacacttatacactgctggtgggaatgtaaactaattcagccactatagaaaccagtttggagatttctgaaagaagttaaaacagagctgtcatttgacccaacaatcccattactgggtatgtatccaaacaaaaataaatcattctaatagaaggacacatgcactcatttgttcattgcagcactattcacaatagcaaagacatggcctcaacctaaatgcccaacaacagtggactgaataaagaaaatgtggtacatatacaccacaaaatactacacagtcataaaaagagtgagatcacatcccttgcagcaacgtggatggagccggaggcctttattctaagtgcattaacaaaggaacagaaaaccaaataccacatgttctcacttataagtggaagataagcactgagtacatatgaacacaaagagggaaataacagacaccagagcctatttgagagtggagtgtgggagaagggtgaggatcaaaaaactacctatcgggtactatgcttactacctgggtgatgaaataacctgtacaccaaatccttgtgacatacaatttacccttataacaaacttgtacaggtattgcttgaacttaaaagttagaagaaaaaaattaaattaaaaagaaaaagattctgaaacctgttggacagatttttaaaaactccttgaagttgctgcctaccccatggaaaagcaaaatgaatgcaagaacctttgtctttttcctcataataaacgaaatgtaaaagaggacaggtgtcatttcttcttgcaaggtaggaacttagaaaataagttggactagaatgtatttatttatgctgataatgttatctttacaatttccctgctttcagaaaaaccaaaagtccttatccgtccactcaatttaacttgtcaaatattcatgagtacctctagagaaaatatattctgctaaacactgtgggagatttaaaaaatagtgacacatacttgtgtcctaattgtagaaataagacatgtttacaattttatttcaaggctgaatgtgtaaagagaggcatataaaaagtcacatggatggttcaaagggaaaaatagcttccctccatttgaagagaaccattctgccagtctagttctgtgttaagatatgtgacttcaataagtttctttgaccagggagcataaaacaaaaaataagtgtatattaattattagtgatcagtttctgagttgagagaaagatctagagaacttggaccaaggggcaagcaagttttcatattgctctagaggacagaataaagatttggatctagaaaaaccttggaggccaatttcaaaggtttatagtgtcaaattggaaccaaccaaaatgtccaacaatgatagactggattaagaaaatgtgacacatatacaccatggaatactatgcagccataaaaaaggatgagttcatgtcctttgtagggacatggatgaagctggaaaccatcattctcagcaaactatcgcaaggacaaaaaaccaaacaccaaactatatataatatatattatatataaacaatatatattatatatattataaacagtatataatatatattatatataaatatatataaaaaagaacaaaaaatatatatatatatatataaaagaacaaaaaaaagaagtttaatagtggtaaattgtggacattgagggatatagtgtgaaacaaatacagggttgggtcatcaaatcagattcacagcgatcagagatcttacccagaatcaaaccatactaacaagtttaaagagaaagaaaatcatgagagaggggaaggatggagaagctgggatagccagtgtcactttcaggtcattttgtgatgcattagtatctgctctgatctagatttaacatgagctctaagtgttgcatgcaaagcactgcttacataaaagcgagccatcactgtcataaaatatcttaatttttttttttttttttttttagacggagtctcgctctgtcacccaggctggagtgaagtggcgcaatcttggctcactgcaaactccacctcccaggctcacgccgttctcctgcctcagcctcccaagtagctaggactacaggcgcccgccaccacgcctggctaattttttgtatttttagtagagacggggtttcaccgtgtcagccaggatggtatcgatctcctctcctcgtgatccgcctgcctcggcctcccaaagtgctgggattacaggggtgagccaccgcgctcggccaaaatatctgaattttattctcagttactagtttgtgtgatgttttccaggtagcctgccctataaattcacacatttccaggtttatttaacataagcaatcctagacagaccagatacatgtgcaaaagttctccacatgtaagaattctcccactattaaatagcagcagatctttctttagaatgtttacaagggtttttgatggatcttttcttccaagggcatcccacagcagggtgagaaaatgacttgtaggtctatggctaacatttttctttccagtccacactctgactttagtcactaatcccttggtacatatttctcaagcatcttttcattatttgtcttaaagtattttatacagatgaataagtctactaacatcctgacaactaccatgttttgaaacatccaatggggagtaggaatgtcctctacaaaggatgttaattgcaactatatgtttttcacaagtcttttgctgttctcttacaagtttgattactctttttcctctatcacctatagttatttgaaccattgatatgtgttgatggaggcaaacaaagttgagttcacttttatttctggccaattggtttccatatgtaacatttacagtctccaagttagcctcccaaagtattttctaatctttgtaaaattctatcggttaacaaggcatttgttatactatatagctgtgacagcaagattaaagtaacatttaacataccatgaaattagataaaaattatagtgtcattccctcccaaccattccctcccaatagaaatgatattttttccatgtgccacatgtttccaaatgccttaggaggttattgttcagaatattctagattccatctggtttttgatataaccatatccctgctaccagtgtgcaggtatttacagacacaggtttccatgtggcattttttaatatcctccttctatttcccataattatgacacagtgtgttcactatctgttttatccaaaccaattacaacctgaaagcaaactcactttgcatttgtgacacctaggtcattagaaaatgatgatagaagtctcatcgtccagtgacaacctgctataatttagaattagcatagtgttcccacagtgtaccttcccaacctggcttttgaccactcttggccactggcctttgaaaacatcagaatcaatagtgactagagtatctgataattcttctttgataagagtatgaaccctttcccagggttgccaatgattatagcagtccaatagaataattattcaattagtttatttacttagagctttagaatcccctcaaagtgatttttgtggccaacctcttagaaaagcactccctttagtgtcactgtttgggttatcaagtctttttcttaatgaggacaatcatcccagaacattatttcagactgacctacatatttatttcaaaatcaaagctatcccaaagccatctcttaaaatctctacagaacatctggtatggcatggccattggtgatcaagctaccacatatgttgctgccatttcacttgtatgggattggtaccatttggaaaaacagtctgaaatggaaaattttgtgtgccccatgaggctatcagttgtgtatattttacctgcaaacacagttccatcttactacacaataaggcttcccataaacatccttatgtacctccagaagggacttattagtaatataggattactgggttccatattagcttttttaaagtgcatttcatccacattcacatttgatatactcgaaggaacaaaacaagctctaatatacttgacaaatggcatcaatctgctttccatcatatccagatagctgttacagcaatatgtcaccatgacttaagcccacacggaattcttaagctctgctgtttggcattctctgccctataagattcatggtagtatttatctcaagtcaactgagaaataaccagaatggcaaattcagcttgtaaacaatgagctgaatgatagtagtagtcagctgtcagtaagttgattcatcaggaaatgctgtgtcacttcttttcttaaattacccaagtggagtccaatttctcttccttagacaaaacagatgaggaggtttctcccatacccaccattactcattgccagacttgagagagatagctaagagtattcttctcttgtccttattacattcctctctgggatcatgtcccacctctgtttgctgtgatacactccatttccatttataacctgccccctttatcctttttcccacggttgtgtttcttatctgaaatgtactgttgaaccataacactggcaataacaaaatctttcctaatgctgctccttggcctcactccctgggataacttgtcaacccataacatctctgccattcaacagaatctagaattactgacatgtccccattcatcaattttaagaatccacaacaataattaaagaatgtgttacagggtgttgctaacacctccttttccattgcttaagagaaatagggcaggatgaagggagactgcatcaaatgggaggcagaagtgccaaatttcagccaaattcagctttacccaggatcaaaatttattaacgtaatgactcaatttttatttttatttcattcaaagtttatgacgtttcttttcttaaataacttttttattgattatgaaataaatatgtgggattaggttaaaacattaaaaccaaattgacttatttcttctgacattctatagcagacataagtattctctgagatttttggaagaacttccttgtatgcagaagttccacagtagctgttaggagcaggagtaaaattatgactctgggagtttaatcactgcagtccttgccaggccttcacactgaagtgctggaaagctctgggcaaattacttactctctcagtgtttatttctccaactgaaaattaggttgatttctccaactgataattaggttgaactagtaattttttctgtattgtttgtgatattttaggaagatatcacccttgacggttttctatgacttaagaagttgaatcaagtttcaacttcttagcaagacatacaagttacttcaaaatctgtgacctcccctccaccgccaaaatgcttcattttaactcctattattccctttatgtacaccaatgtcagcaaactttttctgtaaaaaccgagtagcaaatattttcaccctggcagaccatatagtctccatcagaactacttaattattttaacacagagacagtttcattttcacactgctgataaagacattcctgagactgggcaatttacaaaagaaagaggtttattggacttacagttccacgtggttggggaggcctcacaatcatgacagaaggtgaaaggcatgtctcacatggtggtggcaagagacagaatgagagccaagcaaacgggtttccctttatcaaaccatcaggtctcgtgagattcattcactattaggagaacagcaaaggaaaggcctgccccccataattcaatcacctcccactggtttcctctcaggacacatgggaactgtgggagttacaattcaaaatgagatttgggtggggacacagccaaaccatatcagtcagctatagacaatacgtaaatgaaagagcatggctatgttctaaccaaactttctttatggacactgaaatatgcattttatataatttacatgtcacaaactactattctttttatttttttcaaccattttgtacagctcatgggtcttacaaaagcagtcagtgggctggatttagcccttgagccatagtctaccaatccctaatgtatactgtgcttacatcatgcaaaatgtctctccatttcctaaataattaaagtattttcaaggttcaatgccattgcacataaggattcctttgcctaaaacatcattatttccacaccctcattttttcctgacaaattcctacaggccaatcaaaggttgctcacctagtatccctccccaaatcttctgcaatctttctatctcaatatgacaggatcaaccattcagtgggttaaaccaaataccttactcacgcttgactatttctctcacatctcacatgcaattcatgagaaaaatcttcccagtactattccaaaatacatcccaaaacctacacttctccgtatgacagtctgagacaccatcatctctcccatagactgtttccaacatataagccagagtgctattcctgaaacatgcttcccaagctcccatctcaggacatttttcatttgctattgttcatgtcacaaacattcttcccagagatatttccaaaaatcattcacctgcttcaagtctttgtgaaaatggcaaaatttcagagacaatttctaaacactctctaaaaatttcaaactccaccactcccaaaattccatatcttctttcctggtttatttccttcttcacatttacagcatttgacatatgatatgttttactttttggtttatcatctgtatctctccaccagaatgaagtttcacatcaggaaattttgcctgttcgttcactgcagaatcttcaatgcctcaaacatcatctaccacttggtaagtttattcatcacttactatgttacagattctattacaggcaggctcactttgcctgaatcctcaatgtcaagtccttatttaacatctccgtgttctgaatgttccttcaaaattcatcattgcagagaaagacaactcttatacagtgtcgatgagaatgtagattagtacagccattgtggaaaacaatatggaggtttctcaaaaaactaaaaatagaactgccataaaatccagcagtctcaaaaatatgtaggtatttacccaaaggaaagaaaatcagtacatcaaagggattcccacatctgctgattatcgcagtactgttcacaattaccaagatatggaatcaatctaagtatccatcaacagatgtatggataaagaaaatgtggtgtatatatacacaaaggaatactattcagcaataaaaagggagtgaaactgtcatttgcagtaacatagatgtagccagatatcattgtgttaagggaaataagccaggtacacaatgaaaaatatcacatgtcctcactcatatgtgggagctaaaaatgttgatctcatggacatagagtaatagtaccatatgctgggaagggggtgggagaagacaggttgctcaatgggtacaaaaatacagttagacagaaggaatacgttctaatgtttcatagtaaagtagagtgaccatagttaataataattcattatatatttcacaacatctagaagatttgaaatgttcccagcacaaacaaatgataaatgtttgaggcgatgactatcctaattaccttgatcattacccattgtatgcatgtatcaaaatatcacacatttctcaaaaatgtataattattatatatcaataaaaaattcatcataataaaccctttaaaatcaaggaaaaacgtattcagatctgtcatgactctatgccaaaaactcacattggactctactccaaaattttccatgtgtaccatattacaattttagggttttattaagccttttgggaacatcagagacataaacaataggtgatttaaaatcaaaatgaaagtatataatgcattttaatgactttaagattaaaatattcatttctgttaccaactattacttttttagcatactctctattagaatctacaacttcaactcagatttttgctacattaaaccagtcttaagaaatatttttttacccaaatacaaaagtggtcaatcaaaccacccactcatttactacctcttgaggatacttttaaaaggctcagttagccaaaaagccacttttcttctagcaggatatatatagacattgaatctgaataaattactggactaaacctgcataggcaagtaacttagtgcttttatgtagcaaagtgtttgctatatattgtacaacgtatttgacaaaatcatttgattctgttagatgtgctcatcttgctatggcagacttcagatattacatcattgattacatcatcattacaatcactttaggtttgtctccaaccttgcctatttaattcctttgacccaaaatcaaaaaaataaaaacagaatattacaatgcaacgaagagggagaaattcaccaaatgtcagtatttagttactaaatttgataaatataaattattgatatatgagtaacaaaaattaatttttagtagtgatcagaagatataaaatcactaggaaatcttaactcaaaaaaatttccacataagattgaatctatcatatatctatttcagagcttttgttggtattgggcaatttgaactgctttaaacagcacaaaccctgtttttaggttagggccaaagctgcaactgacaaacatgaaaagaaaaagtccaagatatcatcacagtttatttgtgaaaattaccattatataaggataattctccataaacacaaaataaataaaaatttaataatcttactcatcactccttgttgagggataagttaatatatttaatgagcttggaacagtgtctagaatgtattaaactttaaataaatgttggttattgttgttttgcgcaatgagagtagtactaccagaaactggaaaacgcacaacctatatagtttgatattccaaggtaggttcttaaagccacagggtaaatacacatctttatagaatatcagttttaacttccacaagcaaatcaaattaatttaaaacttttaaattaaaataaatatggatatactatgcagttaaatacaacatgcaaattaatattttaaataataaactatatttaaaagaaattttcccattcatggaggagagtttcaggatgcatttacaaacctagctcaatctcttcctcttagggatattttggtaacaaaacaggctttgacaagcattgctttatgaagcaccctctttgtgcctatattaataaaaaaatagcatatgtctgccctcattctccatgtagaagagtaaatcttatcaccttgctctgtctagctcttcaaggaccaacatttttttcttgctgccttcttcaccaagggtatgtggaagcaaacctgagctaatccttgcatctacaattcttttactttgaacattgcagaactaaaatttactaatacctacctgaaaactcccaaaatgcatttgttttttaatatttgattaatagattataattaggaaagagtaagtaccatatatttgcatcttgatgaggatatttaaaaggaagaaatcaaaataatgatttctggtgtttttgagaagttctatagaatttagtgtttatatcttgattacaaagcctcttcataatttacaagttgtgtctcagctctgcctcccatttaaatctgattaatccagatgaccttgttctaacagcaggtgggttactgtgatttattttggggaattgctaatgagaaagaaaaaatgttaattataaaatatctgtgtcctaggcaaacaaaatataattttttgaggccacatatttgaggaattatatccaaatctggtatatttaagactttctacactgagttgaaaaatatcagaatatccacctctcacagaaagaatttaaaaatgaagtacctagttaatatcaaaccctgacaatgtgtactaggagaacaaataatttgtgaaattaacttataaccacctgatatttagacctaattgtttatatttgtattttctagatatacttgtgtatgtatatctatgtatacatatacacataataaacatgtatatacaaaaaattattaaacttgtaccaaaatattctagattaatgtaatatatttccaccaggtgaaactaataaataagctgaaatgagagaaaatatgtgggttttgctattttttctgattctaaatttcttgagtgaaatttacaaagtcagaatatattgccaaaaattatgacctagaaactatatttcagaatggttaatacagcagtcaaaacatgtgacatagaaagaacacagcattcttataccttttggatgctggtaaattttaatttttttttacttctacaatgattacattaataattgcttaataatgtcgttacactgtatatttatgttttacacatgcctttgtatgcacatcacattttacaattaaaaaggattacctgaaagaaaaagataaaagttgcaaaattatttactaacaccataaagagtccagtaagacacctagaaacgaaatcaacttccctataggtcactgtttttctgatcaatagcaattgctaatagtgtagagtaactaaataattaagatacttagggaaacatctaatagggaatatttgagttttgcatgaaaaaaacataaaagtattgaagaatttttttaaattctgaataaatagacatactgttggataggaagacacaatatagtaagcatatatatatagtaagcatatatatagtatatatgtatatatattgtgtatatatatggatgaatctatgagtatatatatataataaacccccaattcaacatcctatattttttatttgaattctaaaaataaatctgtttttacaatacataaactatatgtttatacttattctggtttttattataaaaaatttcaaagacacagaaaagtaagtttatttttatagggtgttttaaaataaacactaagcttaatacttagacttaacaatatgtaaccatatttgatttatttattcatttatgtatttgcttgctgtaataaattaagaatatcacagcatttctatcttaagtattttagtatgtatttcttaaaaaatgaaaatatgtttctgcataaccaccataaaagtcaatatctaacaaattaatattatctagttcatatttccttaactaccctaaaaatggcttttattgctcatttgttcacactagaattaagactgacatgtgccatttggttaggccttttaacatagacttcccctgccacttcaccacttcagacacacacacacacacacactttttcatttcttatcattgacatgttgaccaagatagttatgtcgaatctcccatattatgaactatctttgtggtttttctaaatgttttctcatggtcttgtttagcattttcttctttattctctgtatttcccaaaaaataaaagttagacataaaagcttgattagattcaggtttaatacttttgacaaaaatgtttaataggtgatgctgattctgcttatgaaattatagaggtacaaaatatctggttgtccactgcgagtgttgttatggttgatctttgggttcaggtggggagagcctgatccctccattgttcagttacatgttttccttttgcatccttaaagtattctgtaggtagtacttttccactatgcaaatattgagttcctcagcaacctttcacctaatggtttggcatacactgatgatctttgcctaattcaattactttgttatgaattacaaaaaaagtggtttttctaattgtattatttattccatagttattaatttccattcttcaaaaaatatatatttttgagataatttgtctacgctgaaatacatttccaattagaatgaaagaataaatgcttatttctttctttttaattagcaatgtatatgtctaaaaggtagtgtaatagtcacctctaccagtaacaaataaggttggtttttgtgttttctcttctctgatatcattatgtatccacgtgtttcaaagaattgtaactattattctttcagtgataaaactgtctcatctttttggccaagagagccccgcaggctggttcctgtgccgtgttgaaaaatacgtcattagtctttgaaagcttctttgctttctggcacagcaagatcttcctggctcaccttttacattcctttttacacacctggaaactgccatatctctaagaaaccttgttatttgtggagagccatatttagagaccacagtcagggtgctaaaagggttcattgctaagggtaatgcttcttcaatctccctttctagaacggtgctacaaaatataatttgttattagaaaaaaatcataggttcacatgagtattttcaatgcacgttgaacatgacagggttttcagttagattatttgttattatactgatttattttacccacattaaattaaaataatactattattaaaattaaaactacgaagtaaaattattagattgagtgaaaaaatatactttctaatccttctaacatagcagttcaaggtataataattaaaccatagtggtatgagtacagaattattaaatatagatcagtgaaagaaagttaacatttcagaaagatttaaaatgacattttgaattagtggtgaaatatgaacatccactaaatagtatgtgtacaaccagctacatgattggaaaaaaattgttaaattcttctgtcataacatacataaaaatattttttacttgaattcaaaagctaaagcaaaatcaaaagcattataataaaacacaggaaagatgctttcaatcagatagaaagaaatgccttgttaaacaagatgaaaagctagattttattaagggaaagattaatagacaaatacttgaaaaagacttgaaactagataaatacttgaaacaaaagtttcaaatacatgacattacgagaaatattcacaatacattatctagtgtatcatataccattagataatacaggaaaaactcctataaaccaattttataaggagaaaatgtcaattaaaaatgataagcatatgaatatgcaatttacagaaaaaatacaagtaaacatctgaaaagatgttcagcctaatatttaagaaaatgtaagttaaaataatcataagatcatttttggcaaaggtattatcaaaaattaaaattaaaatggttaaatgttagccaggatgtaggaaacagaaattcccagagttatggcaggagcataaattgggtcatcttttggggagggtagtatgttaaccaaccaaaatgttgaatctttatgacacaccagcttcatttctggctatctagccatagaaatacacatagttaaaaagattatgtgcaggaatatttattaaagcattgttcacaatacaaaattttgaataactttgtttatccactgatgtataagcagcttagaaatgtatggtatatttagaacataaggaaaatatatgtgtgccagtttcatatttatggcacagaatatgtatggtaagatctaatgtatttttcaaaacatatatgcaaaaatatgcaaataattgcatatgctatatataaagaaaggggtgaagacttgctctttgtcatatgtaaatatgaattgataacatctctgtagttatgtgacaaggaaagaacagctagcaacaggatatattttatagagaaaacaattttttgaaaaataacctaataagaacttaaaataaatggcaaaacccagaagacagatgttggtttatacaaagatttcagagaatgggtgatactgctgtgcatgacccagaagagtaacattccagagaagatgacagaacaaagcagagagaacgaatgatggtaagaaagagaaagatgaaagacgagaggatgatcagtcacaactttagtggtaacatggctaagaagtactttagataagaggaaatctctaaaatgagatttttagatgtttgcatagagcaaagaaatttttcctggagacgtacaactcatggcaaaaaggctgccctatgtgagttatgttatctataaatgctttatgtgagttatgttacctacataaaagctaaaataatactattaaaattaaaactactaagtaaaattattagactgagtgaaaaacatagatcttaattcttaaaccatatcacttcacagagcataaatgctccatgtgagttatgtttctgtaaaaataacagtggagaggttgtcgtaacctttggggaacaagacaaacttgtcacatgtgatgaagcccctagacacaaaggtggcagtaagaagtctcgagatcgcatcactgcactccagcctgacgacagagcgagactctgtctaaaaaaaataaaaataaataaatgcttttaaaaaaagctccaaggattcagagaaagcttaatgaaacctgtagagacagataaagcgtggggtagagtttttacatcattttgcccagctttcaatgacccagcataccccagacaacatctgaattgtatgtgcttctggattgcttgtgtttgggcaggggggttgtttgttttgctataaaaatgtgtttctaatgtatgaagagaagggagaaagaaagaaagctagggaggtagagaaaggaaaagaggaaggaagggaggtaaaaataaaagaagacagggattactatggcttgaatgattttgcgccctccagatttcatgttgaaagttaattctcagtgcaacagtatagagaggtgtggcctttgggaggtgattgagtcatgaggcctgtgccctcataaatggattaatgctgttataaaagggcttgacaagggggttcattttcttttcacccttccatctttacctccaggtgaggacacagccttctttctttccagaggaggtggcattaaggcatcatcttggaagctgagagtagccctccctagacaaccaaagctgccactgccttgatctcagacttcccagtttctagaactaagaaaaataaatttctgttcttcagaagttacatcatcccaggtattttgttataatagtacaaaaaggactgagacatagatatctagcactccttaatgaactaggagaaaagctatctgaataatgtctaataatcactatcttccttctactagttcctcctttaccacccctatttcatttaataatattgctgcttgctcagttgcttcaccttaaactttactattatgttttattcttcagtactacattattcttctccccaattagttgcaacatcctgatgaatcaacctcgcctaaaaataagtcatcttccacctgagaaaagcatcctcttcacctcagagcttcaagaagaaagtacatgtggtgcagaaaaagataagatattcatctaaccagccaaatcaggcataatcaactttggtagtgaaatagtgacagatggtgcaggctgttcaactgcatattcaattccattattccatctcttacatgcggcccctcttctcctttctgactgccactgtcctaactaaagtagcatcacttctcacctggacaaaagcaggtgcccaacttctggcatctgccactccattctgtgcagagattctagatgaatatttgtctcaatcatttgtaaggcactgaaatgacttgggctaatgtaagcagaaaaagaattgtgtacagaataccagaaggccctcagaatgagttggaaggctatagaacaaagctcaggaaattaagaaagatcaagtaacgccagggagggagaaatatagtcaaggtcatgtcacgagaagacttagggcagacacggccactggtgccaatacaatggatgatcagcagtaccttggctagatacactgttaacattatagatcgctgtatgtcactacatcatctcattaatccctcaagtcaaagaattacataggagtttctaattggctgaattaaggcgaagtgtctccttcttcaagtgggaaggataaatgtctgccctctatttggtttctacagtgggagacagaactccacttcagattaatacataatagagaattctccccaaattggaatggtaattgcattcttggtagccaaaaataataataagttttcactgcattcgtctttaaaggaaaccctaagccttgttacacctctttcaaactcattactgactacttattgccaactctataaaatctacatttctaaatataagtaacatctaggcaataatcaaaccatctcttgaattccctttctagacttctttctttgaattgattcttaacagaccattcccctattccattgtttctattatatagttcttcctgctggtaattatcttccttaattctacttttacaagcgttacaccaccttcaacattccctgaaatgcaaccttttccaacaattccttgtttcctgttaacgtctccttttccagaggtctgtaatcaattcttacgattttatgttgccttggcatccattttgaatatgtttacttttctcatactaaaagcagggctcagtcacccttggcagttttacagccccacccaggttcctcaatgtagtcagtccagatgtctgctttatacaaattcttcctggcaagcacctccctatggaacagctagatataacctactctactggccctgctgaccctcactgtcttcatggactgtgcagatataccacagtgaccgcctttcagtcacactgtgacctcctagagctcatgcctgcttgttttaaacttaccaattaaaactccttcaggaaacctttttggataatgccctggtccccagcaaagtcactgacccatgggcttctctctctctactccctctcccctggtgctgactgatctccaggcatgttgtttacccccagagcctgtaagtaataaaatctttatttctatcttgtgtccctcctaatcatttaaggggtgcttcattatcttaaagaccctaaatttaaagagtcccaatttataagatttaccttcctcccaaattatattttaattatttgtgtgtgtcctatctctccctctagattgcagtctctcaaagagcagaacatgatttatttttcacatttcttcaaacatttttcacataggtgcctaacaaatgctgagctgattgtgcaaatgtagcattcaaaagcaaatataaaacagaataattcacaagcagaaatggtttacagaattaccatggaacaaaaagacgaggatgatacaataagagaagatgagctctactttacaaaagctctttgcaaacacaaaagtctgagcataagtcattctttatgcatttacctaacaaaagtattcattttcaaaaagattcactatatcctttaaaaagtaaacttgctaggagtattaaaatgtcacttgatttgcaaaaatagttattttaaatatctattgtataaagaaagtgcacatgtacataaatacaaaggatgaaatcttttcatcaaactcctactcttccaaaaatactctctctggctctgtattctacgactaaacggagaagagggacaatgagctgatttagcaggcagctacaaatggtgattgaaggatctgaaaaaagatctattaaaagaggtcaagagaatgaatattattcagcattaagattaaaggttgatttgagacaatttaataacaatctataaatacatgaagggctctcacacagggaataatcaccagctgctctccaactccaatttggaccagaacaggagaaaaattatgttagataaaagaaagaattattgatagtaggaattatttaatactaaaatggatagctaaggagagttgtggactctcgtaccttgtaagagagctttaaaatgttgctgatgaaaacacacaacctgcctgtgggtaaaagaatgcactagataatctctcaagattatttccccatttctagaatcagaggttttaaatttatttctcttttagaaaattttacttttctttcaatttcttgtattgtctaaggaaaactgtgttgaaagaataattttaggatttggttatattctaattttcttccacatccatctttaagttctgccattttgatgataactttctggcatttatttgagtgttaaacttagggagaaggtgagcaagaatatatgcaatataaattttgaaacattttacagttagcttctcttatatttcatacccaagaggtttctagcaaagtatgactcttccacctccatagttattccttctcccgtgtcccagagctggtatatatttggatcagggaattccttctgctctgttgttacttcccacaagttgtctgtgacatttaatataggtcaagaaaattaatagaaggaggcataaaaataatgttgagatagctacaacacaactagcctctaagttaactgggttgcatattacactgaaatttccatttgttttcaagtatgtccaaatgatcagaggaaactaaccaagtatgttaaaaatctcagaatataaggaaaactagaatttttttcactaaatatctactgacaatacaatcaattagaggaagttaaagagttgttaaaacaattccactagtatattagttggagttctccagagaaacagatcaatagtgtacatgcagaaaggggacagaaagggagaggtttattttaaggaattggctcaagattgtgtggactggcaaatctgtataataggccagttggctggttacttgggcaagagttgatatcagagtattgggttacgaatctgtagcacaagccagtatgctggaaattcagcaggatttctgtgttacacaatcttgaggcacaattccttcttcaggaaaccttagttttcatcgtaacaacttcagctaattagatgagggccacccatattatttaaaaaaataaccatttttatttcaagtcagctacttgtagatgttaattacatctacaaaatactttcacagaaacatctagcctagtgtttgatcaaactgggcaccatagcctaaccaagctgacacataaaatttaacattcacaaatgggtttctcaattttaaatttagtaagaaggagttttttgctgatttctttgctcagaaatccctgtaatgaactcattcttgataataaatatgggcaatttgcaaataagtcaatttgcttattcattcatttagtcaacaaacgcttgttgagtattcccatgtcctagcaccattctaggcactaggaatgtagaaatagagaagaaaaataaggccctcaccatcatagaccttattacattcatcttgtttggagtacttatcactattcaacattatattgtatatctattagcttatttgtttattgatttacccccacaataatatcattttcaacaagttagggacattttctgttttatcattgctgtatgcccagcatacagaacaggtccaagtagataataggaaatgaagacgtgtgctaaatgaattcaagaatagcccagcatagcctttccatcttgaagatgataaaacaaagacccacagaggttgacttcttaaaagtcatacaattttagttattctaccaggaacagaccacaaatatctaggttcatatatcctctgataaaccacacatataaaggcacattcaacaaacatttataaaaactggtcaatgtatgaaaataatggtcccaacaaagaacaatcacactcatgaattagtccaagagtatactttattctttatcatcacccttcatgaaataatgtcagtttaggaaaggcatggtggctcatgcctgtaatcccagcgctttgggaggctgaggcgggtggatcacgaggtcaggagttcgagaccaacctggccaacatgttgaaaccccatctactaaaaacacaaaaaaatagctgggcgtggtggcaggcacctgtaatcccagctacttgggaggctgaggcaggagaatcgcttgaacccaggagatggaggttgcagtaagccaagattgcaccattgcactccagcctgagcaacagagcaagactgtctaaaaaaaaaaaaaaaaaaaaaaaaaaaaaaaaaaaaaaaaagaatgtcagtttgataactaaactattaaagtttagttcaattgctaaagctatctatctcagcattcctccgaaagtaacccgaccttcctactgaaatttcatttcatgtggctgaaatggaaccaggttccttttcctgggtgcaggaaaggagacacatgacacacctaggatgaatcactcagagcaccccagtcctcataaattggtttagagaaggcacatagcccaaggggaacccatcagaggccatctatgagagaaaggcccactcttcctctgaggccactaagtgtaaaaacccaaatgtgtgaagctgctggcagcaatctttttaattatgtggaagaagccagcctataaaggatgtcaagttattagagaggaaaacttaaagacagagaaagaaaaagatagaaacctaatgatatgacttaggggcctggatccagctgtgcctgaattttctatttttaattacttgggggcaattaatatatgtatgtttttattaagaacatttaatgagatgtgtcataaatatagttctacaaatgtaaactctatgaatgcagagatttttgtacattttgttcaccgctgtatcattagcacctagaatggtaccttagcttctgaaaggcattcaataaatttttgaaataataaatcccatgttcacgatgtgtacagcaccaggcttaaaacctgcaaagaaaatcaggccaagatttctggtagtgatgtaaattacaaagcccaaaagagttaccatgtgctgtgatacctgttatctcattaatcataaacacaggagatagtcgttattacaaatgaggaaattgagctcagagaggttaattaatttccttaaggtcatacagtaaatgatggagctgggcctgaagccctggtgacctgtctgactctactgtctgcatgtgtttcattcattaattacaatactattttattttgtaaaatattttgccagtgtcattagtcacttgacacacaacaaggaaaatttaaccaaaacctttgtaaataagaatttcaaagacctagaggtaaaacaacttttaccaaatcaagcagcaaggataggagagctgtaaatgaaatacaagattcaccacttatttagccctttgtgtcatatttcaaaacatcttctaaacactaatacaaaagaatacactgaaagtaaattacatacaaggaatatctgcaacatatctcatggaaccattcacagaatattagatttagaggctgggcgcagtgactcacacctgtaattctagcactttgggatgccaaggcaggtgggtcacctgagatcaggagttcaagaccagcctggccaacatagtaaaaccttgtctgtactaaatatacaaaaaaaaaaaattagccagatgtggtggaggacaccggtaatcccagctactcaggaggctgaggcaggagagttgcttgaacatgggaggcggaagttgcagtaagccgagctcgcacctctgtactccagcctggctgacagagcaagactccatctcaaaaaaaaaaaaaaaaattaggtaagaattagcaggtagttcttcccacagggttacacttaaatgtatgggtgtttaaagggtacttggtggccttgaatgtgattgtgtacaatttgccatcactcacattgtagaaatatgtttttctatgaccgatgacattgaaggcaatggttttgtttccttttcctgaaagatgatatctcagtatcaaatctgtccagttctgcttctgaaaatcatatagagcaacaggaataatgaaggagaaaaacagctacatttctagtaaaagtaggagatagagaaaacccaagattcattaagcatctgtaagcctgggcaatgactccctagaatggcagaattggctggggaacctgaaagagaactattagaaagtacaggggtggagaaggaagtacagaattcgcatatattagagagactgatggaaaattagggttgcagaggtgtttaaagatccaaaaacatcactaaaaatattcacccctagataaacagggccccacatgaatgggaaattctgtgggtacgtcagaaagtaaatggcaaaactaggaaacagaatatcaatacctagattctgggcaagtattgcttaatgaagaacccagcagaaaacaacctaagggagcagcaagggggctgcagggaattataggaagtgccaaagtcttgggtctggaagcgttcagaaattttgcacaaataactctttcaggaaggagtgttacactaagagaaaacttctagagaagccgctagatacgaagaacaggtttgctgaggtagcgagagcaataaagagacacaaattctggaagggtgctgccaaacaatttgtaaagtcaccttgtaagtcaaaggctgtgaggagatgtgggagagataaaactgaggttgggagtcttgctaaagcatactgggctcggagagtggctccccagaagaaaggactttgtttccagcccctgaccctggctccagaggagggaagccttgaattatgaaacctggaaagctcttttccaattcaacttcaccctaaaataatctcccatcaccagttcaggaaaatctgtttggtttaaactgcataacagaaaacaaatttggtttgtttccataccagcaaaggttgaaaataagtagctaaatttttcaacaagcaatgaaaactcaaaaattttgttttgaagcagattaagttataaacacacacacacacacacacatacacacacacacacacaacagacatagagggactcatagaagagaggcctagaaacaaaggatttgcagaactcaaaaaagaaattgaaaaaaaaaaaggactagataattttagaaacaaagacaaataagagctacaatgaacaacagacaccacagaaagattagtaattagagtataaaaaagaaatgtgaataaaatggaacatattagaaaagaagaaaggtttgaagagaagtggatagatatagaagagaagcaaagaagatccaacatgtatttgaagccctgggcagggggagcgggggccaagataatggaacaaagaaatatttgaaattttaattatttgtgacagttttttttaaatgagacataaaataaaaaacacatattgctaaatggtatactatgtatcagtgaaaacacccaggtcaacaccaagacaatccccacaaaaattattaaaaatcaaacataaaaaaaagaaagattatttggatattcaggcaactagatcaagacacttataaatgacagaaaaaaaagtggcatcagacttctcactgcaacaccagaaaacagtaaagaaacacctacaagttactcaaaaaaataaaatgtgaggcaagcattgtatttcaatctaagctcccctttaagtataaagacaatgatcttctgaacattaaaaaacccagggtatgtttctctaatttccctttctggggaatctactatgggataagcaccaggcaatcaagaaattattggagaaactttgctgaaagttgatggtgcacaataattacatttaacaataaaattgaggctaaaaatggggaagagtgctaaagaatagcatacaaatattagtatgatctagcaatataaaaataacacaaaataaaaatttaattaacacagagataagagaaaaaaagctaaattccttgattgtccataagttatgacctggaatattgatatttaaactcaaaaatctttagcgtatttgaaagcacaaaaatcaacactaagttaaagccattggtgaaaattagataatagaagagagaaaagggaaaggaaggaaaagtttccactctaaatgtattcttgatgataaacaatgtaaataaaggggattatttgtattatgtaagatattaatgtaaaagtaaccactaaaacaaattacaaactttcctaaatttccaagaattctaaaaatagaagaaaaaagcagatagcatcatgattgggaaaagcactctttcttttatatatttgcacaattacctatttatgaacatatatagaatgatattatagacctaggatcaaatattccagtcatatcaacaaatgtaaatgtggtgaactcatctaatatataaaaagattttcatattagcactcaaagtaaaatacaacctgataaggtacaaaagagaatcacctaaaacaaaatgactcagaagtattaaaattaaaggattggtagaaatttgcaaagaggctgttaaggactgaactgtgtttccccacaaaattagtatgttaaagtcctaactcccagtacctcaaaaggagactgtatttggagatagggcctttaaagaagtaattaaggtaaaatgacatcatttggggtaaacatgtatcctctatgatgtccttataagagaaaattaggacgtacatgcaaaaagggaagaccatgtgaagacacagggagaagagttcgatctacaagctaaggagagagatctcagaagaaaccaacaccttgatactggacttccagctttcaagattgtaaggaaaaatttctcttgtttaagacataccatttgcagtattcattacagcagaactagcaaactaatacgaagaccattgctctgacactcacaatatgaacaagccagataaactacaatttgtattatagtattttttaaatccatcagaactgaggatgcaaagagatacaaaataataaattttcttcttaggaaagaaaatattcagtttttgttccttcttagtagagctatagggtctacagagatacattccagacagaataaaaagaatagccaaatttttgatcaaacttttgatggccaagtatggcctggtatatgggttataatcactaggaataccaaacacaaagtgagtcttccctgctagcctactcttccaacagatctttgctgcatacacaggataaaaggctataggaagggcaggagggccgggggagatttcccctgaggttcacttgaacttcttcaagagtaaagcagcaggctagagaaagccatgagtaaggtacaactgctgaatgaaatcctttcaaagcactccaaaagataggaagagacagtagagaggagatagacatcccaaaatgcagaaagtagacagtagaaattgagaaaggataactccccatgacccaacaagctagaatccatggagtaagacaaacagggaactctcccctagttcaggaagttgactgggctgaatagcataaatagaatttcccagagaaagcaaagtcctgaacccatcttcagaatatttgtaaccaatggggaactaaatcaaggtaaagaggcaacacaacccagacccagcccagctacgggttagactgatttagccacacacatgtaatgttacaggagaatggagtggccttttttggaggtaaatatttacgagtttctaattttttttacacagtgttcagcatacaataaaataatcacaagatatgtgaaaaaagaagaaaatgagaggaaataatagaagatgtacagataatctagataatagaattatcagatcagacagggacagtaaaataaccatgataattttgctttttaacatttctattcttcaattgacaaataaaaattgtatatatttatcattacagcatgttgttctgaaatatgtatacgttgtggaatagctaaattaaactagttaacattgcattactttaaaacatagtagaaaagatgaaaatgcatagatgagaaatttcagtagataaattataaacaaaaaggaactaagttgagattccagaactaaattatgcaaaataataaataaaaaatgcattcaatgaagttaacagcacaccagacacagcggaagaaacatagcagagttcaagaagggtgaatagaaagtatccaatctaaaacagataaaaagagtgaaaaaactagagtacctgagatctgtaagacaatattaaacatttcaattggcatgtagttggaatctcagaagagagacattgtgacagaggaaatgttttaagtgataaccaaatatgtacaaattatatgaaaagattaagaaaactgtaataggtaattagtaaaacttataaaaactaaattaatggaaaaattttaaaagcagacagaagaaaaaaatatgaaacgaagaatcacagctgatttctgttaagtgacaaaagcaaggtacagaaaagcacgtaaaatatttacatgcttttgtaagaaaggacagaaggaaataagagaagatgatagatgattagatacatagacagacacatacatacatacatagaatggttgaatgtccttaaattggttataacttactctgtgtcagaaatagcatgaagaaaccataacatggtaacagtaatgtgatagtgattgaggatcacataaaatctttgtgagttcacaactagaaacaagctgtgacaagaatatcttgaaaagaaaaaaaaagaactcaactttaagaaataagatttaataacagaaatggtagcctttttccttaatgatatgcattggttttactactagtctctctaatgcccatgtaattaaataaatcaacagtttgatattttctcttcaaaagaacaatgaatagtatgctcgttttattaaatatgactttattgtgttattattacaaaaacaatatacattcataaaagaaacacaagaaataaagctaagtgaaagttaataataaaataattaacacccatggccatactaccaagatatcactgtggattatatcttcctataggtatgtaggtaggtaagtaggtatataggcaggtagatggatgatgagagataataatagataatagatggatggataactacaaatattaatatctatatagtgggacattgatgaagatagaaagatagaggttatctttctaaaactgaattatactacactacactacatctgattttaaataaataaaatcatgaagaatttcctttgcgaggacctcttgtcattttcagggaccaagacatcagcgttatcatttctgtaaaagcccactgaaatcagtaacaaaggtctccttctaaatgtgtgtgaattgctttcacttacaacttcaggaaagaaaacctgccaggacattcctaagagtaaaatccatgcttcttttcactaaatccaaaccattgaattagtgtagaccaagacaaacacaaaatatcacaataatgctttggggtatatacgcttcattaaagataatccactacaatatgacaaaacataaggtagctattctttctgcagcaacacagatgaagactttattttaaacccatagcagattgaatttttgcatgatgttttctttatactgccttgcttaatctggaaatacattaaaacactcatccacctgctgtgctggtttcagctgttgcaaattgatgattagcttcctcctgacaatattttcttctcacaaaattttaaaactgactgaaacaatgttaaaattctgaaatggaaaatacaacttatttaacactttaaaactattttacctttaaatcatttgaataagataaaactattaagattagaaaacattaattaggtgttaacttttaatgttttattcttctagatgaaattcataacattatcatcccaaagccaggtaaataggcataattattagctgcaattgcctccattaaatgccatcacaaaatgtgtaatgttggtagcagtctcagaatttgctggtaacttaaggcaagcttggttatcaaaaattcaaacagactttttactttctctgctatctgacttaaaggataagtattttcttttagtcaaatttaatttttgtatttaaaatttaatgagttgattaaaagaaaatcatgtagattaaaaaaaaattcttatatccagaaggttctaagcaagggttggcaaactatgacttacggacaattgcctctttttgtaaataaaatgttatcagagcacagccatactcattcatttctatattgtcattggcagattttactggacagcaaagttgagcaattgccaccaataatttatatctttcaagcctaaaatatactatctaaccctttaagaaaaggtttgccaattcttggattaaataaagagtttcaagccaactctgacccctatcacatcatactttttaatgtgttaagaaagagaaaaaataaaagaaggtataaaaacataacatggtctccagtttgaatcagttgctggattttgtttgttttaaactgcacctcagcattcagcatttcacttgtccctttaactgaccctgatctggtacgaattttcttcttagcactgaaatgtgctccatcacaaatttctgattaccattttgattaaaatatccaccatttttactgacagtatctcacacctgttcttatttttattcatatcctttgtatttcctacaacattaagactaaagaacattctaagatcatttatggttgaaaattatttccttatagaattctacaagttcctatgggtaggcagtcatagtggtcttggcaaactgaatatgccctaactgatgagcctccttgattactcatgctgactcacttgtatgagactcaaaatctttggattatcttacaaattttaatggggaagattttttttttttttttttgagatggagttttgctctgttgcccaggctggagtgtggtggtatgatctcagctcactgcaacctccacctccaggattcaagtgattttcctgcctcagcctcccaagtagctgggattacaggcatgcgccaccatgcacagctaattttgtatttttagtagagacggggtttctccatgttggtcaggctggttttgaactcccaacctcaggtgatccaccagccttggcctcccaaagtactgggattataggcatgagccaccgcaccgggcttgggaagaatattatgattgagtactcattgctattgtgagattaataagtagctgtagaagataaactagtcacacactgcattttttacatttcatttgacaacaaatttagaaaataactccaataagaataacagaacagaattagagaatgacagaaaaacaagtccaaattcacaaaaatccttcagagacattttttagtgaattctagttctgtgggttccaaaccttactacatactggatcacctaggaaatgtacacgacaaaataacctaaatacagtgggtgggctctccccataaaattctgattcagtagctctcttgtggtattctggggtatatagttttaacaaacatctcatgttgttatgatagatggatatggacagatatttggaaacatgatacagttgttttcaatactataacactaaggaatgatagtcatatctggttatttgtttgttcattcccaagcagcaatgttttgcaattagcttgtgtgagggttaattttatgtgtcaatttgactgggccatggggtgcccagatatttggtcaaaaattctgggtgcttctttgatggtgttttttaatgagattcacatttaagttggtagactgagtaaagcagatttcccttcatgatgtgggtggatctcatcaaatcagtggaagacccaaatagatgaaggatgactcttccctcggaaaaagagaacgttcctgcatgatggcttttaaatgaggatatcaactcttcctggttctacagcagcctttagacttgaacagggacattggctctacagattttggacttactagcctccatgatgatgtgagccagttccctataatatatcctttaggaatatagacaaatagataaatatcctattggttttgtttatctggagaacctcgactaatacactacggaaaagaggaaaatcaatccctctaaaagtctacaatcctactattacactgacctttaagtttaaaaaaaaaaaaaagaaggcccacaatctttcattgttattcagctttatcactgtcaagcccaatgatcctggacaattctcttggatcttgtattcttccattttctcacctgttaaatgttaaggatacccccctgtctacctcacagaattatgagggcatataccatataccttgaagaaagtaaaggagaaatatgagagtaaacatggctcattgagcacgcattcagttccactacctctgaagtgagaataatagcagcagggtatctttaaagaattataccattaaaaacaaagggaaatgaagaagagattataccagcaaaatttaagaagctggaaagcagaaggttcagtggtaaatgatttagccacacaagggaaagccaaatcctaaataagcatgtaaagttcatgtgtaacccaatttgcatggcagaattctcaaaaggttcaagactgagtgaaagtggaggtaaaattaggacaaaaaaatggaagatgaaaaaaaaaaaagcagaaggagtggttgacagttttaagacctaataagtcccagaacacttttaaccagataaccaccgctcccctcctccattagaaaaatggaagtttattctcaagaaaggaccttgggactaggggaccccaggcactatggaaggtgagattaccatataaaatcaagggaacatttcataccaaatattgcaagttccagctcaattctccaaatcatctcacaaaagactagcagctaagcttatactctatggacagataaatgaaagattctttatactgaatctgaccagaccaagagaaagaaacctcaagaagttccccaactaacatgccaatcagatacccaacagtgcattcatagtctcctacctcttccaagtacacagagcttgcagtcagcacattagcccctcagaaaacacctgtagaaagtctctaatgggaaaggcagacagaaacagagaacaaataaaactaggaataaccagcatcgatacagagagaaggaaagctttaaaaactataattaggtctatgatggatatgtaaagtggaatatgtttatataattaagtttctgattaacttccatcataatttcagagatttaacattccagtttttgaactatgaaaatattctgctcaagaacataataaaataacatcacaccattcaccataatacatcccttcataaactcagcagtatatatgtatttaattatctcacacaagcatgagactaatctgattgaacaatgaaagcaaggcaaaaaatgttctaaaggaagcattttctgttatactcaaagctaattccaattgggacatttgtttatgacacatatagggagaaatttgaatatacatatttgaatatatatgcagacacacctcatcttaatgcatttccctttattgcacttcacagatactacgtaaattacaaattgaaggttctttgtgaccctgtgtcaagcctattggtgccatttttccaacagcatgtgcttacttcatacctctgtgtcatattttggtaatttccacaatatttcaaacttcttcattattagtatacatgatatggtgatttgtgatcagtgagcggttgtgaccagggaatggttacagcaggccttggatgagacccagtgctgtgcaggtctcaggtctgacccagtgcagccgtagttgtggtggccacagcagtgcctgtgttactccaccctcagcattaggtggctcagaacagaaacaagggctccatttgtttgggggaaaaaaaagggaaaagaagaagagtctccacctggtaatccagagaattcttctgggttttgttcaagatcctcaaggtggtaccctctacaaatctgcaagaaccacagtgttacttggccttgggtacccctccaaagcaaatacaccttagatcacaatatccaagttctttcaaatatcttcaaagccttctcaagaaggatgggtataaacaagcccagatagtgaacattacaataaatactaaacacttcaatacccagatactgaggaacatcaacaagcataagcaccatccaggaaaacatgacctcaccaaatgaactaagcaaggcaccagggaccaatcctggagaaacagagatatttgacctttcagacagagaatgcaaaatagctatgttgaggaaactcaaagaaatttaagttaacagagaaaaggaattcagaatttgatcagatagatttaaccaagagactgaaataatttaaaagaaccgagcaaaaattttggagctgaaaaatgcacttgtcacactgaagaatgcatcggagtcttttaatagcagaattgatcaagcagaagaaagaattagtgagcttgaagacagactatctgaaaatacagtcagaagagacaaaaaaagaataaaaaacaataaagcacgtctacagaattttgaaaacagcctcaaaaaagcaaatctaagagctattggcattaaagaggaggtagagaaatatacgggtagaaagtttgttcaaagggataatatcagagaatttcccaaaactagaaaaagatattagtatccaaatgcaagaagcttatagaacacaaagcttctataatacaaaagcttctataacacaaaaatttgtgttatagacacaaatttaacccaaggaagatacctcaaggcatttaataatcaaactgccacagatcaagaagaaagaaaggattctaaaagcagcaagagaaaagaaacaaataacttacactggaactccaaaatatctggcagcagacttctcagtgaaagtttacagaccaggagagagtggcatggcatatataaaaaactgatggaaaaagattttttattctagaatatatctccagtgaagatatcctccaaacctgacagagaaataaagacgttaccaggcaaacaaaagctgaggaatttcatcaacatctgaccagtcctacaagaaatgctaaagggagtacttcgataagaaagaaaaggccattaatgagcaataaataatcacctgaaggtacaaaactcactgctaatagtaagcgtacagaaaaacacagactattataacagtgtaactgtggtgtgtaaactatttttatgctaagtagaaaggctaaacaatgaacaaaaaataactacaataactttaagacatgaacagtagaataagatataaatagaaacaacaaaaagtataaaagtggggggatgaagttaaggcatagagtctttattagttttctttcagcttgtttgtttatgcaaacagtgttaagtttttattaggttaaaataatgggttacaaaataaccaagcctcatggtaacctcaaatcaaaaaacataaaataggtacatgaaaaataaaaagcaagaaactaacatatcaccagagaaaactgtgtttactaaaggaagacaaaaaggaaagagaagactataaataaaccagaaaacaaataacaaaatggcaggagtaagtccttacttatcaataacaacatagaatgtaaatggactaaactggccagtcaaaagacctagactggctgaatggatgaaaaaaacaagacccagtgatgtgtttcccacaagaaacaaagttcacctataaagatacacgtagactgaaaataaagagttggaaaaatatattccatgccaatggaaaccaaaaaacagcaggggtggctttacttatattagacaaaatagatttcaagacaaaaactataaaaaaagataaagaaggtcactatatcgtgataaaggggtcaattcagaaagaggatataacaattttaaatatatatgcacccaacactggagtgcccagatatataaagaaaatattattagagctaaagagagagataggccccaatacagtaatagctggagactttaacacctcactttcagcattggacacatcttccagacagaaagctaatcaagaaacattggacttaatctatactataggccaaatggatctaataagtatttacagaatattttagccaaaagctgcagaatctacattcttttcctcagcacatgaattattctcaaggatagatcatatattaggtcaaaaaacaagtcctaaaacactcaaaaaatctaaaataatatcaagcattttctctgtccacagtggaataaactaaaaattaataacaggagaaattttgaaaactgtacaaatacaaggaattaaacaatatgctcttgaataaccagtgagttgagagaaattaagagggaaattgaaaaatttttgaaacaaatgataatggaaacacaacatgccaaaacctatgggatacagcaaaaacaatactaaaagtttatatctgtaattgtctacatcaaaaaagaataaaaacttaaaataaacaatctaatgatgcctcttaaaggactagaaaagcaagagcaaaccaaacccaaaacttgtagaataaaataataaagataacagcagaaataaatgaattttaaatgaagaaaacaatacaaaagatcaatgaaacaaaaaagttgtttttttgaaaaggtaaacaaatttgacaaacatttaagccagactaagaaaaaaaagagagaagacggaaatcaataaaatcagaaattaaaagggagacattacaactgatactgcagaaattcgtatgccaataaattgaaaacttagaagaaatgaacaaattcatagagacatacaacctcccaagattgaaccaaaaaaaatctaaaacctaagattgaagtcataataaaaggaaaagaaaagcccaggatccaatggtttcactgctgaattctacctaacattttaaagaggaactgataccaatcctactgaaactattacaaaaaatagagaacagaatattcattctgtgaggccagtactaccctgatacaaaaccagacaaagacacgtcaaaagaagaaaaatacagaccaatatctctgatgaatattgatgaaaaaatcttgaacaaaatactagcaaagcaaattcaacagtacattaaaagatcattgattgtgaccaagtcatatttatccctgggatgcaaggatggttcaacatacacaaattaatcaatgtgatactcatatcaacagaatgaaaaaactatatgatcatttcaactgatgctgaaaaagcatttgatataacttgacaccttttcatgataaaaaaaaatctaaaaaaactaggtatagaaggaatataacgtaataaaagccatatacaatagacccacagctagtgtaatactgaatagggaaaaactgaaagcctttcccctaagatctggaacatgacaaggatgcctactttcaccactgttattcaacatagtactggaagtcttagctagagcaatcggacaagaaagaaataaaggacattgaaattggaatggaagaagtcaaattatccttgtttgcagataacatgatgttatatttggaaaaacctagactccacacacaaaaaaaatttagtactgataaacaaattcaataaagttgtaaaatataaaatcaacatatgaaaatcagtagcatttctatatgccaagagtgagcaatctgaaaacgagatttaaaaagtaatcccatttacaatagccacaaataaaattgtatacataggacttgatttaatcaaaaaagtgaaaaatctctacaataaaaattataaaacactgataaacaaaattgaagaaaacatcaaaaaagaaaaatattccatgtttatggattggaataattaatattgttaaattgcccatactacccaaagcaatctacaaattcaatgtaatccctatcaaaataacaataaaattctccacagaaatacaaaatacaattctaaaatttatatggaaacataaaagacccagaatacccaaagcattctgaacaaaaagaacaaaacaggaggaatcacattacctgacttcaaattatactatagagctatagtaaccaaagtggcatgatactggtataaaaacagacacataaaccaatggaatagaatagagaacccagaaataaattcacacacctacagtgaattcatttttgacaaagttaccaaaagcaaaaaagacagtctcttcaataaatgatgctgggaaaactggatatctatatgtagaagaatgaaactagacccctatctcttgccatataccaaaatcaaataaaaaagacttaaatctaatacctcaaactatgaaactactacaataaaaaattttggaaaatctccaggacattggtctgggcaaaaatctgagcaatacccccacaagcacaggcaaccaaaacaaaattggagaaatgggattacatcaagttaaaaagcttctgcacagcagagaatacaatcatgaaagtgaagagacaacccacagaatgggagaaaatatcttcgaattatccatctgacaagaatgtgtaaagaactcaaacaactctacatgaaaacaatctaataatctgatcaaaaaatgggcaaaagatctgaacagacatttctcaaaagaaggcttaaaaatgcaaaacagacataaaaaggtactcaatattattggtcatcagaaaaatgcaaatcaaaactacaatcatctcaccctagttaaaatggcttacatccaaaagacaggcaataacaagtgctggcaaagatgtagagaaaaggaaacctttgtacactcttggtgaggatgttaaatcagtacaaccattatggataacatttggagattcctcaaaaaaaccctaaaaatcgagctaccatatgatctagcaatttcactactgggtatatacctgaaagaaaggaaatcagtatattgaagagatatctgcactcccatgtttgttgtagcactgttcacaatagctaagatttggaagcaacctaagtgtccatcaacagcttaatgaatagagaaaatgtgggtacataaacatgatggagtactattcagccacaaaaaagaatgagatccattcatttgcaacaacatggttggaaccggagatcattatgttatgtgaaataacccagtcacagaaagacaacatcgcatgtatcacttatttgtgggatctaaaaatcaaacaattgaactcatggacatagagagtagaaggatggttaccagaggttgggaggggcagtggggggctgcaggggaggtggggatggttaacaggttaaaaaaatgttcagaaagaatgaatgacatgctatgtgatctcacttcaaggtttactatagtcaataatagctgaactgtacatttttgaataactaaaagagtgcaactggattgttgataacacaaaggataaatgcttgaggggatggataccatattctacatgatgtgcttgtttcacattccatgcctgtatcaaaatatttcatgtaccatgcaaatacatataactactgtgtattcacagattttatatatgtgtgtatacatatgtatatatggcacagagcaagttgaagaagaaagagatgtctctttgcaagtacaatatctttattacaaattttaccaaaggtgtatcattatacaaagacattgttagggctctctcagagttttgaaaggggtccatgcaggggcctatagattaagcttcactgatctgattttgtcatgtcagtttctgtttatacttgcaactataaagaaaataatgacttttggttgaagaaaatgtggagaaggaacagagaggcatatttttaaattagtagcaatcatattggtagcattagcattgctattttaagactgctgtatgagtgttgtggattaaagtaaatgagtaatgatggaaaatttgtatcatattatcttccataggtcctgaagagccaggattctcagtgtagaagagagtagatacaggtgtaataccgaagccagccaataaataatcctatcattctgattttaatttggaagtgtcagtaagaactcataagtatttcatctttaaaatattatctatgaatatactcttagttctatctaccaaggaggcctgaaaacaatgaccaatctaagagcaaaagtcatcccttaagcctagattgtgagcttgaaataccattttccactaaatgaattcagggattcttagataacaaatgtaaaaggtatatatctaagacttttatcataccaaatagtaaaaaagctaccagacactaatagggtcatgttaaggcagtcagagggtcatgttaaggcagtcagaagctcatgttaagaaatttctactggccaaaatgagacaattagtctttaaaaagactaaaactgaaatgaatttaaatctgtcaaatatgcctaaatatgagattatcatattaaaatataaaattaattatctttgaaaaataacagaaaatctatttgttatcttgaagacaaaataaaaggaaagaatcaaaacagatcctatctatcctatctgactataaaactgggtaactaaatagtagatgagggtaaacatcctaagagtatttcaactacaaataaaaaagacaaaataaaatgtcatcatttttcacacaccaataaattaatatgtctaagctttgagctgtttatactgtatttctaaaaacagaaccagacatcgttatgtgcctcctgatgaaagaacaggatacactacatgcagttgtgccaaaacaatcaaacgtaagtctgatccagcctttagaaccagccacgaatttgtgggaaattcagaggacagaaaaaacatgttgagcacttacatgagtttacaactttaaaaatccagtctgtgagaaactctgtaggttcaacactcctgattatttaacataaaaagtgaaaagaaaaaaaaaatggaagcgaaacttttagattaaaagaaaatgtattttttttttattaagaacagacaagactcatctatagcattaaggatatgcagttgggtgataaaaccgaaaagcaacaaaaaaagattactataaaaatcaggataaactccaaatagatactttaaaattctaaaatcataaacaaagtaaattccaaatgggtaaatacctaattacagtttttaaaatgtctagcacgttgtgaaaaaaattatgataaggtgctaggaaaagatttctgtacgatatgagaataatatcattttcttaaataagccaaccaaagaacaatacaataaatgaaggcgataaatttgactcttatcaaaattaagtatgttcaccagtcattacacaccataaagtttaatgataagccatatccttagtatttgcaatgtgtaaaagcttggtatccatgatataaaaagaatagttataaagcaataagtttttttaaatataaaaataggcaaaggttaagaagaggcgatttacagagaagaacacacatggcatataagctacatgaaaagatgctcaacagtgctggtaatcagtgagataacatacatataacattccatattcaccagaatggcaaaaacaaaattttgataatacatatcttggcagggttgtcctaaaacaagtgctatagaaaaagtacattagaaccaccactttagagaataactagataattatccagcaatatctagcaaaagttgtgattagaacaaggcaaataaggagtttctggaatgccaacatgttatttttcttgacgtgggtgttaattttgtgatagtcattgaaatgtacattcatttttgtgtaccattcaatattgctctacttcattattttaaaaagattttaattaaacagaaatctattagaggtattcatgaggaaaatgttctctttccttctccttttctttctcccttggattcaggaagctgtagctagagctgcaatggccatgttgcgaccatgaaaaaaaggccaagagatctgcaaagaaatgagccctgacttattccactgctgaactaatatcagcaattgcctgccttgaacgtcttgttatgtgatcaaagtaagtcgtcatttgttaaaaaggaagagatggatgagggtaaagtagtgtggtagaatttagtgcttttggtaacatacaatgagattcttgtatgtcagttttcccatcagggtaaaataaggataacaataactgatttatagggccattaaaaagattaaataagaaaaaagtaagttaaatatgaagcatagtgcctgacatatgataggcaatgacagtgttaatttctattactctaataacaccaattggaaaacaggagaccttaaatatcagtcattcacaaatgaaatgtttcgtactgtttctgagttgttttctgttttggtttagtatccttgatattggtgaacacagctaaatgctaaatgtatgtggatatgggggaggtggggatgttccctgaggatacttaaattttacgtcatatgcttcaaatcagggatccagtctctatcagtctttacttacgctgtactgtgatagaggaaaaggcaaacattaaacatgaatgtactacactaagatgtcttaataaatttctaaattatgactttcctatttgtcttacccttatgcaatctgttaccacacagatggatgaacataaagctgatttattctctgtcaatttttcatatcctttaagagttctcctgattttagatattctcatttaaattttttgaagagtttctcctaactcaaagccagatgttaatgtttatagaataagaattgcttaaattttttctcaaactgaggtctcttgacctaaagtaaaagcatgattttactgaatggtttgggcattttttagttgcctaagtatgcatgatcttcatttcctttctgttttcagctcttctgtttctcagcagtttcttcttccttgaagaacttggagtgacattagctaaagaagtgaacaaaacctcccctcacttatatttcacgaactgtctgctgagcagagtgaaagaggtaactgtgatgctacatgttctagtggaagttcagtgcagttatagttgaacaagaactcaacagaacaaaaccatcattttgttccatcggatagtctttgatattccccactgtatcatattgatgaatgccaaatgactcccaaacttgccctaagaccttcactgacctttcaatttctaactgtattgtgaagcactttagggggtcttgacttcatgctttgtcagactagctcttttcgtgaatgaagttcatgcatatggcagtacaatagacactattaagtcgcccagatgatatatcagagatgcatttttaaaggattgttaaaggtaagagatattatacatataagaagagaccatctccttgatccataggacagaagttctttagaaagacaactaagccatgaatacattccaacatcaaaacccaagagctaatcctgtggaaaattataaaaataaaagactgatgggaaaaactggtaggaactgctttcattgacaatagcaggtatgtgaaccagaagacacattatcagagaatacacacacacacacccctccttcatgttcctatacactccacacattagattctgaaaagctattcattagaaaatcccatgtttgttaagttcaaagtaacactatgcaaaagacttgaaaatattagcagatttaatatctttttactgtgaattacgaatgcattgaaataattaagagatcttaactagatattccaccagcacaccaccataattaatggaggctagaacatgtctattaaatcccctggaaaaaaggttttcagtttcctgatctacaatttgtccattgttctgcccaaatccttcaggttccttcaaggctaggattgtccctactttactcttggcctcaattgccaagagactaatgcccatggctcttgacaaagaaaacaatcatttaaaggtatttaacctaatcgagagtcgtgagaatggagccaactacacagccatatatgaagtctgctaaaaacagaacaaatgggcaagtgctcaggtcctcaccaaagcaaagccttaaatgatgaagtcaaatataatctgggagaatatcagaatacattacttttgaaagaaaagtctaagaattataaacatgaaggaaaaacggggagaaaggtgcaagaattacattgactactacacaaaagactcaaagggccctaatatgactgtcatgtaggttcacataaattctacacatatctctgattattactttcctctaggtcaagagaccccagttagcaaaacacttaagcaattcttatttcataaacattaacatctggctttgagttagaagaaattctttcaaacatttaaatgagaatatttaaaatattctgggtgcactttttcattagaggctcccacaaaattgccacaaacaatatttaactgctttgttttaaattttgaaactcttgtaaaaatatttttacacagaattgtaagattttttaatataccccaaagatatttgcatttttgttgtttcatttaacttggtttaaaatttaaagtaatacatcattttttaaaaagcaaaaaagtcaaacattatgaatggtataattttactttgtgaaattttaaaaattgtatacagataatacattgtggaaggatacaaaagaaactgccaatagtagcgctctaatagtggctgttaaacaaggtttgatggctcaggaaaactcacagaacccacaatgacaatgcttacaagtttacagggtgtattttgcaggaaaaggatataacataacaatgacagtaagaaagactatgcatgtcagacgaaggctgtctctcttgcatcaggaaccaccaatgcgtggttcctgactggaaccagagagcataaaatggagtctccaatgaggtttttttcttttttcctttgctattcacataggcatagtcctactatataatcagcatcaatagcagaggcctccgggggtctcactgagactaggtgccaattgttagtctcactgttatcaacagtgctgacaagttgatactcaccactgaaaaactctgtggaccacatttacaaagtaactatcttcaacagcatgctccatgccttgtccaggagccagtgcagcacgggaacatttcttatttcagcaggacacctcaggctaattccagacacactggatgaacccccacacctcaagtagtttctttggtgaagaaaattcaagagtgttgaccagtggcatgattcagcttttccttttatactttgttttactgcttagagcttcagtactttaagtatctttcttttaaaaaaacagttggcatatacattatcagataccagccactctgagcagaactggaaattagtagttgtaagtaaaatttacctacaattgctattaaaaaagttagacgagtaaagggcaagactcctctatacttggtaacctaacaattaaaaacaagaaagaagaactaaatgtcattttatcaacatttaactttagtctttctctattagaaaaaccatacctggcccaggaatggagcacagatgcactttatagcagatcatttaatccagaatgagatgatgattctctacaaagcatatcatttgctccaaacactaaacagcagaataataattaaggcccattcaaaagtctggcacttccagccctcagttctttcttctctataaactggagctcaaatacaattttataaatcccattaacaataatgtttcacagtgaggagaattatgtgtcccagccacaacctcagggataaggcggaattcaaaaggaagagaagttaaagcttgataggaaataataatgacaaggtcacataaaagctaccctaattcttacctaatggattccacacataatttacagctaaaagatgaagctgagagggaatcatgaatttggccaaacatgaaagactaaaatttttagtcaactaataggcatttaaggagtatataataaatgcccaagagcatcttggccctttccctcaataaatttacaaacaagcagtatcatctaggaacttcaacttgtactgtgcttgtcttgtccttcaaacacaagaagagtttgtgtcactgttaaaacactggtttcagcctgggtctcaagttgaatgaaatcctagtttttattgaagtatcaaagacaagtgcatcagtatcaaatgagaaaggaaagaagtacagagcaaatatacagggaagtgtgaaggaattactgggcagcactgagtacccatttcagatcatgaatttaaaatgagaccatcatacttgtgtgttttcttaagccatctttacacttgaatgcagaatgagttgggtgcgtaattgggttcagccagggttgtttttttgccaagtgtataaatgaaaagaagatggtcaaggaagttaagggtgattgcacagggttgattattacaatatggcaatgaatctgaggcagaggcatgagataatgacagagatggtggggttttctatgtagaagcaatagtttgttcaattctacctaggtaaagagatgaaggcacttcactttaaccccctatctccagacaacgtgttcaagtcctctgccctctgttcagaggaatttgcccagagattaaatatagatgcatgtggtccacattgatgaagatttggcaatgggtcttttttattattgtccctgctctctacagtgatggtctttattactttctgtccctccacttcttccattccagtctgagttctcttctgtctctccattcccatccccagtctcaatcttttacagtttttgaaagaagaaaacaaaaaaaagtaataaacatatgtgtgcctgtgtcattatagtacaatgatttataatcctttgggtatatacccaataatggaattgctcagtgaaatggtatttctagttctggatccttaaggaatcgccacactgtcttccacaatggttgaactaatttacactcccaccaacaatgtaaaagcagcactgttcacaatagcaaagactttgaaccaacccaaatgctcatcaatgatagactggataaagaaaatgtggcacatatacaccacggaatactatgcagccataaaaaaggatgagttcatgtcctttgcagggacatggatgattctggaaaccatcattctcagcaaagtatcacaagaacagaaaaccaaacgccgcatgttctcactcataagtgggagttgaacaatgagaacacatggacacagggaggcgaacattacacactggggcctgtcaggggtgggggtctaggggagggatagcattaggagaaatacctaatgtagatgacgagggttgatgggtgcagcaaaccaccatggcgtgtgtatacctatgtaacaaacctgcacattctgcacatgtaccccagaagttaaagtataataaataaaaaaaacaccctcagcaaatacacatgaaaaaatttatgactctgtttttcttcctccttttattgttattctttttccttcccttccattccactcctttcctgagaattgaaatattaaaatcattaggtgggacatctaggtaggcatctgtgctggaagtatggagaaggggtagtcatagtgactcagagaagggtggcaaactctaagcaaaatgaggagggtattcatgtgggggcctctggtaccccccacatgaatttctgaaaaacttacatttctaataaatttatctttgttaatgagatagacataaatttatatatgtagatagagatatcctctgtcaagaacaatgccccacccaacataaatcactaaccaaaagtttccatagatggacttatatacacagcacatatcactgaggaaatgtgtacttaagatgaaaatagaaggtatggcagttttccaaagatagcagtcccctcaccactgactgcttaatggactattaaataattccagtctttaccactgtctctctaagaacatcaaagggaccttaattcataatacacagcacatcttaaatccctcttttctctcctctccaactcttgtctttgccacagctgatgctgagcctcactctctcaactctccacctttctaggtgccccaccttgcttgacttctgttttctgttttttgtttgtttgtttgtttgtttttggcaagatcagattctcacatgatggaggagtcagaaaaggtgagccaagaaagaccaaataaattccctatttctctttactgggctagaagaggtgtggtggctatgtgtagactacaaacacttatactttaacaaatattgtcacactgacacttttccttttggccgcactaaatagggatgctccctttaccaaggaaaatcaatctgtgccctcagctaggaaggtaagactggttgtctactaggtaaaatcaagaaagcctcaagaccttccttaggccatcttaaactgttctgccaggatcagcttaactatgcttaactgttccttaaccaattaaataattcttgcccttaatgtctcttgaccaatggagaaggttaactttggttcatatccacccagtgctacttctcttctttccttccccccaaaacccaaaactaatattagccatatgtttcagtaagctctccccaatccgagactctctgtggacctaccatagccagaaacagccagaactgtctctctgaattaaagcttgggatttatataaatggccctagatactgccctctggggaactttaagtggcaacctacatgctatctgaaacagaagcccaacatctacctctctggatgggtcttgcctctggaagttggcagctggagcccagcatgaattcacagacagagggagctttctcctgtgtcttcaaaggaaaatcccaagcagaatcaagtgagcagccacagcagcagttctgtctactgtaggatgcttcctactcaatcatagccaggtgtgattttatatgatagaagtatctctttcttttaagccctttgttacaggaaggaacacagtgtggttgttttcatcttcaggcacccttaaaaggtaaatttgaatccaaatcaaatagaaaagataatccatgaatcttactacagagttggaatttaacaataatgctaacacttattcaccacttgttatgtacctgacactgttctagtcctttgtatatattttaattttatttaatacaaaactccatgaggtaggaactaccattatctctctttgaaaatgaggaaactgaaggtcaacaagtaactactaatgtatctggcactgtatctcaaacccaaatgcttaatggctacattatactacctgtcccctagtatatgtgaatggggcaaagagctgaaagggatatccctgtcctctcatccagtaggagtgaatgtgaaaagagagagggagctaaaatcgtggcagaaaggacaaattataaggggaggtggtcctgaatagccactgagtgatgacagagagcaatgttgaagaaaatgatgctaagactaagtaacatatagtcatagatccatacctcccaggacatccagcagataatgaaaatgcaggctccccaggcaccttaaaagatcccaaaagagacagaggttacacaaaagtcacaccttcctaattaaaagtacttaggacaagagacaaatggtccaggtcaagaaacccaatcaacacagaaaggatgttcggaagctatgtgctgaggactcagagcattctagtcccttgtacacagtaaaggggaagcatgggtgggcaggaaaacgcttatcctcagatgtgtcggcagcaaactttttactaaaagaagaccccattcaagataaaacataattgaaaaatatttaaccaccctctgattccagcaaaatagcttgccagaagcattttttcaaattgcatccatttttatgactaagtggggttcttggcagcagtcctatgtgattcccaagactatgcttagctgcttattccttccatgcaaaagcagccctttaatgcagtcaccaccacatccttacaactgtatgtcatccctctatctaccttcatcccacaccaacaggtcacaaaggtccaaggagagctggcgactgagtcacatgagcacttagagtgacagtccactctcctctagataagcaacatccattcctgagcagtctgcttttacttgctccaggtgaattcaatgacacttctgaacttaggaaataaaacaggactgcgttctttatagtaaaaatggcttcaggttacctcatcagtttctttcatatgtaccgcttccatgtctgagattgttattaagctatggactctcagcttcaaacccactcatctacgctcaactttgcgctgctggggctggaactctgcaaactctatttcacctctgccagctgagtttcttagatggggccaccaagaggtgctagagggagaccaggggctggaggagagagaggagacttgctcttctgtttgctcactgttctgcaagcatcattcagcacagttacttcaactcagcagcagcagttgacttcagtaatagttgattccagtttccattttttccatgctccaggaaccaatcatcttttatcatctcagagataacaggaccatagccacaggattcccactctgaacttctcaattctaataacctcaacctgtcccctttgttcctgagccctggagggcacagctgcttccttcaggtaccatctctgcattgccttaatgtttccctttttctccaatacctgattatttatatccttaaattatctgttaaaataactgttgtctattttcctcaccaaccctgcctgatacaatatgtgagttaatttcttctgtcctgtctaaacatacaaaaaggaaaccaaaatttgtcacctcgtggagcttcagtaataggagactgtttaagttttcaacaaatacattctcccctttgttgacaatggcagaaaacacggtcataaacctacttttcatttgttcttttcctgttgttgactgttaatgatgaatgtttggaaatcaaaattttaatgctgaaaattttattggttaaagttacttgtattacataaaggagaagtaattcaatcttgagcaagaaaacagagctgtgaaaacttttgggtttcctcaaaacttcctgcatgagtttcctctggctacacatttctttgtccacattatgacaaacctggtggtttaaaacaacagaagtgtattctctcataaatctggaggccagcaatctgaaatcaatgtgtcagcaaggctgtgctaccactgaagactctaggggagaatcccttgcttcttccagcttctggtggctctacgactccttgacctgtaccacaccaatcgaatctctgcctatgagatcatatcacctcctcctctttatgtgtcttctcctctatgtctttctctaaaaactcctctgcttttatcttataaggatacatgtgattgtatgtaaggcccacccagataatccagagtagctcctcctctcaagaaccttaatttaatcagttcctttattatacaaggtaatattcacagcctctaggaaaaaggacatggacaaatttggggggagtcaccatttagcccaccattgtccacccttaatgacccctttactttttccattttcttcctttgggaatgggaatgttttgtaactgttataatatgtctgactcattattgtagtttggaaacaacttgttttctagtttcacaggtccacaaatggagacaatgtcccaagatggatcatgcttagattctcacctatatcttatttacatgatttagatgatgagatttgggactttttaagcaattatatttaaatgagattctcagatttagagcttgtgctataacagtttgaggttttgagggatgtattttgcatataggttgaacataatttttggagggccaaaggatggaatgtagtatactaaatgctgtccttcaaaaagatacgtccacattttactccccagaacctgtgaatactaccttatatggcagaaggtgtgattaaggatcttgagttaaagaatttatgttagattatccaggtgaatatgaaatgcaatcaccatgtatatttatataagaaaggcagagggattttgagataggcatgcagaggagaaaccacacaaagaagtagcagcaatataatcatgaaggcagagactgggttcacgaagctacagaccaaggaacaccaaagaatatcaattgccaccagaagctgaaaaaggcaagaagcagattatcccctggagccttcgcaaggaatacagccacgtcaacaacttggtttcagacttctggtctccagaactgtgggagaacacatttttttttttttggtctctcttattttactgtggtgagaacaattaacaagagatctaccttctcaaacatttttttttagttctttttaattatactttaagttttagggtacatgtgcacaatgtgcaggttagttacatatgtatacatgtgccatgttggtgtgctgcacccattaactcgtcatttaacattaggtatatctcctaatgctatccctccccctgccccatcccacaacagtccccggtgtgtgatgctccccttcctgtgtccatgatgagttcatgtcctttgtagggacatggatgaagctggaaaccatcattctcagcaaactatcgcaaggacaaaaaaccaaacaccgcatgttctcattcacaagtgggaattgaacaatgagaacacatggacccaaacatttttaacatacactacattattgttgacaataggcacaacattttacaaaagatcactagaacttatccattgtgcttgacaaacttcatgatggtagattagtaactctccacttccactttgccccaacccctggtaaccattattgcactctttgattttatgaatttggctattttaaatacctcatatagttgaaattatgcagtatttgtctttacgtgaccagcttattttacttagcataatgtgctcaaagttcatccatactgcaaaatttcctccttttacagggctaagtagtgtcccataatatgaatatactacattttctttattaatttatcaatcaatgggcattcaggttgtttccacatctgcggtattgtaaatagtgctgcaatgaacataagagtgctagcatctcttcaagatctttatttcaattcgattggataaatacccagaagtgagcttgcttagtcacacagtagatctatgtttaagtttgaggaacctccatactgtttccaaattaactgccccattttgcattcccatcaacagagtgcaggggttccaatttctccacatccttcccaacatttctctttaaaataacaataataataataataaccattctaatatgtgatgtcttctttgggaaaatgtcactcaactccttagaacatttttttagggttttttttttttttgctattaagttatatgaattccctacatatttgggggattaaacacttagacgattttcaaatatctgctcccattccataagctgccttttcattctcttgattgttgccattcctgtgcaaatttcatgtagtcccacatgtttatttttgtttttgttgcctgtacttgaggtgtcatatacataaaatcattgccaagaccaatatcatgaatatttccacgtgttttcttctagttgttttaaattttcaggtctcatctttaagtcttttgtcctttttgagctgattcttatttatggtataagataaggatccaattttattatcttgtatgtggatattcagttttcccaaaaccatttactcataaaactatcatttttctattgtatattctaggcacttttgtcaagaatcagttgaccttacaggcatacctcattttattacacttcactttatggtactttacagatattttgtttttttacaaatgtaactttgtggcaaccctgtttccagcaagtctgttggcaccatttttccaacagcatatactcacttcatgtctctgagtcacatgctggtaattttaacaatatttcaaactttttcattattattatatctattatggtaatccataatcagtgctctttgatgttactagtgtagttgtttgggggtattatgatctacgcccatgtaagacagtgaagttaatcagtaaatactctgtgtattctgactgttccatggactggccattcccctatctctctctctcccctcagatctccctattccctgagacacaacaatattgaaattaggccaattaataatgatacaatcacctctaagtattcacatgaaaggaagagttacatatctctcacctgaaaacagaagctagagattataaagtttagtgaggaaggcatgtgatctaaaacagggacaattttgcttctttctaatttgcatgtcttttatttatttctcttgcctcattgctccagttaggacttccagtgctgtatgtgtagaagtagcaacaataggcattcttgcctttttcctgatcttagagaaaaagctttcaacttttcccaataattatgatgttagctgtgtgttttgttatatatggccttaatgatgttaaggtaatttccttctattactagtttgttgagagtttttatcataaatgtttgctgagatttgtcagacactttatcttcacctatttagatgatcatgtgatttttatcctttattttattaatatagtttatcacattaattgtgttgaaccatctttgcatcccagaaataaagaccccttggtcatggtgtaagatccttttaaaatgctgttgaattcagtttgttatactttgctctgatctttatgattcccctccttctgccagctttgagctttgtatcttgctagtgttcagttgagaacttttgcatgtatatttatcatggttactgacttgtagttttcttgataccaaaaggtatcagggtgatgctgatgaaacgaacttggaaatatttccttcttttcaatattttgaaatgatttgagaagtaatgttatcagcttttctttaaatgcttagtagaattaaacagtgaagctatcagatccacagcttttctttggaaattttttttatcacagataacaactccatactagttatgtctattcagactatttctttatgatttagtcttcataagttctatgttggtaaaaacttatccatttattctaggtcattcagtttgttagcataaacttatatgctataattgtttgtaatagactttataattatttttatttttgtggcatcagttataatgttcatttttatttctgattttatttcagtctccatttttttagtctagctaacagtatgtccatttaatattttcagaataccaactcttagctctgttgatttctttctattatttgtctatttcagtcattcctagtctaatctgttattttctttttcctgctaactttaggtttagcttggttttcattggtctagttcctaaagtgtaaagtttagttctttatttaagatctttcttgatttttaatgtaggcatttattgctatgaaagtctctcttagtattgctttgccacgtcccataaattttggtatgttgtatttgtattttcatttgtctcaaggtatttcctaatttcctcttaaagtttgtctttaacccaatgattatttaagagtgtgttctttaatttccacttgtgtaaattttctagttttctttttgtcactgattttaagtttatttcattgtggtcagaaaacatacttcgtatgattttaatcttcttaactttgttaagatttgtttagtgacctaactcacaatccattctggagaaaaatctatatatacttgagaagaatatgtattttgctattgttgagtgaaatgtcctatatctctgtgtgtgtgtgtatatatatatactatatatatatagtgtgtatatatatatagtatatatatatctgtatatatgtatctgtatgtgtgtgtgtgtgtgtgtgtgtatatatatatatatatatatatatatatatatatatatatatatatatatagtgtcattctagtcctgtttccttattgaccttccatctggatgttctgtccattattggccgatgttggctttatatattttggcacttttctgtttaatgcatatatatatatatgtgtgtgtgcgtgtgtgtgtatacacacacgtgtatatatatacacacacacatatataattgtgagatctttctggtcgagtgacccttttatcattagtcattataaaaattcttctgtcttttgttacagttctagacatagttctattttgtctaagattgcttgcttagacccttgctctctttcagttagcatttgcatagaatatctttttccattccttcagtgattaagtgaagtaatgaataatgaaatgaagccataataaaaagtctcccatcaaaaaaataaaaataaaaaaagcctaagacctaatggcttgagagctgatttctactatcttttaaagaacaataccaactgtacttaaactccttataaaattaaagaggagggaatccttccaaactcattctacaaggctagcattaccctgatactaaaaccagacaaggacacacaaagaaagaaagaaaaacacaggccaatatcactgatgaacatagatgcaaatattctcaacaaaatactagcaaagcaaatccaacagtacaataaaaagatcacacaccatgatcaagtggaattcatccctgggaggcaaggatggtttcacatatacaaatcaataaatgtgatacatcacattaataaaataaagaacaaaaattatatgagtatttcgacagatgaaaaaaaggcatttgataaaattcaccatccctacatgcaaaataccctcaacaaactaggaatagaaggaaaatacctcaaaatggaagaatcaaatatgatgaagccacagatgacatcacagtcaatggggaaaaattgaaactctttcctctaagatctagaaaaagacaaagatgcccactttcaccactttcattcaacaaatactggaagtcctggccacagcaattagctaagggaaagaaataaagggcttcaaagctggaaagaaagaagtcaaattatccttatttgtagaatgtgatgttatttttaaagaaattgaaagactataaaaaacctgttacaattgataaacaaattcagtgaagttacaggatatgaaatcaatatacaaaactcagtagcatttgtatacaccaagaacaaacaatctgaaaagaaatcaagaaagcaattgcatttgcaatagctacaacggttataaaatacttagaaatcaatttaaccaaagaagtgaaagatctatataagaaaaatgatttaaaaattgatgaaataaattaaaagatcacacaaaaaagtgaaaagatattccatactcatgaattttaagaattaatattgtgaaaatggcaatactactaaaagtaatttatagagtcaatgcaatttgtatcaaaataccaatgacatttttcacagaaatataaaacaatcctaaaatctgcgtggacctacaaaagaccccaaatagtcttaatcaaaaagaacaaagctggagccaccacattacccaacttcaaatatgactgcaaagctatagtaaccaaatcaacatgttattggcataaaaacagatatgtagaccaatggagaagtattgagaacccagatattaatccatacatttacagctaactgctttgacaaaggcaccaagaacatagaatacagaaagaacagtctcttcaataaattgtactgggaaaactgaataaccacatgcaaaagaatgaaactagaccccgatctcttgccatacataaaaatcaaatcaaaatgaattgaaatcttaaatcttagacctagaattatgaaaccctagagaaaaaaattgggtaaatgagccaggacatgggtctgggcaaataatttttgtgtaagacctcaaaagcacaggcagccaaagcaaaaactgacatatgggattatattaagctaaaatgcttctgcacagcaaaggaaataatcaacgaagtgaagagacaaccagcagaatggggaaaaatatttacaaactattcaactgacaaaagattaacacagaacatataaggagctcaaacaactcaatagcaataaaaacaccccaattaaaaactgggcaaaggacctggatagccatttctcagaagaatgcatacaaatggccaacagttatatgaaaaaacctcaatataactaatcatcagagaaatgcaaatcaaaaatgcaactaaatggcagtgagatgatatctcattgtcttgtatcttttggtctcatagcaaaaagacagggaaaaacagatgctggcaaagatgtggagaaaggggaatccttgcacagtgttgatggaagtatcaattaccacagccactgtggaaaaccgtatggatatttctcaaaaaactaaaaattgggggtggggggttgagccaagatgtctgaatagaggcagctccattctgcagctcccaccaagaaggacaaaaactacaagtgaactctgcatcttcaattgaggtactgaagttctcctactgggattgcctaggtggctggcatgacccatggagagtgagcaaaaacagggtggaacgtgagatttgggaggggccaggggtggaattatatggtttgtctgtgtccccacccaaatctcatcttgaattgtagtccccataattcccatgtgtcgtgggagggaccttgtgggaggtaattgaatcatgctggtggttaccctcatgctgttcttgtgataatgagtaaatctcatgagatctgatggttttataaaggggagttctcctgcacaggttttctcttgtctgctgccatgtaagagataccttttgcctgctgccatgattgtgaggcctctccagccatgtggaactgtgagtccattaggcctctttttctttagaaattatcctatcttgagtatgtcttgatcagtagcatgaaaatggactaatatagtgatgcttatcccaattcttctgatttgatctttacacattatatgaaggtatcaaattatacatacccccaagatgtgtctattatgtatcaatatttctgatatataaaattaattttaaaaaactaataataaagtaaacttatagaacagcaaatagtttgggctatttttaatccattttttaatcctttttttaaatccattcagccaccctatgtttgattagggagtttaatttatttactgtattagtttgttttcatgctgcatcaagacatacccaaaaccggaacaaaagaggtttaattggacttacagttccacatggctggggaggcctcagaatcatggtgggaagtgaaaggcacttcctacatggcagcagcaagagaaaaaggaggaggaagcaaaagtggaaacccctgatcaaaccatcgaatctcatgagacttattcactataatgaaaatagcacgggaaaaaccagcccctatgattcaattatgtccccatgggtccctcctacaacatgtgagaattctgagagatacaattcaagttgagatttgggtgaggacacagccaaacgacattatttacatttaaagtaattattgatagggaaggatttgctattgccactttattcattgttttctactggtcttatagttcttctattgtattttcctttcctattgctttcctttgtgttttgtccacttttcgtattagcacactttgatctttttctcttttgattttgtgtaactttgtgggtataacatgtctctgggtgaatttctttgtgttgatctaatttggtatcttctaggcttcctagatgtggatgatcatttccttccccagatttggaaagttttcacccattatttctctgaataagctttatggttctttttcttctcctagtactcccataatgtgcatattgctcctattgatgatgtcccataattcctctatgctttctccactttttcatttttttttgtttttctactgaattatttttagtgatctttcaattcactcatcctttcttctgattaatctagtctgctattgaatccctctagtaaatttttagttgagttattgtgctcttcagctccatgatttctgtttggtacttttaatattttctatctctttgttgaaattcttactttatacatgcattgttcttttgacctcactgagcatctttttaagagttatttttaattctctgtctgtaaattatatacctccttttcattaggctttggtttctgtagatttaccttgttcttttgtttgaaacatctttgcctggtttttcatttttcttgactctctgtgttgatgtctgcatattacacaaagcaggcacccctctgtcttcacaaactgacctgtataggaaaagaccttcaccaatcatcctagccagggattctgagatcgtctattaactcttttcctctcaaggaagaagtaggcagctgcagtttctgactacttgctctgtgctgagctagggtggggagctttggcatctaccaatccaagtcaacatgcccattgttccccaggcagctagactgtactggatctgtcagagcttcaagattggtgaggcaggtactagttctttgggcagctctggaaactgggcattgatgtacacgtcaactctccccctaccagaggaaactgagagctggttttatttttatttttttccatctatttgctctgtgcttaactgaggggaggatccatgtcatctactacctctgttctcctccaggtggctagactattctggacccttcagatatccaaaagccccctgagaaaatttggggtattagacacatgaaaaaacaccttccctgctctgggtgaagctgagagctagtgtacctttacttggtcatatagtgctgtgctaggggtagggtttctggtgaaagggtatcttaaatcttcccactagctttgttaagtctggtttcatatttggttttcaggatgccagagcttttctggtttctcacaaaggggatttgtccatgagttgctgctgaattgatgtgtttatgaggtatatttgtgggggaagaagggtcaagggctttctatttcactatattgctgatatcatttcatatttctattgttttaagccccaaagtttgtggtaatttgttatggcagctttaagaaactaacacggttcccaaaagataacaaaaaatacaatggcaaaaagttaaaaattgttaaaaccagatttgaaaaaaaaagattaccagccataggacatatgttctcaacttcagatgggggagggatgagagtagatacagattcatttgtactatttcaaaataagttttaaagtacaaaagtcagtgctattaattgagattcttaactgttgatgttatacaagagtttcaagaatcaacaagctttaaaaattaatgcatcattaaatgtatgtagctcatcaattctttttaatgatattcagttacccccaaaacacaacctgcaggcacagtgaaattcacttggttgatgattctaaacattatggaacgtcaacctctagcaattcaaatctgcccaattgtatttccttttcactactgataaattttcaaactgaaacctttcaaaccacacatcttggttacaaaataaattttaagcattagaatatggttgtttccatactaaaagagatgaaaaagattctagtatttattttcttgtatacaacagttttaaaccttctaaagctgttttctatttctttcattcatcaagcacatgaaaaaagtaattgtcctaaaagtagagaaaaaatgtgaaagacgttgcaattcactttatagcatcttgcaagttataaactcatgtgtttaacaacttctttaaagaacctagatattattatactgagttacatctacaaattatataacaacctagttttatgcttttcataagtctcaaggaatgttcttgctaccccaactttgaatcactctaacatttcagaaacttcttgttttccccaatccattatatctgtctactgaagcagtaaatagcccaacatttttagtgctgaaaaccacaaatgtaacatcttataagaatgaattaataatgagaaaattttttatgaaatgacaatagttcatgaattatactttaagagtaagaagtttttggttctcagggttgataataactagaagttgtgagagatgttcctggttctactaccaccagacctcagatatatggtactctggtcttacaggaagcagagaagctttcaaggtaccctctttcatcactatataaacagaaagactatccaaacctgacctttaaggagcaaacaacaagaatggtgacagttaggagcctagaagcctaagcagaactgctcacggccatgagtggaaattcctgagggaaacttctgggaatctgagaaaatagaggccagtgtggcacacagcaagactggaccagcataccatgaaagggcaaagttccctagagttgccacaaggccccagtaatatggctgcacgttaatccttgaacagaataagctaaatctgagacttactctgattgcaaactcttgacgaggagtaaaatatttgcatggtcttaatttcttctcacagattgtttattagtttgaaagggtgaaaataattaattatattgcagataaataagttagtatcttgaccaagtgatcaaaattagcatcaccattgagagacagatggatatgcgtacctctgcatgttataccctgagaagtacatagcagtacctatccagtattacagcaaagaattagaaaatattttaaagacaatatctaaaaatacaaaaaactgtaaaatatattatagatgataagttataaaactctaatgaaaacatttaaaaagataaataaatagggagctactccaggttcaaggatagaaagatttcacatcataaaaatgtcagttttccctaaattgatgtatatatttaatgcatctccaaccaatgtaccaatggggcttttcacacaattagaacagttgattctaaaatttctatggaaaagccaagcataacaatacttcagaagaaggaaataggagatttgtctcaccatatatatggatgcattataaagctatcttagaagacaatatgatattagtataaggaaataaactggctagtggaaaagaacagcatccagaaataagctcatattttatatggaattttgataggtggcagaggtgacaccatctgtccctggagaaaaaaaagggtgggtgttttttgaagtcttttgtttttttccccagttactttgatggttcatgctcatcatttattagtaaggggaagaagaaagaaagaaaagcaaatgggcatataaagtgacctctctgtgtcttttctgatgcttctattgctgacagaaatagtagttattagaacctagacatttttatatattacatttataatcacaccagtttgagaataagccccaaaaggcccatgacgtcacaaatcataattttgctctggtggaaatttggatatgtatattattttcaaattgtagtttgcataagaatcgaagtatttgaaaaaaaaatgtagagattataactcagtagatctggtgtgcggtcagaaaaatgacatttttaacaaggctctgggtaattctgaaaaccatattttgagaaaagctagaatgaagtgttggggagcccaggagtaaatgcctctctacacagttatgtagtctttccctcatcaacaaatgtcatggctatattattagctgagaattttaactttttcagatggcactacaactaagattcctagtgaatcttaagagttggctataaatctaaaagcctgcatctcactgctagccagttataccacatccagcaatgagtcttttaggaatctttttatgttgatgagaaaacacaatggagcaatgtgaaaatgcaacaagacttgttgagtacagaatgagaaacactttctgtttctgcaatttcattttccttcccatttttacagaggggaagcttggcactatcctagtaactaatgagatttccccacagttcacagcagcagggcttccaagaagaccttatacacccttatccctaccacaaagggcttgaaggccttgaccaagcacaatacacatcaccagtgtctattaactttcacctgcagtgatgcttcccaagcagctctagctctgaccttggctgtggctcttagctttgcatattaaggctgggtgaggcactcatccctatacctcaaaatccccacacttttatgatcatttcttataaaacaccaggtaatgttttcagagaataaacgaggtctggtacattgcatttttgagaaatggaagagtaactactccatgctttctgtatctttaactgtttttctcatctgttatgttcctcggtgactaaattgatgcttccttctttttatcaagcatattctaaaagtttatattgtcttcgacagtctggcttaggaatatttgtatacttactggtacattttttaaataaaatatactggaatgtttatagttggggtatcattaatgcttctcatatcataggccccaagctggaatattaggcctcatcaatacaaacatagatgacttccacccatcaccttctcattaagtatcctttccttaggcttacataggccatagggttttctaaggggagatgtccataaatgagatgaaagccaagtaattcttaggcaatgacagagattgctcctgctaagtgatcaccaaagaaggtactagctactgataaagtgaaagcttcactatttgctaactaaaggagctgtggtagtccatgcattaggcaatggtgggctgcctctgaggaaagctggaaaatctgtgacccagttcccacatagataccgaatgtgcaaacgcaccccctccttgccattacggcctgaattgcacctccccaaaattcacatgttgaacttctgaggtatccttcgtacctcagactgtgagggtatctgtagataaacatttaaaaacgtaactaaggtaaaattaggtcatgtgagtggaccctaatcccatctgactaatgtgtccttataggaggagaagacagacacaggcatgagcatgttcagagaaaagaccgtatgatgatacagtggggaggcggccatctaccagccaaggagggaggactcagaagaaactaaccttgccaacaccttgatcttagacttccagccaccagaactatgagaaaatagatttctattattggaaccattcagtctgttacagcagcctagcaaactaatattaatacattgccaagtgaacccttttggctctcctgagcaacagttatttactcttcctaggcaatttcaccgacagtgcctggcccttagaaggctccataaacatttcttaactaaatggcttaaaagacttatggggtactctactttctgacttgtcacacaactgcccttgggtgaaaattccagagccagttaatttcttaaatgtggggataagaaagcagaaaacatttttaaagtgttaataacttaaaatatcatccagttatatgccacaatagccaaagaatatatttccaggataaaccaaaaggatgtatcaataggcaactcaaatgctttattaacatattaaaagaaatttttgccttgattcttaagtgttagataaaatttgaagtatacactgttctcatctattaaggcttagaggtctttcaaaaagtcattagagaagttgttaactggatacttctgcatactaaaagttgacctcctaaaacatgtcaacctacaataaagacatatgtgacactggaataatctgactcaatggctgaattttgcacaatgtgtattaaagcttagaactgagagaaatggaattatcttattttcaaaaattattttagcaggcctaataaaaattaaagatactaggtgtaagtgttaactaaaataaaaacagacaaatctacagctacagaaaaacagtctgctcaagttcttcctgcaatggcataacgacgcagggaagtcaacccttccacctggggtcatgatccttcttcccaagattttcagtctcacccaggttcctcacagtatcacctttgttagctttcagtactagaagttaccatattctatgtatttctttatatattcatctgtctcgagaataagcatctggagattgggaattctgtccttttcactgctgaatgtctaatgctttaaagcatgtctacacatagtagtttctcaatgaagccttttcagttgatggattgaccaaaatattcagtaaagtgtttcttaatacggaaatcatggaccaaaaagaaactgacaggagagttataagaaaatctcaaagaaacagtgaaaatctgaattgcatgcagatagtgggcagcaagctacatgacaaatgaaatgagatacaattcagagaataatttgaatacagcattatttgaaaattacgattcttgatagagtagaaaaggtggaatggaagggcaccatggagcccttagagtttcataaggagtctaaaagccacttacattttaaaaattaaaaggttggtactaaaatatctttatgtacctgtttactttctttatacaactacaaaatttgcagggtttatggagcacagcaaagtgctttgatcaatgccactttacagatgagtaaaccaaaggcttagagaaggtgaataactgcccaaagtcacaaaactagtaagtttaagaattgagctctggactcagaagatgtcggttaggaaaattacaatctcaaaaatactccatggtcaattttgactctagtgtccaatacagtcaacatggttcaaaaaaaaatcatctcacctctcccttaacatgaatttgggtctgggcatattgccaattactataattcccataatattgctcataatttttcttgcccataaagaggatctcaaagcactttcagtaattgtgactgatcaaattgttactatttatgcttgctgttcaattacaaatcagttcaatataattaccttgttggattgttgagaaattgccttattcattgttgaagactatcttccaacttggtaatttctaaataaagcagtgtcctttcttcatgttgtggcataactcttagcttttgaaggaccagaagaagaaagggaaattttatcccactgtataaaaactaaaataaatcaaaaaataaactaaataagaaaagctatgggagaaatggataaacaaaataaacagtagaaggagacaaaaacttattttagggcatgtagcaaataatagctaatgagggtagactacgcttgaattagatacatcgaaagcacaaccttagattctctccatctcacttatccttaagaccctcagcctgttcttctaagtaactacctcataggcccactctaaaaccagcagagatgtgtggttcagccaattgcaactgacaaagcctgaaatccttgtctcttcccactactttctgactcagatgaagtacccagctacaggacatgggaactggcttctttagttgtgtaactaagctgcacaacttagtgacaaccccaaaatgtagaagcgtcaattcttcgtagtgtttactctgactattgagtgactggagatgggagggaagctgtagataagttgctttgcattccccccttacatgaaccatctgggggcaaggtgcttttaaataatctgacagaaaacctcttgcatggctggaaaattgcctgtgtttgtttgtgaagccaagcatagttcagtgatgtaccaccttatgtttgctgtcttcctctttacaacttaactttttcctcactctcagagccctggaattagatttaccaataaagcattagcaccttagctttgcctcaggctctgttctccaaggaccctagaaaaagtcttatgtactatctgaaagctctcaatgcacaaggtagaaaatgggggtatataatgagcttctaaattagtagaaaagacaaacactttgatgataaatagagattgggttgcctattcatgaagagttagtctagcacaattttgtgcccaatatgtaagtcaactacaaatgcccaacattagcattttagcagcttagcatggtgggggaaaaggctctgtttacataatgatatttttcccatctttcagaagaaaacacaattacaagtgcatttttgaggaataattttttcaggaaaagtaatgcaaccaatcatccaaggtacctataaaaatttaattacgattatcaaataaaatgcagggaaatagcaacagaaactactaaacatgtcttcaatccaccagcctcgagaaaacactggactttacccagctacctcttgttgtctagttacccgctcttcaaactgagaatcatcagctgaatttcaaaacagaattatgcaagtttatttgatttcctctgcttgcctctcatgaaaagacataaaaattaaaatggattggtagagatggtaggagctttcaggtgaacacgaaatactgtcatcaatctcattgtttcagggaacagtgggcatggtggcacaatcaggctgaacagagaaaagcatttcagctgtggccactatgaaaaatgagataccaccgaacaaggcagcaatttcacacaagcaagttaacatacttcctttttaaaaagctccagggaaatctgaaattgcaagtaaagggattaagagaagagatgctaagagaaacccttgacttttctctaaaccactacataatttcactagaacaaactctttaagccatgaggattacaatttcctgttataagagccatttcaataaaaggtttgctgattactttgaaaagttaaaaaaaataaagtaaaaaaacaagtaagtgaaaactgattgctcccatgacatgaactgcttattgagttttaatgtctttctcttctgtaggtttcaggtggaattagtcaaaaccaaacgtggattaacagcataagaggtaaataagtacatatcttgaaaaattagaagacacatcccccctgagatgtgtctctcagagttagaagtcagagtctttcctattaacagattatgttagtattgttaatataagttaagactaatgtgtaaataatctgtcaaaatacaaggaaaaaaaagaagcttagtagctacacaactctgcttatttttgttggtatttgaaagcaccaacctctctagttctatattagactctctgttattggtttgtgggattctttgtctttaagactgctccttccaccttgctttcacttactctaatcagacaacctatctggggacttctcatctcataggacaaaattattcttaataagcttcattcatccctatcctcatctcatggccataatagcaatggaataaatgccaggatctgtaagaatttccaagcatttaggggagatgatcttgcaaagataacattgttctcagatctttctcttgctttatcagaacttagattttatttcctttttctttgagatcctgcccattttcagtgagaggaactaatttttatatgattttagctaatatcttttccagaaaaaaattttaataacttataaagtaaacattttagtcaccatggaatgcaaagagggaggaaatttttggccaggggccccttctattctccaactataaaacatggaaggttacctggctaacctatgcacagtgccagtcctaggttagagacagattaattaatagcatgggcaaataaaacagtgatgtaagcagccaggtagtggatttctggggtcagatcctggacctcaagtatccacacaattacaaaagcaaattactatatatttattgcatagctgcatttattgtcaaggttgttatacataaatagatttcaatacttattttttccctcttaaattgccatcacattgctaaatagcaagaacattcagaccagaaaattgagttattttttaaaaggaaagttaagtggacagcagctgcaggattattacattcccttgatttattttttatttacagatgcacattttcattagctgggatttgaacagaatggatttttacaacaataaaagaaaaagcaacccaatttgggcttttatacacagatgggcttctgtctccttagacagttttgagtgtatcttcttccaacacagcccagatgcatctatttgtaaatgttcagctcgcagccttgaggtagagggcataatttccctccccagtctgaagaacaaatctcagatgtaacgtgttttctgtatagatgtaaggaagtcccagagaggtaggctggaaatgcaaacaaaatttttccctttcttcccattataaattaaggcatttcatgcttctgtgattcttttttcacttacatatctgtatttgctacaatgcttttctagatggctttaggctgtattacttcctcttgccttagaaaacaatcaaatttgtgttgccagtgtcccagactaagtttcatttcttcacagttgttaggactatcctctaaagctctcaaatgtttattgttttaggtttctaatcacagtggttataaataagcacagattctgaagagtccttatatgcggtacacattttcactgaccagtctagtttgtttgggcgcctaagaaatgtttaataattaaataaattcaccctggatgtggtaaagaacttgaagatttttaaccacacagccctgccttagcttcggaggtggtgctgctaagacatctcaggagcactggtttagaattttattaatacttcattttctaactctgttagggtagcaatacagtatctttactattaggaaattggtaggatgtagtgctactggactagccaagatggtaaatgggcatcaatacaattgacggcagatatctggaatgctgggtggagaccacagtggcaagggtcttcgtgactacaggatcacagactgcggaagacatctgagccctgatccctgggtttgtcctctgcctctttcctattccatgctagccccctagagggtccaacggaagctaaagaactaggcaagctttaggtaagccttgcccactccagacttttgtccatgtccctgtacctaaacacactagaaactgtggttgaaaaagtaagacagtaactaacgtatcagcaaagcaaccaggatattttccctggtgattttaccacttgcaagcttcctggcccattgcctcaaggacattgttttcacttgtccctggcacgtgcctatccatatttatggatgagtggattatcactagacaaagacaaattatctttaaatctgaagctataaaatgtttatgtttgttgatttatattgcccagttgttctcccagcagggtggttagcagggtgacataaaaataaaacagcatccaccctttctatgccaaatgtaggaaaagagttaaaatgatgttcccaaacatggatggtggccctcactttgacaaaactaaatgagtagtacaccttctaaactacagtgatgacaaagaaaactcagttctctatcctaagtaaattacacagctagaagtcacttccaggtaaagacctgtacatcacctttcaatccaccgaggactgtgtaacagctcatctgattccgtgaaatctggagtatcaccctctgtttcaagaacttcagtggttaagtcccaatttaaacattcctcttttatcaaatcctgtgaaagaaatctctttgaactttacctccattttagatgtaatatttgtgtagaatttatagtcagtgtttggtgcttaggttttatttgtccaattttttaacttagcatgagttcttctgagattcatctctgcttagaaagcaataatagaataaaaacaaatacataaataaaaaggattttttttcatagaaatactgacacaacctttaactagagtggagggagtcgtgcggcagtaataataaaagtagcaaacgttagcaatctgcttcatagcatgaaataaaatattttagtaaaaacatgaatactgctcaactgtaatttttcacacagctgtgataaaaggatgataaaaatgataaggcataacaattcctgagtaaacatacatataaaatgaagtggaggttcaaatctaaagagtatgttttactttcagattctaaacatactatggctgatgccttgtgttttttatttttttaacaactatcaattttgttcacttgtacaatttaatggaggctagcagcttccaaaacctgtgctgcattaggagatattctattctagcctgtgcatttgacatcttgtcactttgtaacattacatacctttgaagagatagcctatctattgcctcctgataggaaaaaaatagcaaaagcagtaccaatcaatctttccactggaaaaattcattttcttagaaatgattatgtccctgcctattaaaaatctgagtctttcccaaagtaatagaatacctcttaaatcattagaacaaatggatgttcttccaacaatgagagcaattatttttcaaaatagaaacattccttctagaatgttctaccagatgtaatttatttggggcaaataaatgatttttaaggaggttaaaacataaaatgttcttagaaaaaaagatgactatatatttttacatactatactagtcactatttcggtagaacaatctgtgacctctcggtcaagacacagttaaagaaacatagataagaagaaacaatcagtttggaacttacaataaaataactactctcgcatctacattaagtttgtgaaccattacatctggtagccacaaaacatatatgaacctgtggctctcaccttcttttttttcttcttctttctttgccatatttatactttctttttctttttctttttcttttttttttttttttttttactatactttaagttctagggtacatgtgtacaacatgcaggttacacaggtatacatgtgccatgttggtttgctgcacccatcaactcgtcatttacattaggtatttctcctaatgctatccctcccccagccccccaccccctgacaggcccccagtgtgtgatgttccccaacctgtctccaagtgttctcattgttcaattcccacctgtgagtgagaacacgcggtgtttggttttttgtccttgtgatagtttgctgagaatgatggtttccagctttatccatgtccctgcaaaggacatgaactcattctttttatggctgcatagtattccatggtgtatttgtgccatattttcttaatccagtctatcactgatggacatttgggttggttccaagtctttgctattgggaatagtgctgcaataaacatacgtgtgcatgtgtctttatagtagcatgatttataatcccttgggtatatacccagtaatgggatggctgggtcaaatggtatttctagttctagatccttgaggaatcaccacactgtcttctacaatggctgaactaatttacacccccaccagcagtgtaaaagtgttcctatttctccacatcctctccagcacctgttgtttcctgactttttaatgattgccattccaactggtgtgagatggtatcctactgtggttttgatttgcatttctctgatgaccagtgatgatgaggatattttcatgtgtctgttggctgcatgaatgtcttcttttgaaaagtgtctgttcatattctttgcccactttttgatggggttgtttttctcttgtaaatttgtttaagttctttgtagatcctggatattagccctttgtcagatgggtagattgcaaaaattttctcctgttctgtaagttgcctgttcactctgatggtagtttcttttgccatgtagaagctctttagtttaattagatcccatttgtcaattttggcttttgttgccttgctgttgatattttattcatgaagtcattgcccaagcctatgtcctgaatggtattgcctaggttttcttctagggtttttatggttttaggtcttacatttaagtctttaatccatcttgcgttaatttttgaataaggtgtaagggagctctcgccttctaactgcctttacgcatgacctggcacacagtatttattcactgtttatttataaacacgtatcaagtacctttatgagacatggtagctgtagagacctgcccgcctctatggttgtagttgagctacctgttcaacaaagttctgtattcctatcccacagtgcctagggaagtgtcttcctagccagacactaaattttttagtttttctttgcatctagatgtgggcaggtagctaggaagtaagaagaagagatatgattccttctgagtcaacatggttaagaagcaaatatggtctctttgttctctttcccttatatggcatccttggaattcacgttttgaagacggcaatgccccaagatagaaagaccctgagtttctgcatcaccacacagaagacagccagaaaccacatgaaagtgctttgagagtgagaataagcttaagttgtgttaaactacagtcatgtgctgcataataacatttcagtcaacaacagacagcatatacaagggttatcctgtaagattataatggagccaaaaaatttctattacctagtgatattgtagctgtcataacattgtagtgcaatgcattactcacatttgtagcaatgctggtgtaaacaaacctactgcactgccagtcatatagaaatatagcacatacaattatgtacagtacataatacttgaaaatgataacaaatgactgttactggtttatgtatttactatactatacttttaatcattattttagagtatacttctacttcttaaaaaaagttaactataaacaggctcaggcaggtcaggaggtattccagaagaaggcattgttatcacaggagatgacagctccatgtatgttattgcccctgaaaaccttccagtgggacaagacatggaggtaaaaaacagtgatattgatgatcctgacactttgagtcttaggctaatgtatgtgtttgtgtcatttttggcagaaaaaagtttagaaagttttaaaactttaaaaaatagaataaggatatgaagaaaatatttttgtataatgtgtgtgttttaactaagttactacaaaagaatcaaaaagttagagaagagtttaaaatttataaaataagacagtaagctaaaattaatttattattgaaaagaatttataaatgtagtatagcctacatgtacagcatttataaagtctatagcagtatacagtaatatcctaggccttcacattcattcaccactcactgactcacctagagcaacttccagtcctgcaagctccattcataataagtactctgtacaggtgtaccattttttatcttttatagtgtgtttttaccatgacttttctatattatgtttagataacacaaatacttaccattatgttacagttacatatagtgttccacatagaaacatgctgtgcaagtttgtagcctaggatcaacaggctataccatgtagcctaggtatatagtaggtttgggtaccatctatttttgtattagtatattctataatgtttgtacaacaataaaatcacctaacaagccatttttcagaatatatccccattgttaagcaatacatgactgtattttaattttgggatttatctgttataataactaacacaatcatataaaataatcttgttctcagaggaacttacttctaacaagggagaaaccctccttcaaatgtcttttggagataagatacagttatataaaataatgaggtgataaggcaaagaaccaaaaattatagcttaagaaatcagccacataataaaattaaggaatctgggttgcaaggaaggatgggatcacttaagtctatagagctgttagaaaaggccttatgttggaagcatccttttaacttcatttcgaaggatgggtagcagtgtaacagtgagaaatgaggtcgaaaggcatttgatgcagaaggaactgtatgactaagcagggaagaagtaaagtgcaatgatttgggaatagtgaattgtctgcccaaaggagtatagcctgcacagaagtaaccatgaaatggttaaacagcaaccctccaagttgctatagttcagaacttactgataacctgacatatgcattataaagtccatggctttggcactatggagggagaaagatgtatttgaggaaggtcatctcaccttcaaagtttttctcttcttttcaaaaatccaggtactaaaacatctctctcaccactgtagataatgagagagtgatacagggacttcaaagatctgagaggtcatagaacagagaggggcaagatatatttccagtgaactctaaactaaaaggaaatcattcccctgaaaattgacatttctcaagaagcatcataaaagtgacaaatcctccagtcccctcaaaaaaatgcattagatttgtgctattgtcagcaagaatagggcaaataatgttacattgattacagagccttcttcaactttgtgaatgagactagaacttttttcttgatataaagctctgataaataaccatcctatcagagatggacatgttctacaaacagtgactgagaaatctagatgataagaggggataatatggctaagaagcactgcaaccttatttaaaaggggttaaaaattgagaacagaacctcactatacaataactatttttgaatatttccttacgcttaagtttataatttagaaaatatgtgttttcactccaaaatatgaatacattcattctttagaatgatcctttcaggtctgtaattgacagctaattaattatttaataatatctagaaaacacatctgcattacactttagtttatatgtagaattgtacatttataaacaaatatccatgagcaaataactctgcttccctgcaaaaagtcagataagtcttgtctacagaaagagaatattctccttttttaaaggatcatcttggcaaaggtgcaaaagagacctggccaaacataaaccagttcctactacgttctttttaaaagtttgaatcacattagtatgactccttaaaaaaggaatagtgtttctttgtttctgtttgcctttttaaagacatacatagttttcacacgttttgttgttgttgtttttgcaaacagtagaggtcctagcgatctgtgttgtttgttcagcttcccttgggctacggaaaagtcagaggctcatttccaagagagtactgtgtgaaaacacagtggagagaagttgtagagtaagcaaaggaaatgaccccaacggtttgttcaacagtttggcagcagcttcctatacctgggactaatcatgccaatccctgttactgtcaaatgtgtcctaagcaagtgtcccctctttttttttttttttttttgctattatcttgcttcgtcttaccttgtgctacaataatttataagaagaggagtttcagataaatttatgctttaaagaaattttcttttaaattgatgcaaatgtcaagggaagacaaaatatcccccaactacacagatcagtttccctcctttctctctttacataccattccaaaaaatctaaaatatgcattactgaagattcttttggataagaaaaaaaaggaaatgtactctgggcatgaacaataatttttctgaagccttaattctttctaaaatggaaaactattggaaaactaacctgcatggttctaagaacattttccacaaaaaaaaaaaataataattcaattcaaagatctaaacctgagtagaatttatggtgattgctcttagtctacatgcttacctgggttttctcttcagaaaagccatactttacttcatatcataatcttttctttttaacttggcaaactcattttctatcttctcaccttcttacactccagcaatgatgacctactttaattcattttaatatatcctggtgtttcatggcccccatcaatttgctcattctgtttgctttaggtattatagaatgtgtctttcttcctttgttcacttgctgaactcctattcatcttccaaaccctttgtgccagtcaaggttcaatgtaagaaataaaagtcagctggatatgccagacagaaaggcatttaatacgaggcatgaagtgccaacaaaactgttgaaaggactagaggagcacaggtccggggccaccaaaaagttttcaggtcacatggctacctatgtcagagttatcccacagccaaggctggcagtgaaaaaaggagtctgtgcattgccatatatatatatgtgtttactgtatatatatatatatatatatatatatatatatatatatatatagtatacagtatacgtatatatataaatatatatatatatttgctgtatcatatatctcaactgctatcactactaaaggaaaaatgaactctacctccctcctgccttgcaaattttgcaccacagtctctcattacagttattagccttccaactccaaggtgtagggacactgaagagaaggaaataggtgcttcttgccaaagataatatctaagactccatagctcaagcctcatatcccatcctcaagcctctctctggactttccacccccaaataatcttgcttcatcattcccttcactttatcacctctattctttactaaacatattcttctattatcttagcagtcccacaatattgcaatatagtatttatagctatgtctatactttataaaccacaaggtatctaagacaagtctcaatcaatttagaggtttattttgtcaaggttaaggacatgctggtgacacagcctcaggaggtcctgataatatgtgcccagggtggttggatgacagcttgattttacacattttagggaaacatacgacaccaatcaatacatgtaagatgtacattggttcagtccagaaaggtaggacaactcgaagcagagggaggctgcagggagcttccaggtcataggaagattcaaagattttctgattggcaattagttaaaagttattacctaaacacctgaaatcaatagaaaggaacatctgggttaagataaggtgttgtggagaccaaggtttcatcattcagatgaaacctccaggaagcagacttcaaatctcttatcacacctaaaaagatgtcagactcttagttaattctttcctggatcagggagaaaacttggaaaggaaggaagattctctaaagaaagtagattttccccacagagacagctttgcaggaccattataaaatatgtcaaagaaatatattttggggtaaaatactttgatttctttcagggcctgctatccattgtgtgatgctatactagagtcaggctggaattatttggtgtcttattgctgttttgtcagtcttgagatctctgtttgaatgttaatcctggtaagctgtgcctgaattgcaaatggagggcaatataataaagtatgtccaacccctgcttcccaccatgctctgaactagtttttcaggttaactttggaatgcccttggctgaggaaatggtccatcggtcagctgcggggtgcttagaattttatttttggttcacaaatacatgtgtttatcattttattcatccttgtttaatcttcagtgcctagcatagactctgaacataatatattttatacattttatttcaccaaattttattaaatatcactttaatttgcaaaagaattactaactttgaaaactgaaatttgctgtttcaatatcctctttcagtagatttgaaaaatttggagttgggaagtagtgacattcaactcaactgaaatttcagtaaattctccttttcttagaagaataataggatactattcaattaaaaatatgaaatttgggggttctttggttctaatagattatttccttaatgtattctccagtgatcaatttgctcttctcaattggaaattaaaaaatgaggtatgttattgcacttatttaaattatagttcattttgaattgtgttaaataacctctgggcatgcttataaggctcacgagtaagaatacagcaagcaattggaatttcttttaaaaaaaaatagaccaagtacccatgcccatggagccttgctcactgctagcacagcagtccaatattcaactgcaaggcaggagtgaggctaggggaggggcatccatcattgctgaggcttgactaggtaaacaaagcagccaggaagctcgaactgggtggagcccactgaagctcaaggaggcctgcctgcctttgtagactccacctctgggggcagggcattagcgcaacaaaaggcagcagaaacttctgcagacttaaacgtccaggtctgacagctttgaagagagtagtggctctcccagcaaggagtttgagatctgagaatggacagactgcctcaagtgggtccccaacccccgggtagcctaactgggagacgcctcccagtaggggccaactgacacttcatacagccgggtgcccctctgagacgaagcttccagaggaaggatcagtcagcaacatttgctgttctgcaacctccactggtgatacccaggcaaacagggtctggagtggacctccagcaaactccagcagacctgcagggagtttgttagggacgtgactgttagaagcaaaactaacaaacgaaaaggaacagcatcaatatcaacaaaaaggacatccatgccaaaaccccatgtgtaggtcaccatcatcaaagaccaaaggtagataaaaccacaaagatggggagaaaccaaagcagaaaagctgaaaactctaaaaatcagaatgcctcttctcctccaaaggaacacagctcctcgccagcaatggaacaaagctggatggagaatgactttgacaagttgacagtgtaggcttcaaaagaacagtaataacaaacttctccgagctaaaggaggagttcgaaaccatcgaaaagaagctaaaaaccttgaaaaaagattagacgaatggctaactagaataaacagcatagagaagaccttaaatgacctgatggagttgaaaaccatggaacgagaaatacgtgacacatgcacaagctttaacagccgattccatcaagtggaagaaagggtatcagtgattaaagatcaaattaatgaaatgaagtgacaagagaagtttagagaaaaaagagtaaaaagaaaggaacaaagcctccaagaaatatgggactatgtgaaaagaccaaatctagatctgattggtgtacctgaaactgacagggagaatggaaccaagctggaaaacactctgcaggatatcatccaggagaacttccccaacctagcaaggcaggccaacattcaaattcaggaaatacagagaacaccacaaagatacttcccgagaagagcaaccccaagacacataactgtcagattcaccaaggttgaaatgaaggaaaaaatgttaagggcagccagagagaaaggtcaggttacccacaaagggaagcccatcagactaacagctgatctctcggcagaaactctacaagccagaagagagtgggggccaatattcaacattcttaaagaaaagaattttcaacccagaatgtcatatccagccaaagtaagcttcataattaaaggagaaataaaatcctttacagataagcaaatgctgagagatgttgtcaccaccaggcctgccttacaagagctcctgaaagaagcactaaatatggaaaggaacaacctataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaaagccccaatgaaaagacacagattggcaaattggataaagagtcaagacccatcagcgtgctatattcaggagacccatctcacgtgcagagacacacataggctcaaaataaagtgatggaggaagatctaccaagcaaataggaagcaaaaaaaggcaggggttgcaatcctagtctctaataaaacagactttaaaccaacaaatatcaaaagagacaaagaagaccatcacgtaatggtaaagggatgatttcaacaagaagagctaactatcctaaatacataggctcccaatacaggagcacccagattcacaaaacaggtcctcagagacctacgaagagacttagattcccacacaataataatgagagactttgacacctcattgtcaacattagaaagatcaatgagacagaaagttaacaaggatatccaggaattgaactcagctctgcaccaagcagacctaatagacttctacagaactctccaccccaaatccatggaatatacattcttctcagcaccacatcgcacttatcccaaaattgaccacatagttggaaggaaagcactcctcagcaaatgtaaaagaacagaaattataacaaactgtctctcagaccacaatgcaatcaaattagaactcaggattaagaaactcactcaaaaccgctcaactacatggaaactgaacaacctgttcctgaatgactactgggtaaataacaaaatgaaggcagaaataaagatgttctttgaaaccaatgagaacaaagacacaacataccagaatctctgggacacatttaaagcagtgtgtagcgggaaatttatagcactaaatgcctacaagagagagcaggaaagatctaaaattgacaccctaacatcacaattaaaagaactagagaagcaaaagcaaacacattcaaaagctagcagaaagcaagaaataactaagatcagaacagaactgaaggagatagagacacaaaaaacccttcaaaaaatcaatgaatccaggagctgattttttgaaaagatcagcaaactgatagaccgctagcaagactaataaagaagaaaagagggaagaatcaaatagatgcaataaaaaatgataaaggagatatcaccaccgatcccacagaaatacaaaccaccatcggagaatactagaaacaccttacgcaaataaaatagaaaatctagaagaaacgaataaattcctggacacatacaccctcccaagactaaaccaggaagcagttgaatccctgaatagaccaataacaggctctgaaattgaggcaataattaatagcctaccaagcaaaaaaaaagtccaggaccagacagattcacagccgaattgtaccagaggtacgaagaggagctggtaccattccttctgaaactattccaatcaatagaaaacgagggaatcctccctaactcattttatgaggccagcatcatcctgataccaaagcctggcagagacacaacaaaaaaagagaattttagaccaatatccctgatgaacattgatgcaaaaatcctcaataaaatactagccaaactaatccagcagcacaataaaaagcttatccaccatgataaagttggcttcatccctgggatgcaaggctggttctacatacccaaatcaataaacataattcaccatataaacagaaccaaaggaaaaaaaccacgtgattatctcaatagatacaaaaaaaaaaagcctttgacaaaattcaacagcccttcatgctaaaaagtctcaataaattaggtattcatgggacgtatctcaaaataataacagctatttatgacaaacccacagccaatatcataatgtgtgggcaaaaactggaagcattccctttgaaaactggcacaagacagggatgccgtctctcatcactcctattcaacatagtgttggaagttctggccagggcaatcaggcaggagaaagaaataaagagtattcagttaggaaaagaggaaatcaaattgtccctgtttgcagatgacatgattatttatatatttagaaaaccccatcatctcagcccaaaatctccttaatctgataagcagcttcagcaaagtctcaggatacaaaatcaatgtgtaaaaatcacaagcattaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaatcacaagcattcctatacaccaataatagacaaacagagagccaaatcatgagtgaactcccattcacaattgcttcaaagagaataaaatacctaggaatccaacttacaagggacatgaaggacctcttcaaggagaactacaaaccactgctcagtgaaataaaagaggatacaaacaaatggaagaacattccatgctcatgggtaggaagaatcaatatcgtgaaaatggccatactgcccaaggtaatttatagatttaatgccatccccaccaagctaccaatgactttcttcacagaattggaaaaaactaaagttcatatggaatcaaaaaagagcctacattgccaagacaatcctaagcaaaaagaacaaagctggaggtatcacgctacctgacttcagactatactacaaggctacagtaaccaaaacagcattgtactggtacccaaacagagatatagaccaatggaacagaacggagctctcagaaataataccatacatctacaatcatctgatctttgacaaacctgacaaaaacaagaaataaagaaaggatttcctatttaataaatggtgctgggaaaactggctagccatatgtagaaagtagaaactggatccttccttacaccttattcaaaaattaattcaagatggattaaagacttaaatgttaatcctaaaaccataaaaaccctagaagaaaacctaggcaataccattcaggacataggcatgggcaatgacttcatgactaaaacaccaaaagcatggcaacaaaagccaaaatagactaatgggatctaattaaactaaagagcttctgcacagcgaaagaaactaccatcagagtgaacaggcaacctacagaatgggagaaaattgttgcaatctactcatctgacaaagagctaatatccaggatctgcaaataacttaaacaaatttacaggaaaaaattcaaacaaccccatcaaaaagtgggcgaaggatatgaacagacacttctcagaagaagacatttatgcagccaacagacacatgaaaaaatgctcatcatcactggccatcagcaaaatgcaaatcaaaaccacagtgggataccatctcacaccagttagaatggcaatccttagaaagtcaggaaacaacaggtgctggagaggatgtggagaaataggaacacttttacactgttggtgggactgtaaactagttcaaccattgtggaagacagtgtggtgattcgtcaaggatctagaactagaaataaataccatttgacccagtgatcccattactgggtatatactcaaaggattataaatcatgctgctataaaaacacatgcacacgtatgtttattgcagcactattcccaatagcaaagactcagaaccaacccaaatgtccatcagtgatagactggattaagaaaatgtggcgtatatacaccatggaatactatgcagccataaaaaaggatgagctcatgtcctttgcagggacatggatgaagctggaaaccataattctcagcaaactatcacaaggacagaaaaccaaacaccaaatgttctcactcataggtggaaattgaacaatgagaacatttggacacagggtgggcctgaagtgaggtagggggaggggagagggatagcattaggagaaatacctaatgtaaatgatgagttaatgggtacagcacaccaacatggcacatgtatacatatgtaacaaacctgcacattgtgcaaatgtgccctagaacttaaagtataataaaaaaaaaaaaaagactaagtatcaaaagaatgttcaaataaggttcagaatataattttatgttcactcacaatttcttcactcaagtatggtggacagataaaaaatatctatacgtagcctttctcatccctggagtggggctgagctactttttcaaaccaaactaggcatggtcctgtgattctaaaccatgaagttatatattttttaaatatccatagacatgtaatattcctccagactccatgcaaaaacgagttgtccaccggagacttgattagagggaaaactagtatttaataaaactagcaataaatttttaaatactaaactagaagtgttttgtgtataattacaccacaaactaagagattattatatagctaaaggtggatttactttcagtttcacataaattctgtaataagaatcaaaagtaaaattagactatactagagaaaaatcagaagcaggcattgcaataatcagaacagaaattaactgcagaagatacagctttcatcatcagctttcaagatacttttaagtgtttctcttgacctttaaaatgaagtacctgagttataatacttgtgctgagaatatcaaagaatcagaattcagcaataatatggactcaatgtttgtgcccctcaaaattcatatgttgaagccctgactgtcagtgtggctgtacttgaaaatggggcctctaaggaactaattaaggttaaatgagataatgagattggggccttgattcaatacgattaatgtccttattaagtagagacactagagaatgctcgtgtgctcgctctcgctctctctctctctctctctctctctctctctctctctctccctccctccctgccttcctccctccctctctctctctttctgcacacagaggataggacatgtgcagacagtgaggaggtggccatctgcaagccaggaagacagccttcaccagaaactgatcatgctgtcaccctaatcttggacttccagcctccagaaatgtaataacaataatttgttgtttaagccacccaatctatggtattttgtcatggcaaccagagcagaataatacagtcatcaagactgccaacaatcttctaggatccttttcctgctcatactccctatccccacatacacacatataatgatttcaccaaaaagctgatggcttagcaagcagcatatggaaagggggtggctaaaaaagtattaagattcttatctattactatcaaggaaaatttcatgcatatacttttttgctcctctgagatctcttccacttaaagttactactgatataaatatatagataaaattaatgttatactcattatatatcataagaatgttgaggtaaggccatcagagtgtgatttagccacctagggaaaccctgagccgacttttgttggtgtatcactaaatggcaataatagaaaggggattctgaggtcctcattctctcttatgagaacacaaatcctactatatattactgtggtaattatttattgtatataatgtgttaaaaaaatttctagattttggcaatataattgacaatataaatcaatgtatttcaagtcattgaaatacaagctaaatttaagaggtagaaacactatcacaatcaaattaatacttggaagacactagatccattatttccaggaaaagggataattttggtacaactaataaaaggtatatcccaaataaattggtttttcagcctacttactatctactttcttccaaattgttaacttataaagacttcttctagctctaagcgagaaacgaaagccaaaaactctaaattcctactcttatgatcttgaggctaagactctgaaaactacttttgtcctctgtcagatggccttttgctaggagcggccaggaggaggcacaggaaaaaccctgggaggcagggaaggggaggaaagaattcttacttcctgttcctgtcttccttgcagaatgctagctctgcactccaacagcacccatttgcattcttagaactagtttcattgccctcttctctgaaagattcatagtagccagggcgtgactgctctcaagtaatctgagccccaacttacagagtctgtactcttctaaattgtaaaatccctaacctcttccttgtgtgcttctggccctggagatggtagctactccttgctgttcttgctgggctttccggttttgttctttcagccttatttaagattatgttcccattgttgaaatacctagtgtgcttcctgttttcctgactggactttcaccaatacatatatgaaaaaattatctttaaattttaggaaggagaacccaagtaaaactatttaaaattccacatagatcttccaaaattgaaaaccatttcaaatacaaatggatttcatatatctatatatatacacacacatatatatgtgtgtgtgtgtttatgtgtgtgtgagtatgaattttatatatacatatgtgaattatacatatatgagtatatatatgagtatatatatacacacacacacatatacatacacacacatatgaatgaaagactcctttagaagcactttgcctacatggtacaaataagcataggtttggggattttacatacagaaatagaattatgccatatattttgttctgcacacaaaacagttaactgtgtaatgacaccctaaaaagtgagagtgagagcaaagatgaccttcacttttcacttttgacattgattaggttttttatactgagcattttacagttgcaattaattttttaagatttgtgctgttgaagcaaacaattttctgttgttttacaggttattgataggatcaccagccctgtccttttaattgcctaacacagtcttaggtagcctacagcaggcacacattaaatgaccaataccggcttcaagtttctcctctctaacttggcaaaaaagattaaccattatggttcaagccatgtatgtaacactctagtccaggttttctcgtcttgaatatccatgcctttgtaagcataacacaattcatgcttcagtataacactggggtcgtctttacagaacacagatcatgttaccaaaagtgacttcaaactaaaataaaatgcctatttttatttctcaaacatggtgaaaacgaaaaatggtcctagtaacattttttatcaccgttttcttctttcacccctgctatgacattatgtttgcgctcccaagctacacccctcaaatcctcctcacacctcacaacaaaaacaaaaacaaaaccaaactccttccagcaatttctagtttatcttttctttttgatcttgcatcacaaaatctcagatattaatctgtccaatataacacattttggacagcctaggagaggaagagtttgagtaggtcagaccagaattcttttgagtagggaggaggaatttaaggaactgacagcaggtaactgatatctgcccaggctgtgtaggctgcatggtgctatagctttccctctctgtagattcagggctccaaatgtatcctttatgacagtgatgtcctctttgcagaactaacatttttctaacgctaacaagacaggatggggattttgaacttgttaagttacatctatttatagtggcagcttccatttgaggctccctggtacctcccatttgtgaggctctgtggtaccttcatgcactactatgacacttttcattcttcccaagcaataagtcactagagttattatttattcatttccaactcagtatcctagaagttatgtaagtgcaaataaacatggactaagaatcaggagcaatataattcataatttgtcaaaaaattcatagttgtgataaatgtaatatttttgttcagtttcactatcaagaataaggaaaaatgcctcttctaccactttttaactaatatatgtgaagtatataaaacatgtacaataataggaacatagtacatgtacattaggtagccactgatttcttgcttgaaatataaagtatatgaagtttaaagcactggtagaaatagtaacatttatagttgttaaggagaaataagaaacatcattcccaagagaaatgagcatgtcaaataaccaaggaggaaaggagggaaattattacagcaaggaaaggggagaaatagcagaaacggcaatgttgaatgcaaagatgcctataagtactgaggaatgggatctaatgtcaatgaattcatctgcccaccctagctagtattgcaagatcatgagatttaatcagtttttggcattttaccattggccttctactgaattaacaatagaaaactcttatctcaaaacagattaaaatactaatttgtatacaaatcataactataaaagtctattataccatcttcaaattctgacactggatctctccatttaagaaagaaaaacaaaatacatcacagttccatttgataatctcacacattgggtaatttttcttttattttcattggttttgttttaatgtgaaaatccctcacaaaaaataatcataggatgctgtccaggtatattttagtgctctgggaaaagatgaatagccaacctataataacgcttgttcaaggcctagtaatcactacaaatgctctggcctagttgggaaggccacctcaatccttatcattgcttacagacagcagtaaagcacaaaaacactgctgagtaatagctggtgacctcatcactctttcctacagaatgttgtcctttatcagtgtcagtctcaaatcaatcgattagaatacagcgctggttataaaaccccacttgccttctgcttcagtgtaatgcaaccattctgtttgtttgctcctcaacctcaatttgcaggaaaggaactgcaaagatcaattggaaacctcaacttatgcacaactacttggaaatcatttttttatattgatatagtgtcaatgaaaatgaaagtgaaaaatactactcacttgaggggaaaaaaaagaaatactctcaagagctatgttcaagtacaatacaaaggttgagtgattggaattcttttgtgggtaacctgagtgacagcggaagaatactaatatgttgggcctcggggaagtgttagcctaataatctctgccttctcttacagtgcatgagtgcaagactcttattctgaaaaagaaaaataaagtactgagagatgtttaatgccagtaagagacaataatggtacttagaaatttaacaaaccaaagacaaatccagcacttaaaatttatcccaagcaataactataaattagttaaaaagataccaccaaagttctagatccatgtcagaggagtacaaaagaaagaatatctcagtacctaattgccactagatttctaattgcctctaaacctcttccttaactcttactgcagtctacaccacagcttgagggtcctgttgggtagtatcagcattatcttcctaggattgattctgaaacagctacattttatataggagccccctatatatggatatcactaaagaacaccacacctctctggttaaatttgaaaggatccctttattcattttgtatgttatcaaacaagaaacagaagaacattcattccgggacactgtagccagcatgggaaaacactgcaattgagcagtgtaccatggcagacaaatttttgaaatctgaatttttgtttcttcctatctttttccttttcccttccccaactgaaaagaaagtggaccctgtgcttctttgcttcagggaaaggtatgggatgtggattccttgaaggaagtaggaccccatggaaccaaaaagaaacctgaagaaaaagacagaactttctctgaattaacaacaacaacaaaaaaggctctacaaactgagaaagacaaagtctgtggatgtcttcagtgatggggcttgtttcctgctcactaaaaatgtggcaggacctcagaagaaagagccaattagtatgggttgtggggtaaggtgcctcacccaaaaacatcatactccaagactgtcaatgaagcagtagagaagtggctagaagggcaggaaggaggactaggcagatgggactaacaggtcctccatcagcactcatgtgaaaagctaacataatcacaattatcctcacaacacctttaaatgctcattaagtacaacctacaaacatataatctctcagtaaattcaagtcagccagctttcctccaacactggaacagatcatatttcttccactgaaccccagatcaagtacctggattatggtaaagggtgatgtgcaaaaaaacacccatcagaagtgcactcagtttagctagatgcttactgaaaatgaatgatggagcagatacaaagcttgcacttcaggttcactcctgttaccttcttgaatgccctacaaatagaaataattccctgattgatttttctcactttttttttttaacagagttgaatttcaccggattgcatgaaagaattcaactagattaaaagataaatacattaagcaggaacttccatgaggagagcttcctgaataacctatgttattacgtggttatcatgtgatgtgcaaaatcattggtcatgtttttgttctgaaagtagaatggagagttgagaatttggaaatgcttacttctcaaagacacagtgtgttttgttcaaaagggaattagctttagtgctaactcgacttagggtgaagtgaaagacttcagtttgcctgtgtgctatgtgtactgatctcaggcaagttactgaatctctttattccccaattacttcatctatgacaatgtattaagttggggagtgggggaataaataataactttgaaaatacacacaaactacatgccatagcctagtcgctggaatgcagctattgttggtttgtttctccacgctactctcctctcaaaccttatttcttattctaccattgccattcttgttttattgaaattcagagaatgtcattttaattttctaatgtttgctataatgcttgcaatggcttaggcttcatgtaaaatttacaaaatcttgttatatttttgcatcttcttacagctaaaattttaattcattttcttcaaaaacttcaatactttttagctgttagctataaagcaaataaaagatggacagaataagcaatttaataaaaattggatttgcctttttaaaagaaaggttttaatcttcctaaattggccctttgatgtagataattttcaaaagtgggacacttaatagattaaaagttcatgttaaagtctttcctcggagtaatcaagatttggtaaccctttagaactagaatcattaaaaacagcaaagaggagttattagatgtgaaagatcaagattttcaataagcatggtagacctgcaaattttagcaagctgaagataacattttcactgcacatttctttaaaagaagataaagagcattgaatcaatatatcagtgaagagattattatttttttacaagctgaaggttgctacaggtcattcccagtaaagcaaacagaatttgttaatttaatccaacagacttggcagtgagaccaaacaggaatttaatcagcaagagaaggtggtaagcatctctaaaaattgagtgatcgctgtgcaaacagtaaatatcattatggaagggtgaggaaataaaaagagtgttcctttcatgattttcatcaagctcatcaaatataataaatgattccaaataaaccatttctaggactgcaacagtgacttaatgttacttgtgctagaaaattaaaaattatagttttccagtccctcacctttcttaaatagttttcttaaaaactgcaaggttatgaaatgaacaattaagtgtcttatatgctaagtaaaaacagtaaatgacattttagactttctcctctcaacaaaatgtgccagttctctgatgccaacttgaaggcctttggtacaaagactaacacagagacaaggctaagatgtataaggttaacattagctatttagttctatagtaattgctctaaccatcaaaattaagagtatttttatttttatttttttgaaacagagtctcactctgtcacccaggctggggtgcagtggggaaatctcggctcactgcaacctccatctcccgggttcaagcaattctcctgccttagcctcccaagtagccaggattacaggcccccaccaccacacttggctaatttttgtatttttagtagagatggggtttcaccgtgttcaccaggcttgtttcaaactcctgacttcaagtgatccgtccgccatggcttcccaaagtgctgggattacaggcgtgagccactgcacctggccactaagcgtagttttaaagcacgtatatcattataaaaggataagtgaaaagtatttatcatttatcctcctaacccccaccgccaccatttccatgaagtaatcatgaaggcatattcagaatcttctcacttcctgttaccacagagtttccagcttcacctgcctttctttctttccttctcatttcaaccttttgtaaaactctcctttaattgcaggctctccttatctcaatccagtctccttgaggccccttctttaaaaacatgcctttggaattctcttgctgaacgggctgtgtaggtgtatattatatctaaaacaaaaagactttctcaatggtgttttgttgtcttctctctagctatgaacacacaatgttatcattaaaccagtgaattcactatcctatgaaacctcaataaacaaaatttaattagcgtttcccatgagtgacaaacaaaagtaaattgtgtaataaatggcaaaggtccacatctttatttaaaattctcatggaagtcacttttaagtggaccaaagtaaatggtcaacttaccttgaaaccctagaagaaggttgtctggcttcatacaaaactagaccaagatatgaagagaaaattaaaaactatattaagttaagctactgagaagaaagaaaatcaaggggaaaatcaagggatgctattttaaaggtccgactcagaaaatagattgaaaatcttagctttaggggaaaggagagatgctttttcataaacattctgtgtctaaaattgcgccgtaaaatacatgctcatttatttctaacccagcttttacactgtcttgaatcatttatctccacatttcatctcctagaggaagagaaatttctttcttatgattatactgttaaattgtcttctctttagaattatcgaaaaggatggaacattctgcagaatttcagttagtataagtgtctaaatatccatttaaaagtttatgatacctttcaaaaagggccacaaaatcttctcccatccatatatgcacatcatcccctcacaatgtgcttttgcagcttattccatcaagaggtagatttttgaagagaaaaacactgagagtcgacagagaggcaatgcaaacacagaagctgaagagagaggtatccgggaaccttgcatgtggttgtagagcaccaggattagttctcatccctgaatatgtcctaaggaaaggatgtgtgaagtgatggtacagaagcctactttcaccatgaacctctgagatcttagctacaagatcccatgacccccatagacattttaattggcaaggggatctgcccagacagtaggcagagacagaattccagcctgtacagagcccaggtggatttgcaagtagggcagctgcagcaaaatatgaccataggttaccaaacccctaggctccccaacttcctccaaatagttctaaccccagctgaccacaaggccaggagagagcagggccatctttcccatgtgactggggcacttctcttctgcatgcctctctgcccaccagccacttgaaaggcccctggctggctgttcccacaagagcatgtatacggcacagcctccactgcccagtctgagtgctttgccagtggccccacctcagtgttttcctggtggcctgggagcactaaatctcccctagcatagacaatgcccaaccccaaggggccagaggacaaagctgtgggcctggtcccaaagccccagggtaatagcatacagctaaggtgtgtcaatatgagatccgtggccagcgcttgagcaagggaagagtccccactctcaaaacattgagaaaagttagacacgggttcatgaactgacacaggaacaaggtatactttcttccacaggactggtccatgaaggatgtggcctgtctgccagccacagcctttgcctgaggaatctctgtggcccaaaacacctaataaaagaaacacaagcatgaggtcagtgattggacaggggtcccccccaagacctggtgagggggtcatctctgctcccacactgcacagagcactgctgtgaacatactgaaataaaaaagagctgcatggctgggtaagaaccaatcagccagccattactcttaagtaccatctactggatcgcagcttcttcttccagtatatattctctgtgaaacccagggcaagaatgtagtcactaataaagatcctgtacagaggcttggccctctgaaagtaatccagaaacaaagtgaactcaactatactcaacttacaccaaagttaattcctcaaggaaaataaagaatagaaaaacaaaaagctccatccaaacgacagcaaatccgaaaacacaaaagaacgcaagctttcttggatgagaaagaatcagttaagaactctggtaatttaaaaagtcagaatatccctttatatccaaatgttattagctctccagcaatggttcttaaccagattgaaatgactgaaatgacagacatagttcagaatctggatggtaaggaaactcattgagattcaggagaaggttgaaacccattccaagaaacccggtaaaacattccaagagttcaaagacaaaatagccatttgaagtaaaaaccaaacaaatcttctgtaattaaagattgcactgcaagaattttataatatagtcggaagcattaacaacagaatagaccaaactatggaaagaatctcagaggtcaaagaccagttctttgaatcaactcagacaaatacttaaaaaaattcagaaatgaacaaaacctctgagaatatgggattatgtaaagggaccaaactacaactcatcggcatttctaagggagaaggagacatagtaagcaacttgaaaaatatattcggggatataggccatgaaaatttccctaatcccattacagaggttgacatataaattcaagaaaatacaaagaacccctgtgagatactatacaaaatgaccattcccaagacatatactcatcagattcaccaagtcaatgcaaaagaaaaattgtaaaggcagctagagggaagggtcagatcacttacaaagggaattccatcaggctagcagtggacctctcagcagaaaccttacaagccagaagagaccggtgcctattgtcagcatccttaaagaaatttcaaccaagaatttcatatcccaccaaacttcacataagtgaagaagaaataaagtccttttcagacacacaagcactgagggaattcattaccactagaccagtcttacaggaggtccttaagggaatactaaatatggaaacaaaagaacaatacctgctactactaaaacacacttagacacatagcccacagacactataaagcaattacaaaatcaagtctgcaaaattaccagctaacaaaatgatgggatcaaaatctcacatgtcaatattaaccttaaatgtaagtagtctaaacaccccacttaaaagtcatagagaggcaagttggataaaaaggcaagcctccaactgtctgctctcttcaagagacccttctcacatgtaacaccacccatgggctcaaagtaaagggataaagatctattatgcaaatgcaaaacaaaaatagactataaacaacagcaatctaggaggatattacataatgataaagagttcaattgaacaagaagacttaactatcctaaaaatatatgtacccaatattgaagcacccacattcataaaacaagttctttttgacctatgaaaaggcttagacatccacaaataatagtaggagtcttcaacaccccactgacataattagacagatcattgatacagaaaactaacaaagatattcaggccttaaacttgacactggaccaagattatctacacgatacttcacccaataaccacagaatatactttcctctcatctgcacacaaaatattctaagatcaaccagatgctcagccataaagcaagtctcaatacattgaaaaaaatcaaaataatatcaagcaaactctcgggccacaatgcaaaacagaagtaaatattcaaaagatctctcaaaactacacaatcacatggaaattaaacaacttgctcctgaatgacttttgggtgaacaatgaagttaaggcagaagtcaaaaaattatttgcaattaatgaaaatacagacacaacataccaaatccttgggatgcagctaaaatcagtattaagagaaaagtttatagtgccaaatgcctacatcaagaagttagaaagatctaaaattaacaatctaacattgcacctagaggaattagaaaaacaaaacaagccaatccaaaagctaacagaaaaaaagaaatcactaaaatcagagcagaactgaatgaaatcaagatactatattgtgtagtggccaagtttggatttttaatgtacccattacccattacccaaataatgtatactgcacccattatgtaatttctcattgtccacctccctcctactccgaaacccttccacatctccagtgtccattattccactgtatttgtggaatactctctcctatttgtcacctttgcccttttttctgctgataaataaaatgttttatatttaaaaagatacaaaaatcgatatgaaagatcaatgaaaccaaaaggtgattatttgaaaaaataaacaagagtgatagaccactaactagattaacaaaggaaaaaaagagaaaatccaaataagcacaatcagaagtgacaaagatgacattacaactgatcccacagaaatacagaagatcctcagagacaattatgagaacatctacgcacacaaattaaaaaacttgagaggaaatggataaattcctagaaacacaaccttccaagattgaaataggaagaaaatgaaaacctggacagaccaataacaaaatctgaaattgaatcagtaataataaaaaaaaacctaccaaccaaaaaacaaaggtcaggatcagatacatttacagctgaattctaccagacatacaaaaaactgctatcaattctactaaaactattcccaaaaattgagggagagggattcctcctcaacttattctatgaagccagtaacaccctgatacaaaaatctggtaaacacaacaaaaaaataaaatatcaggtcaataatccctgataaacatggatggaaaaatcctcaacagaatactagcaaacggaacccagcagcacatacaaaagttaattcatcatgatcaagtaggctttatttttaagatgcaaagttgattccacatatgcaaatcaataaacatgatacaccacataaacagaattaaaaacaaaaaccatatgatcatctcaatatatgcaaaaaagctttaaatccaacatcccttcaggagagaaaccctcaacaaattaggcatcaaaggaggatacctcaaactaataagacctatctatgacaaacccacagccaacatcatactgaagaggtaaaagctgtaaccattccctttgagaactggaatgagacaagcatgcccactcttaccactcctattcagcatagtactggaagtcctagccagggcaatcaggcaagaaaaataatactgcacccattatgtaatttctcattgtccacctccctcctactccgaaacccttccacatctccaatgtccattattccacagaaatacagaagatcttcagagacaattatgagaacatctacgcacacaaattaaaaacttgagaggaaatggataaattcctagaaacacaaccttccaagattgaaataggaagaaaatgaaaacctggacagaccaataacaaaatctgaaattgaatcagtaataataaaaaaaaacctaccaaccaaaaaacattcatatggaaccaaaaaagtgcccaaatagccaagccatcataagcaaaaagaacaaaatcagaggcatcacattacccaaactatacttcaaactatattatatatcacattacttcaaactatattataagtctacagtaaccaaaacagtatggtactggtacaaaaataaacacatagaccacagggacagaatagagaacctagaaataaagccacacacctaaaatcgtctgatctttgacaaagttgacaaaaataagtaatgtggaaaagactccctagtcaatagatggtcttggcataactggctagccatatgcagaagaatgaaactggacccctagctataaccacatgtaaaaattaactcaagataggttaaacacttaaatgaatgtccccatttataaaatcctagaagaagaccgagcacattggctcatacctgtaatcccagcactttgggaagctgaggcaggtggattacttgagaccaggtgatccagaccagcctggccaacacggcaaaactccatctctactaaaaatacaaaaattagccgggtgtggtagtgcacgccagtaattccagctcctggggaggctgaggcaccagaatcgcttgaacctgggaggtggagcttgcagtgagccgagatcacgccgctgcactccagcctgggtgacagagaaacactctgtctagaacaaaaaaatgctaaaagaaaacctaggaaatacccttctcagtatcaggcttggcgaagaatttatggctaagccctcaaaataattactaccaaaataaaaattggtaagtgggatctaaattaaactaacgagcttctgtacagcaagagaaactagcaagggagtaagcagaaatcctacagaatgggagaaaatattcacaaactatgcatttgagaaaggtctaatattaagaatctatacaaaacttaaatcaacaagcaaaaaagaaataatcctattaaaaagtgggcaaaggacatgaagtgtctacttcttaaaagacatacaagtgggcaacaaacataaaagaaatgctcatcatcactaattgtcagagaaatgcaaatcaaaaccacaatgagataccatttcacaccactcagaatagtctttgttaaaaattcaaaaaataacagatgctggtgaggctgcagagaatgggaagcacctgcacactgttggtgggaatgtaaattagtccagccactgtggagagcagcttgaatatttctcaaagaactaagggtagaactaccatttgacccagcaattccattactgggtatatatccaaaagaagataaatcattctgccaaatggacatacacacccttaagttcaacacagcactattcacagtagcaaaacatagaatcaagccacgtgccccaccatggtggactggataaagaaaatgtttatatatatgtatatatacaatagaataccatggagccataaaaaagaatgaaatcatgtcctttgcagcaacgtggatgcagctggaggtcattatcccaagcaaactaacacagaaacagaaaaccaaatatcacgtgttttcactgatatgtgggagttaaacattgggtacacatggatatacagatgggtacaataaacactggggactactagaacagggagagagggaggatggaaaggggccgaaaaactacctattgggtatgatgctcacgacttgaatgacagttcagtcatatcccaaacctcagcatcatgcaatatacctttgtcacaaacctgcacatttacccccaaatctaaaataaaagctaaaatgaaaaaggagatttttcagcttcttatttgccctcttggaatgctgttctgagactgccatgaagaagcccaatataatcaattaaagaataataggccacatggagtagaggtgtgtcattccaacttaggccccctagttaagcagccaatagccaatatcaactgctagacatgtcagtactgccatcttacaccgtctagcccctttagagctacagaagttagccacatgagtgaacccaagggagagcaactgcagaagcacccagctgagtcaagaccaaattatttacccatggaggaaaaaaaagtttcgagtgggttcttatgcagcaatagataactgatgaagtaccatatttcctaattttccaacgcaatttagattttaaatattctgtcctatcatatgatgtgtcaaatggatactattttttacattggaaatatggtcttacaagatagtaagtactaaaatgtgttccataatgatggttgacctaaatggacacttcttaccttctagaaggtgaattgttattattatctagtattaaaataaagtcattttaaccctgaacacagctagcttttctttcactcatgcaaactaaaagtgggggcagataatcaaatttaactgcctatgtatccatagaagtattacagctattactcatgacatctaagtccagtaaattccttgtacattcttctccaggtgtcactgcctcatggccactctttctgccacatgcatccatagaaaagcacaaacacataagagataaaatgaagagtgagaaaactgtagattaaggggcaaagatgaataactgttataatgacacactgaacaatcacatttctataatacatttttgttcgaattgcctcccagctagacctctccttggggagatgctgtgtaatttctctggttatgtgatagaaccaagatgaaagataactcacaagctcctgtggcttaaaatataatggttgaaaattggcgggttatttttaaaggatttttgtcaaggaaagagagaactatgctcttccacccccagccactgtccttccacaaaataaaagtcaaattgtttcttctgtttttaaagacgttgctaaaaagttatagtgcaaatgtttaatgagtattaatatactaccctaaataacatctctctttttccttacaataaaaaccaaaagatctaaaatttcttcaaaaagcagtatagtcagattctggggaaagaaatcaattttataaatcatctataattgaatatctgtaattgcaaaagctgtcactgtacaatcatatacctcatggaacagtcagttggattatatgattacttattttaactcccactattcttggaagatataaaaagcaagaattcatatatccagaaccttgtctctaaggatagctgactacttccaccaaagttagaatttatttaaatactgattataaattaaggtcaaatcattttaaatcttctagacaattctagtgctggtagcacttctgttcaaatatgctgaatcatctgaggtttttttttttcagtatatactctacaaatgggaaaacttttcaatgaaaagctaaaattgtagaatcttagctctaaaagggaccacaaactttttaaggttatatatgaggaaactaaagatcacagagttgaaataatatacctggagtagcagggtttgttagtggtgatgctagtttgagaaccaggtttcctggaccctctgaccagcactctctcctccataccatgtggactcaccctggaaattgtgttctctgtggatgggaagccctggtataacccactcctgaatccaggagcggccacacctgagcatggaacttctataacccttcagacgcagccctatccccaacttattaattcagattctctacaggaaagcaaagtgttagcaatatctaaatgatccccaggagattctggtatgcgcctagggtggagaacacctgtaatagtttctcatcctcacccccttaattgactcaggcttaacaggttaggagtcacagtctttgacttcctagaatttctggctctctttggccccttgatactctagatatcaagaacctaattctgagagttcagacttttggagaacagaaaacaaaaaggggatggtggagaataattaaagtacatgggtcttagtgacaggcatcatcagtgacacttcctacagacacatgagaaattacaagagaaaactatcaagaaaaaacttgatttggctatataaaaatggttttacttataggcatttgtctcaactgctaaccaagtttgcaataacatatatcagattgcttatgggttcatttcattatataagtagaccactcatataaagtcatagttacctcctcacaagttcatgaaattgtaggcaatatgtcttagatgcatgcttagaaattatgacattggagataaacaggcagaatatctcatgtttaaaaaaaaaggtctaaatcagtcagaatccatgttagctatatcacaagaaaaattattagcaattcaaagagcctaaaatgtatcaactgatcctcaatcccaacccagttctcaagaagtaaagctaaatctgggttattttgaacctcagaaatgagaaagataatatttacttgctggaataagattacaagtaaagatggtccctcaccccttgaaagtcttgctcaattcttgcagttgtgttgaaaaatattattttttgaaagtccgcaggccatttaagtttccaggtaaagcataaacatagcctggtcagcagtggggtcacatgtctcagcctgcctccttacacaggcagaattttcattggttaaatactaattttgatcatatttaataccaactattaactattaggcttaaatactggaatctgaactacctactcaagaaaaagcatgtctctgaagctgcttggctcaattccatgtgaacagtccaatatttcagaaacaactgtgtcccttaagccttcaacagaactagaaggggaaaagttagtttgcccagtttttcttcatgtcccagcttgaggtatattttatagaactgattgtctttttcctgcctctgtcaccaattcttccccacgccaacaaatctcacatacggaaaacacaagttaattaagcattgtattacagagtattaatagaaatgtttcagatgcttttccttaaatccctatgacacaattactattgccctgaaggagaaattaatttttattgtaaacagaaatacttaaaaacatagttaaatgtttaaacatcagtttaaagaacagattaaaggaagtgatagttaaaccaaaacattatatagtccagcaaagtaatgtgaaaagagaaaatatcctctcaccattctaagcacattaagagtttttcaaagaatttcactcacttgcatttcaagaaccaaatatgaatgttgccaatatctcacttcacttccttgcagtctaaccacggatagcatcaagaaagcattgcttccagctcatcgttctccctcccttagatacattaagacaattttgatacatcaacaaccagagacaatgtaaaataatgtcagagttaaaaatcacaaggctttgggaggccaaggcgggcggatcacaaggtcaggagatcgagaccatcctggctaacacggtgaaaccccgtctctactaaaaaatatatacaaaaaattagccgggcgtggtggcaggtgcctgtagtcccagctactggggaggctgaggcagaagaatggcgtgaacccaggagacagagcttgcagtgagccgagatggtgccactgcactccagcctaggcgacagagactctgtctcaaaaaaagaaaaaaaaatcacaaggctacaagtaactttcggcatttatgtggtacatcctccacctccgacataatcatttaaccagtggttctcaaccttgactccacactgaaatcacctgaaaagctttaaaaattctggtgcccagctctaaacctcagaaattctaattcaattggtctgaggagcagcctgagcatcaagatttttaaaacctctctagatatattagttcattctcacaaagaagcttctttctaataaattaatattatatttaaaaatcctaaaaaaaaaaaaaaagaactccccaagagggtaatttataaagaaaagaggtttaattgactcactgttctgcatggctggggaggcctcaggaaacttgcagtcatgatggacagcaaaagagaagcaagtacctgcttcacaaagtagcaggagagagcgcccgaaggtggaagtgccacactttaaaccatcagatctcgtgataattcactccctatcaagagaccagcatgggtaaaaccacccccatgattcaatcacctcccaccagtttcctcccctgacaggtagagattatggagattacaattggagatgagagttgggtggggacacagccaaaccttatcaccagatgattttaatatgcagccaagtatcaaagcccatcaaataaagaccaccaagaaaacacctgtagttaagcaatgaggcctgcttaccttgctgaaactccaggaaaacattgagggcttctcagtaagagtcagagggtggtgggtggggggattttagtagattatttttaggagtgattagggaagcagggaaagtttctggattgaataacatcaagaaattggggaaattctgtgattgggttcctcaatcgtcttcatccaagagcagtgctatcattgataaataagcagagatcatcaaagaggcaaagttgctggcaatgaggggtgttagtcatttttgtggttaagatgtaacctaaccattgtcctattctaaatatggtgtatttacgttctttggtgaagattttggtctggttttcggcaaggccaattttttctcagtccaattgggccaatttttatgctatcagaaggttgagaaccactgatttaaacaaactacctagctgaatatgaatgctgcctgattgtgacatctgtcattctttagattccagagttaaagttagcaaatctggcttattaaacatgttttttttatttctccccaatttatccaagtgaaactttcccaaagctaaatcttcccagagaaaattctgttcccttcccttgatacaatacatagttacacccacaagtttaatttgcaagagaatacatgctacattcttaagaaaaatctaatttaaaattgccccttttggtaaatcatctttaaaacactagttatgctgtatttaaaactcattttctacttattctgttcttgatggaagctattgttaatttttcacaagtattggctcagggctttcttgatacggtactacccgtgaaagatggggctccttacagaaatgtttttgacaatgttttgatgattcacctaatgttctgctctataacaaatcagaaggttgcaatcatttatgttttacgccaagaatcactgtgtgtatttaatagaaattgggatatttaactattctttggcgatctgaaatatctgtttactgtcttaggaagcctgcataatagtaggtcatgtctgcctgaaaataagatactttcagtgttttacatgtgtcaatacagggtatcatttttatttctttatcagagatagacaatacagtaccttctgatggtatagccagactacccggtattcactgagaaccctactcagggctgcctattcttatttttactacctacacctcgatgggatacaagtttctctcacctaggcagagttatatccactgctgagatttaaaggagtctggaaatggcactattatttctctacttgagttctgaaccagttaagaaaaccaaatattaacattagcaaaaagatatttaaagccctaaaccaaaagaggccatatcacaggttgactcctccaggtgcatatactgagagagagttggtgttcaagacatatataaagaatcaaaggaaggggaggaagcagaatggagcagagaaaaaagtcaaactgtgatgaagacccaaaacagccttggccaacctggcaggagctctagagcgagactgcccattagagtcatctcacagttggttgaaatggctgggccttttaatcttgtcctagttcagtcacaagatgtgggatgctctgaaaagggcatattcttgagcaaagacatccatcactttgcagctgaggctgaccctaagaaagcaggcagccggagacattctgctgaccaccctctcctcagctggtcagtgagttctttcttggaggggctctgggtaacacatgttcatgtctaccacagaccatgatggggaacacagctaaggagttcagcaacaagaggtttcccaatatgatatccagcactagatttccatctagacacaggcagcactgagcaatcacagaccatctgctgagatagatgggcaacgggaaatgagcagagatgcgggcctagaaaatgcaggtctcgggccgggcacggtggctcatgcctgtaatcccagcactttgggaggccgaggcaggtggatcacctgaggtcaggagtacaagagcagcctggccaacatggtctctactaaaaatacaaaaaattagctgggcatggtggcaggcacctataatcccagctactcaggaggctgaggcgggagaatcgcttgaatctgggaggcagaggttgcagtaagctgagatcccaccattgcactccagcctgggcaacaagagcaaaactccatcttgaaagaaaagaaaaaggaaaagaaagagaaaaagaaaaaaagaaaagaggggagggggaaggaaggaaggaagggaaggagggaaggagggagggagggaggaagggagggagggagggaagggaaagaaagaaaagaaaagagaaagaaaatgcagttctcacaggcaagctgactcctgaagaagagaaacacaaagagcctgagatatgtgtatgccaaatttttgctcccacatttcattaaacagattttgctccatgagagggagtttgagaacagatacagagacaggccaggagcgatatgctaatggtgaccctcacctgaaaggaaacaccatgagagaaaggtaagtggtctcctctgtccacctgagtcacagatggtcagttaaaggcagggcagtgaggcttattctcatttccagatgtccagattatcacagtaattcaaagctctcatgtatacagtaatcccttttctacatacttataaatattattccatttgaaaatttagttactcgggagttggtttggttggttggggacttggaagctgaattttattcttgttgtagttgcatacaaaataatagatttattttccaagttctacataacattaattttttttttttttttttgagacggagtctcactctgtcgcccaggctggagtgcagtggcgcgatctgggatcactgcaacccccgccttccgggttcaagcgattctcctgcctcagcctcccaagtagctgggactacaaggcgcctgccaccaggcccagctaatttttgtaattttagtagagacagggtttcaccatgttggtcaggctggtcttgaactcctgacctcaggtgatccaccctcctcggcctcccaaagtgctgggattacagatgtgagccaccgtgcccagccaacattaatattttttagatgctctgtactcttttgtgtcttaatgcaaaaatcacaatggttattttaagaagtctgtggcaaagtgatgttgtatatactgcaagtggcaattcagcagtcagattttttatcctcattcccctttcagctacgcaggaaagggagtgctttggaactcagatcagggaatcacagtagcactcagagcgcaggaatcaagtgcagccatggagacacccacttcctcagtgaggtgttgaaggtggctctaagagcaaccacaggtgcaaatcagcttttaaagaaggagcatgggataggtcaagggcatgtcagtctttctcagccagccaaagacactttaagtaataggctagtccttcctctataaaagcatgataacaagatgttaagaaattttatttttaaaatattggccaactgtttaagtaaaattccatgtcacggagatttgctaacaagataatatatgacaaggtgttaatttccgtatgtgcagttaagacaagtcagtcgttcgaaatctatttcagactgatggtctaaagattgccataggaccatttcctaaaaacacctccaactctttagaatatctgcctgaaatagttgaaacacagccaaattagagaaaacacaaatctatattggatctgcctgaacccacacctttaatgatatttaacaaagtgtggtcctatgagcaccttacacaaatacttcaagcacttactaaaaacccagatggctggaccttacctactgaatgagaatatctaggaagtatggcccaggaaggagtctgcatggtccgctagttcccccaggtgattctaatacacactctaatttgaggaagcctgttagaaattcaggctgcaaaaggtcagacatgaagtccagaattcaggctcaatgaaaaaactctacagaattcatttgacatttatttgggaacagtatttttcacaagagaaaactaaaactcttacttattcattcaataaatattttattgtgttcctgcctcatctagaccctgtgctaaatgcagtagattcaaaaatgaaatgcatagattgtaagaatggtctagaatcatcacacattatgactcctttcatactgaattcagacctcggggtatgtatattactagcatttaaaatgagaattctggggagaaaattaaactcatgctcaagtagaactatcctaaggaaagaaaaacattaaaaagtttacagagaatacaattaaatgtatccattcttctgtggaaaaaaagtggggtgtggagggatgaacagacatgcatgtcactatttttaaataaaaagttatcttgaaacgagatcagagcttagaggatgactcctaccccaacctgaatcacttctttatagtagaatcagagagttgatgaacttttgatctgtcctttctttctttggaaacatacatagatctaaaacctggttatcaaaaaaggtcatgaagagaggataaaaggataatatataaagcattgttgattttccataaagtatccatgaaacctgcagaaagaatctccaaacactaaacccacttcacacacactaccacaattcactagaatattcctccttgcttgctagaataagctaagcttgctcaagattgaacacctgaaatggtttctacaaagtgtacacaaatatggttatggtatgagaagcacatacacgtaactccatttgaccctcatagcttttgtttataaaaagatttcaccaaatatttgtttataattttgtcctatgatcagacaaaacctcttctgatggttttgtccacatcttatcaaaatcaaaacaaagaaaagcatgcattgaaaaaaactggaaaacatattttaatattaaaattaaatagaactatggtttatttttctacatttcctaaatatttaatagtgagaatgtattactttataataaaaagcattttaaattaacttcttgatagggagttttattttatgacaaaatataatttttaaagtaaaaataaatttcaaagtaatagtcttcaatggtcattgtttcttttcatcttatttcctctcctctttaatatgttttacccttcaggacagatcatcgatcatctctatgttctttcaaacatatgtaagtttcaacatttttgttataacaagaagttctggcttttctttttctcttctcttttgttgcagcctcataaattctaaccacagctgtccactctacctcccattattctcaatagtcttgactaactgactttgaaagcatattgcttcagcacattaacttttgctgggcaccttttttccacacctgactctcctaccttgcaattttatatctactctaatagttttctaggtaataaattatacatgacatctgtcttgtcctagtttttaaaatccctgtagcctcttagaagtctttttaatgtccttattgtcaagtccaaaccaactctgatatttccttcatgtaatactcttctacttatcttttttctatctttgcccttacactttttactccaccatctttctcagcattttcttcagtagtttttttttttctccctctaatgctatccatagcttatgcttcttgctttcttctttttctacctcttggtctgcctctttcatttgctgtaaatttggtgtaaaatcacccaacccatggtagatccctttctccttcttcaagtccagataccatgtgttctttaatctgacataaactagccacaggcaaggctcatttgattcttaccattgagccttaaaattagctagtgtggtgaataagacattcataataacccttggctcataaatgagaatagagggagaaaggttaagtgatctttccatagacattgaataatatagtgattgagtggtgaacaaaggttaactacatgattttgttttcctttgttttcacatagatttatattctgacaagagcagacagatgtgtccagccaagggaaggccaactagtatagtactattgctctaatgtctaatattttaatagattagctatggtaaaatggcctatgtgaatgaaaatataagttgcttgcagagagagttcaggaattctcctttagagaatgcatcactttgaaaacacaaggcactccagaaatgcatgataaataaaagaatttttaaaaatggttaatcaatctaaatggtatttttacagtctataagaattttaaatttttctgctagaataaaaccccctaaagatttcaatcttatagacacttagaaatcccctggatcataagaaatagttttaacgatagcgtaaagtttaaaatgcacacacacacacacacacacacacacccccacacacacatattctcagcaaacaaataacatgacaggtagtttgatcacatttcacagaataaaagtataaacatactaagtaaattccacactaaatctccatcaccacatgtgcatacattataagtaaatatatcaaggaatctgaacgcttgagaaatgccatatgtaaaaattatctgacactggctttttaaattcttcggcaaattttgagtatgcacttgacaccagaatatgtaagcaaacaatgtaagcatgtatgcacccaaattagaagcataaatagtcatctaggcagtagatgaaaatgtcattccctaggatgggtacagtttcatgggtaattgatcatatatgccaactctgggaatgtattcccagacagtgacttgaaagaccttgaaactataaaggcaaggaacataatattgctagaaccagagtgatcattctgacttgaaatgacttgaatgtgatattacacaccaaacatgtaaaaaaaatttcagtactatagaagttaaaaagttgtgaggaaaacaaaaggtggtaggattcttcagaattacagcaaaccatccatacctgtgctgtccaataccatagtcaccagccacacataggtattgaaatatggttagtccaattgaaaaactgaatgtttaatcttaattgtaattatatttaagttacatttcattaaattaattttaattaatttaattttaattttaaaaccagtcctcaataccattattagaaaatgtttaaaaatatttggagctgggcacagtagtccatgcctgtagtctcagctacgcaggagtcaggtggggggctaacttgagcccaggagtttaagaccaacctgagcaacatagcaagactccattttatataaattatttaaattaaaatatatatatatatggacaacttaagtatgttaatctactttttcaactgtaaattttatgaaatctaaatgcatactaagtctttccagtaaaaatttagtgtccaaattaagatatgcttatccactcagttgttagctacttgcaaaaagtcaaagacaaataagtaaataatgattttctcaagcgcagcacatcctgttaagtacttactaaagattcagaaataattaaagccatgacaattaaatataaaactgcataaaatttccccctaaaaataacaaaatggtacaaatcaacaagaaaatgtcctgaaagaaactagctatcaattttctggtcttgaactgaatatcagaatgaatatcaagagatcatggaatcatcaggggtttttactattcttaacattgagtcccataactatactggacatgaattcaaaatgcagcaagccaagtcataattagatagcagccaacctcgtgattactcataatcttaaaacacattaccaggactcaagaagaggatgttggattggaatagatgaaaaactacccacttggtgttatagatcaaagggaatgtattcaggctaaaacaaaccaaaccaaaggtagaaaaactgattaaatttttgtcttggtttttaaataagaaaaattttagaaagattcacttccatttctaagtttcctgctacttccaccatatctgcagtgactttctccactaaagaactgaatctttccaagtcatccatgagggttggagtcaagtacttcccaactcctgttaatgtagtatattttgacctcttcccacaaatcacaaatattcttaatggtgtctagaaaggtgaattctttccagaaggtcttcaatttcctttacccgagattcatcagagaaatcactatctatgtcacctgtaaccttaataaatgtatttcttaaataataagacttgaaagttgaaatggctctttgactcatgggttgcagaatgtatgttgtgttcacaggcataaaaacattaacatccttgtaccagtctatctgagttcttaggtgacaaggtacattgtcaatgagcagtaatatctttaaaggaatcttttttttaattttctgaacagtaggtctcaacagtgagcttaaaatattcagcaaaccatgctgttaacaaatgttctgtcatgtgggctttgttgttcaatttataaagcacagagagaatagatttagtataattgttaagggtcctaagatttttcagaatggcaaattgacattggcttcaaattaaagtcaccagctgcactggccccaaacaaaagggtcggcctgttctttaaagctttaaagccaagcattgacttcttctttctagctatgaaagccccagatggcatcttctttcaatataaggctgctttgtctatattgaaaatctgttgtttagtgtagccaccttcattgatgattttagctatatcttctggataacttgctgtatcttctacacgagcatttgctgcttcaccttacacttctatgttatggatatggcttcttgtcttaaaccttatgaactaaccactgctaacttccaacttttcttctgcagcttcctcacctctctcagccttcatagaattaaagagagttagagctttgctctgggtcaggctttggcttaagggaaggttgtggctggtttggccttctatccagaccattaaaactttcttcatatcagcaataagactacttcactttcttatcattactgtgtttgctggaataccacatttaatttccttcaataactttttctttgcattcacaatgcggctacctgttcggtgcaagaggcctagattttggcctatcttagctttcaacatgccttcttcactaagcttaatggtttctagcttttgatcgaaagtgagagatacgcaactcctcctttcccttgaacatttagagggcattgtagggttattaattggcctaattcaatactgttgtgtctcagggaataggatggcccaaagagagggaaagagatgggggaacagccagtcagtggagcagtcagaacacacacatttatggattaagttcaccatctgatatgggcatagctcatggtgccccaaaacaactataatagcaacatcaaagataactgatcacagatcaccctaacagatatactaataatgaaaaagtttgaaatattgtgagaattaccaaaatgtgaaacagacatgaagtgagcacatgctgttggaaaaatggcatcaatagacttgcttaatgcagtttttttaagtgcaatatatttatttctgctagaaatatattatcaaccttatgtaatatttgaagcattacatattatttgtaaacagcttaaaattatatattaccccaattgtatataagtacaaatgtgtggatattagtttctttcattaaaaatggtgtttttttaaaaatacatatgcacccatttacacctttcattcacttacactgttttatgatgtttggtacctgtttcctcacctgaaaaaaaggattagataagatcgtgggtcccagctggccactcacaggctggacgcagcccgggattactgcacagtattttgggtttgtctttagttgcatttgaaagcctttggaaaagacattgctctcaagttcccactattttccattttctgcacccagtccccttcattcgtgtatgctacccaatgaaccctcacaatcacatgattttgcacctctctgtactgaattatactgaagactccataaaacttaaaaactcctgtatctcatttcagccatgagcacttggatatgctgtaatgatattacacaaagcagaatgacaccaaataagattagccaaattgtaagtcttaatcctccttccacacgacattcctttaaaatatttgatgttatcattaccccctgctttcaaaagtctactctattacccttaatttttttgtgcatgcctaacaccaaccttttagaaatcttttatttggaaggatttcatgcttaaggtagagttgcaagaagaccataaagaaactctgtacaccctttatgcagattcacaattgttaatcttttgccctatttactttatcatgtgcatttacagtgagtagtgtgtgcataaacacacatgcacatgcatagatatgtaatatatacaaattatttttctgaaccccttgagagtaagtagcatgtcatgccccattatctctaaataattgaaagtgtatttcctaaaaacaagattccactaaataatcacagtagggttagcaacttcaggagatttaacaatgatgcagtactttgacgtatcatctgtattccagatttgtcaaattacccagtaatgtcatttgtagcatatcttttcttcagtacagatccacttcaaaatcacatattgcatttagtcatcatgctactttagtctccttaaatatagtacagttcttcagcctgtctttgtctttcatggcaaaaggattcctattgtattagaaatcatgaattcatactgatacctccaattccaatgcactcccacagagtcctcttttcttgctttgccccgtttgatatctgtatggaatacagtggaagaagactcaacaattacctcaacgtatttatttactcaactctaccatacacttaaaactaatttcagattgcttcacctgtacaactacaacacacaaaccttctaaaaagaggtcagggtttgtttgcattgtttctgtgctactcaactaacagtgtatagccagatgatatgttcagcagttactttgattaattccttttttgtcctcctggatagttatgttactcatgcgcaatacaagtgggtttatttgttcggtttgtttggagttttaatggatcttttccttcctatttttatggatatttttaaaaaatagaaaataatgtgctttcaacaaactcatagatctaataagtgattatggcaaggttgaattatagcaaggttagaggatacaagattaatactttaaaagaccgttgctttcctatataccagaaatgaacaattggaatttgaaataaacagttatatcatcactaaaaaaagaaaaaagaagaaataggtttaaacaaaatattcacaaaagctatataaggtaaactacaaaactttgacaaaataaatcaaagaaggtctaaataaatggagagatagtccatgttcatggataggtagactcaatattgtgaggatgtctgttcttcccaacttgatctatatattcaatgcaaacacaaccaaaattccagccagttacttgtggctaagaacaaactgattctaaggtttatttaaaggcagaagacccaaaatagccaacacagtattaaagaagaaaaacagtcagagggcttaaactacccaacttcaaaacttactacagaactatagtaataaagacagtgtactattggcaagagaatagacaattagataaacggaacagagagcccagaactaggcccacataaatatagttaaatgacctttgacaatggaacaaaggcaattcagtggagaaataataatcttttcaacaaatggtactagaacaactgaatatccacatgcaaaataataagtctaaacacagaccttaaatcttttgcaaaaattaacttaaatggatcatagacttaaatacaaaatgcaaaactataaaacttctagaaagtaacaggagaaaatctaggtagttttggttttttaggtacaacaccaaaagtacaatccattaacaaaaaaattaacatgatggactgcatgaaaattaaaaacttctgtgaaaaacattgttaagagaataaaatgactagccacactctgggagtaaatatttgcaaaaacacgtatctgataaaggattcgtatttcaaatatacaaagagctcttaaaactcaacagtaaggaaaagatgaattatgggcaaaggatctctctgaacagacacttaaagatatacagatggcaaataagcatatgaaaagatgctcgacatcacatgtgattagggagttgcaaattaaaacatgagctacaactacatacctattagaagagctaaaattcaaaacactagcaatgctaatgctggtgaggatgtggagcaataggaactctcattcattgctggtggaatgcaaagtggtacagccatttaaaaagatagtttgtcaattcctttcaaaactaacatagtcttatcatatgatctagcaagtacgttcccgggtatgtacccaagtgagttaaaattttatgtccacttaaaaatctgcacatgactgttgacagcagctttatgcataattgccaaaacttagaactaagatgtccttcaataggtaatggatgaacagtctgtggtatatccattttccatacaatggaatatttttcagcaataaaaagaaatgcactatcaagctgtgaaaagacttggaggaatctcaaatacatattgctagtgaaaaatgagctatacactgggcggttctaattatatgacattctggaaaaggcaaaattacagagatggtaaaaagattggtggtttccacggtttggggggaaagagggagaaatgaagggatggtgcacaggtgatacttaggccagtgaaataactctgtgatgctactgtagtagtagatacatgaaatcatgcatttgtcaaaactcatactactgtgcaactcagagtaagctataatgtaaactatggactttttggtcaataatgcaccaatattggttcatcagttgtaactaacgcactacaataatgcaatagtttaataataggggagactgccagtgtgggggagaggggatatacgggacttctagattttctactcgatttttctgtaaacctaaaactgctctaaaaatagcctcttaataaaacaacaacaacaataagataccgcttaacaaccactgcgatggctataattataattactaacaagttggcaaggatgtggagaaattggaaaccttatatattgtcggtaagaatataaaatggtgtagtctggccattcgtgaaaaggataaaacaacgttacttactatatgacccagcaattccactcctagatgtacacccaggaaaaattaagagatatgtccacacaaaaacccgtacacgaatgttcatagcagcatcattcatgataggcaaaaagtggagacaacccaaatgcccatcaactgacaaatggataaataaaatgtggcatatccatataaaggaagattattcagctataaaaaatgaagtacgataaatgttacagcatggatgaaccttgaaaacaggatgctaagagaaagaagctggtcaaaaaggattacatgttatatgatcccatgaatgtgaaatgtccagcatagaaatatccatagagatggaaaatagattagtgcatgccagaggctggaaggagggaggaatggaaatgactgcaattagatatggggtttcttttaggaatagtgaagatttaaattctgttaacacttataactaagacactgcactagccctttaaatatttccaaattttaattttttaaaaaaagtctaccttgctttttttgaacccaggtatacagccttaattaagaaatatgaaagctgcaaaactcgatggtttttctactaatggattataaattgtcactaataagtatctcaaaaagggtttcaatggatggtactaaagatgagagcattttaaagtttcatatttatctttaggggatgggtccatacctatgcgaaagcagagctctgctgcccccaacaagtctggtggtcttgatataaacgcttattatttatttagggctgtctcactctcctccttattctctatttgccatttaggctactagtagatagaagtaattagaaaataggaacaaggaggcccaccctacttagagactgggcagtgcaggtgagaaggaatcagaggaataaagttcagggataagggggaggccaggttggggctgggccgaagagatgagagagatgagctcagccctctgggtgggcaatgacaagtgtaggtactagaggacaaactgtgggatagattgcagagtaagaccctcagggtggagtctgaacacatagctggaggcagaggaggagggaaggaaaaaagtggtaaaaagagatcttagtacaggccactgtatgacttagcaggtgcatctacctaaatatttgtacaaataccaactagaatcaaataagtttaaaagaccttatctaggccatgtcatccaaagtattttatagttgaggaaatcagaactagagaaacaaagtaaattggccaaagcatactgggcctagtctagtgatatatcttcaactctatattataatcaaagttcaatcttaaatcaacctaaaatattatattatgtaaaatacagcacacagattcattatgtatcattggcacttttactatgttttgcatttaatctgcccataaatattctgaaactcattctttaaatcatttcctgtttgccccaaaaatactcatctctaatcctactgtaacatcatcatctacatttctgttacattaggattagagacaaattctgtttataaataactctaagaacagtttttatattttattttcatgttgaaaatcagtcagatttgcttcagcctcaaataaagtgtttatgtaaaattaaatgagcactggcagcaagctgcacttttttttttactaaatggggaaaatggactaatatagcagaggcttttgcttattaatattgaatgtagtaattcttatattagttactttggtggtaaataaaaataatctcaatatgatggagtttgtacatggtatattaccatcaaatccagggaaaaatggattttgtagatttggggatgtggtacaagtatataagtttagttgtgtatatgttggttaagtcatttaacagtgataactgagtaccaatctggttcaaatgaatgtgcatatactatgcagttgtgcagtctctctacttggagctgaaagaatctcccaattaatttatggatcacctccctccctttgaataagacacgcctttataaggcatgtcttatctgataaaggcctagagttgtttataaggtatgtcatatctgacataggcctggagcactacatgaccagggcatgggtggcttacagagctctagttttttggttttggggttttttgggggggttaggagtggggagtggatagccccctcatggacacagaaaatagattggaactcttggaaattccaacttgttattacagatgcctttcttccatagtccaaaagacagcattatgcaaagtatcacttacagatgcatttacatctaaacttgctgtatgcttcacagcaagttggtgtctttccactttctccttgatgaagacctgcatccaatatgaatttaaagaggctctgtaaagtaattcgacagcagcaaatatgctatttaaaaatgagtcaatccaagatatgtaaatccaagaaaggttttagactgaagcagttgttttataaaatacacatgcccaaagacacttttttagtggaggcaacttgctgaagaagaatttgaaaggatcttttaacatttataagcagaccaatttgaaattacctagaaaataagtaagctccaagaagaacatacctatggctatcctatttttcgaaggcaaaaatggagctacaaaattaaacaaaggatgtatttcatgtttgaatttgtagaaaaagtcttagaaaggtataatgaaaataaataaaattactaaataagataactatgagatcctaagaattttgccaccatctttgggaataactaatgctgataaagtagagactaatactttggtgccaattccaactccttgcactgtacaaagggggaaaagtatcttaatgcataagaaattatgagacaacacaaataaaaaccaatcttttatgcagaaagtttcaattaaagtgaaattcatattttaaattaccaaattataaccggaaaagtttgtaatgttttcaaaatggtcttcgccaaactacctctatctagcctggaggctagagatggaacttaactatccacttaaattatatctatgtatttgtgcaaagttaaaactttaaatctaataaattattcgaatcaattaaaacaaagtcattattatttggaaaactaaatctttgccaggatgaatatcttaattattttgacatatgaaatatgcaatgtaatttttatgtggggttacatttggaattttcctacatttcatatttagtaaatggatttattataagacagtgatttttttaaagaatgaatttaataagtaactgttttgaaattttgatttacagatcattattgccatctgctggttacatagtttaattgcattttttaaaattcccaattgttttactaaaagacaaaggaaaaactgaggcaagttttagatatccataaccggattagagatctctatgtaagacagataatttgcagccaggtgcagtggctcatacctgtaatcccaatactttgggaggcagaggcggcaggaatgcttgaggctaggagttttagaccagcctgggcaacatagtgataccccatctttacaaaaataaacaaattagctgtgtgtggtggcctgcacctgtagtccttgctactcaggaggctgaggcaggaggatcccttgagcccaggagttcaaggtttcagtgagcaccatcacactttagcctgtgtgacagtgagaccctatcttcagaaaaaaaaaaaaagctaaatcatatgcatgaaaaaatgctcatcatccctggccatcagagaaatgcaaatcaaaaccacaatgagataccatctcacaccagttagaatggcgatcattaaaaagtcaggaaacaacaggtgctggagaggatgtggagaaatacgaacacttttacactgttggtgggactgtaaactagttcaaccattgtggaagacggtgtggcgattcctcagggatctagaactagaaataccatttgacccagccatcccattactgggtatatacccaaaggattataaatcatgctgctataaagacacatgcacacgtatctttattgcagcactattcacaatagcaaagacttggaaccaacccaaatgtccaacaatgatagactggattaagaaaatgtggcacatatacaccatggaatactctgcagccataaaaaaggatgagttcatgtcctttgtagggacatggatgaagctggaaaccagcattctcagcaaactatcacaaggacaaaaaatcaaacaccgcatgttctcactcacaggtgggaattgaacaatgagaacacttggacacaggaaggggaacatcacacactggggcctgtcatggggtgggggaaggggggagggatagcatcaggagatatacctaatgtaaatgatgagttaatgggtgcagcacaccaacatggcacatgtatacatatgtaaaaaacctgcacgttgtgcacatgtaccctagaacttaaagtataataaaaacatatatatataaaagctaaatcatgaggcatctctgtttcaaagatggtaagataatgcaagaatatattgcatcttatctaattataatgtgctattttaattgtcaattaatcatagattaaattatcaacctaactgctttaagttattgtcattagttagtatacagctaaaatgtgactcaaataaccattcaaaataatgaggtcaaaataagtgaccactgttacagaagctgtaaaaacatgaaaacatccatgattctattcaactgcacataaaactaagtgtcatgatttccctcttatacacaaatctactcctctccttagtaggagtagatacataatgatttaggcaactatctctcagttaactaatgaatctaaaacatgtattactgtttaataattactaacatatcacttgatgacaaagaaaccaagtgagcaaaatattaattggaagtattggcaaaaatagcaattacttttgcaccaacctaaaaatactcacgagtgcactataggatggccggtctagaacataataaaggaacatttgtttaagcatgtgctgtgtttttgatgctttacaagcattaattcattcaatcataccatcagtaagacaaatataactgtcttcatttttcagatgaggaaattaatcctagagtggctaaattactagctcaaggtcatacattggtaatcttcctatatgagtcccctgtgtaaaagatttagagcagcacatggcacacagttaattttatgtgtttactaaacatatgaatcataaaatatatcctgcttcttttttcctttaacattatatcatgactattttcctatatcattaaatatccatgcaaaatgactttagtggctgtaatgcttcactatatgaatgtttcataacttagtgtttgatactgaggccacttctattttttaacgatataaataatagcacaatgaacattcttataaaaagattaattttttaaatgataaaaatgaccagatttgtactttcaagggctagaccatggtaagagcattttgtatcccaccaggacaccaagtgatgcaaaaggcaattggaaactccagaaaaaacaaactgaccaaaaagaaaaacaatcgctccacttcacttattgttccaaaaaacattaaaacagtcatattttaaaataaggtgctttattttgagtttgcctagccattcaagaatatattcttatcaaccaccgtaaatactttgtattttaaatgcagtattggacagatagaatttattagctgttaaaacttgggcaaataactacatcctgatgcttgattttaaaatttgcatacagttattgcaagaattaagtgagaaaacattttgagcaccaaacacaatgccaggaatgtagaaatgctccttgaaaaaaatctcccaaaacaaaaaatgagcagtagtagcacttactgaatttaactaagtgacaagataaatagtactgtcagttaagtgctttagaccttcagaaaaagcataattaatatgggctggagaaatgggctggggcttggaaggtgacagcattcagatgggcagggagaaaagaatgtaaaagccaagggatggcttttccacatgaataaaggaattcagcggttatgatgtctcaggctgtggacttcacctgaaatgactgagatggaagattttgtgcccgaggaagtgggaaattaaagttgaaaaggtatattgggcaaatattgaaggcattggtgagcaagcctaggacttgatttgtgggccacgaacatttttgtgctgtgttgcatcaggaaaaattaacctggccacaatgagccatgctttagactggtcagttaggatatgggagttcaatttgatccatcatcaaacagatgggaagtaaagcggtgtgggctccagcatgtggcccgtgacagaggacatggaaaatgtcagtggccccagtgcatctgtgacagccgctttggcctcttgtagggctgcgcggtgactgggagctaagcgctcccctcttagttggtcttggctggtgctgaaagcgcttgagcacaccgctcctagggctgatgacttctgaggaaccttattggaaaagcattttgctctaagattcagtaaacgctgtcccgtgccaaggaagtcgcgtcaacctgaggctctgggatcagacccaccggactcacgcgggctctgccacgtgttgcccgcagtctcggcccgttccctccgctttggtaacgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggcggcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgggggggctgtgcgtggggctgctctcaccggaagctgcacgctcggggaagcgcggaggcgggggtgctgcgcgcttgggagcacgtgggggaacacgcagggactgccggcgcgaatggcttcgaacgcatgcgccccacccgacatttcacagtcgccatgacgaccggtaggtccgcaacggctgcggggacaagaccgttgaggctgccaggcgagtcaggcctttctggacctcgcctgactcggctgggctgtgcctgaaattgacccagctctatcagggattatgaaaaaacaaggagtaagcccgaagccgctgcagtcttcccgccccagccagtctaagcggcggtgcgggcctcccccttcccccccgcctccgccccggagccggaggtagaggaggtggaaaagtcggccctaggcggcgggaggtccttccggcggaggatccgaaatgtggaaaatcgaaaaggcttggagctaaaggtggtggccaagacccttcttctcggccccttcctgttggtccgtaattccctggcgcagctccgggaagaggtgcacgaactgcaggcgtggtggttccccagcagaaccactttggacttcggtaaggagagggcaggagagctccaggaggtagccgcatggcgcttttcttgagtcttgaaggagatcagtttaacaagcaagggtttgtgggtgcctagtaggaaataaaagcaaggtccgaatagaaagaagttggccaaaaatcttgtcattgaaccaggggagagagagagatagggagtatattggtctgaagggctgtcagatcgcagagagtgttttaaggtctaggagttttaaaggctgaggggaaggatcaagggaagaggatcagattaagattccaagagaggaaataattagtggagcaagtcttggaatatttggaggggtagaattaaaggcacaaatttgagaagctaactgtggaaaagaggagagagaattccttttctgagatggcagggagtagaaaagcgaggattactatatggagaaatgttaaagtggagataaaagaagttgggagtgctggcgtctaatggtctttgtttcagtgaagtatgaggctgggtcaccttcagaggtgagactgataggatgccggggtccaggggacatgcttctgtcacagcttggaaagggcatgtgataagcccttcaagcatttagaatactggcatcgttgcaacatatcatttttttcagatgtggtatgtgggttaagggagggagtgagagacacagaaagattttgagcatctttggaaagctggatgaatttggtagtatatttgaccttttccttatatatcatctgaagagtttttgccagtgtatataattgttaggagaattagaaataggatacaaatatagttgaacaggatagtctctgtatattttaaaattaatgaagcctaataaacagttaatgagcatctttacaaccatttaaagttttcaaccttttaaaaattatagcaaccgtgcttgcagacagtccaaaaatacaccatgggccatactttgcctatcctggtataaaacaagtaaatcttccaagaagtatttaagataagcccaggacagttagtaatataggaaaagatctgggtaagcatggttgacaatttcaacattgcaattttttaatttttaaaaatttaatttcttcaataattattgaattaatttgcatttattttgttagccaagtgaagtaatttttgaatttttaagaggctattattggtggtttgtaagatgacttgccaagtatatttgggataaccataagaaataccattataaaatctcagaagggaggtaggacttctggaatagccaaggaaatgcactcctccatgacgacaatgaaaatacttggaaaattatcaaaatcattttcttcaaaactttggaaattaaccaaaggtttacaacaatctaaagggcattaattcaagaaaagctgctgaacctctataagaatagcaaagtttgtggtgttttaacttgttctattccccactcttctctctccaggggaattgaaaacaagcaattccccaaccaaacaggggcacaggctgcgtttgcagctcctgtaaaagctccatacccagagcagtgtctcccagctcccaggtgaagtcttatgtatacatggggcgttggcacaggtgactccagactagtctcctaggccatctagtagcttctaggtctcggctcttgtaaagagcttgcaattcatcaagggttgagctgcacattggggcttttagatgtgctgctgaggaagtgatttcctgcatttaatcatcttctgatgaatgctagagaaactgatctagagtggctcctcttggttagaactagctgaagcatactgtatatacttacttcttttaaaaatttcatataaaggaatagaaaataatactgaaaaaaaaaaaacaaaaaaggtcgcaatcttccataattccatcactcttaccaattacctgaagtaaaaaaaccctctcaagtttctccctttgcttatcaagccctgctgcagagaggtaagctctgttcagaatttgctttgtgtcctggattttttcctatgctcatagagacaggattagctggccatcttgctttgtgtgctatctttctagacatgtaaaatactacatttgaaatacttgttttaatggtattttataataaagcagctattaataactttcctttttttctttattccagcagtccttgtggcttatctccattggtaagatttagtttcagtttgaaatatttaaaaacatttgaattaaaaattgccatctctctttgcatacagtaaaacaataacttctggctatatttgtagaacatctttatgtgcaccaatttatacatgtattttgcttttttacaaacctcatatgtgaaacagcatttacaaaatagatgcattaggggaatagtaacttacgaattaaaatatttttgctttactaaataattcaccacacgtttctttaaatatctagcttttctagtgtattttgcatgtgtagttcatttaaaaccttcctttattttatggtaattatatgttgctagtgaaataacttttttttttttttttttttgagacagagtcttgctctgtctcccaggctggagtgtagtggcgtgatcttgactcactgcaacctctgcctcccaggcacaagtgatcctcgcgcctcagccttccaagtagctgggattacaggtgtgcaccaccacacccagccaatttgttgtatttttggtggagacaaggtttcaccatgttggccaggctggtgtcaaactcctggcctcaaatgatccacctgcctcggcctcccaaagtgttgggattacaggcatgagccaccacattcagccagtgaaataactttggtgataaagttttagcaacacctgccaattggaaatcagttaaaaaagaagttaaagattctgcagtggttatatggttaaatggctctgagtctttcagtgtgcaagcctgtgtacattattttacaaaagtgtttataaaaatttgtaaaataatatttccttctggaatattttatttttacctgtgctcagtgatttctacccttgggaggtatgagatctgcccctatgttctattgacacagtgctgctctagacatttagtctgcagggagattttgatgttagaactgaggctgcaatggtagggaatattcctgcagtatttggtaccctggcatatggcctacatgtaaagaagggttagtggaaaacagggttaatatatggaactttgctttattttcaacttcactggaaagtactgactacataagttagctatagcataattgttggccatagctaattttgtttatcacatatgctcttttcttcactgcctatagctgttgagtttcactactaaaaggtcttcaagtacacacctgtattctttggcacttgaaagttgatcctttatgtgatattatacttattgtaagtctgctttgatctaaagtaattttatttaaaattatattctgaacccttttcaacagttatggaggtatttcccaaggctggtacattagaatcacttgaaacttaaaaaacaaacactaacctgcctctgttccgatttagaggcctgggatggaaggaagggtgaaaaaagccacaagaattttagatatacaattaaggtttttgttttgttttgttttgttttgttttgttttgttttgttttgttttgtttttgagacatgatctctgctcactgcaacctccacctcctgggttcaagaaattctcctgcctcagcctccctagcagccaggattcagacatgcactaccatggctggctaatttttgtgtttttagtagagacggggtttcaccatgttggcaaggctggtctcgaactcctcacctcaagtgatctgcccgcctcgggctcccaaagtgctgggattacaggcatgagccaatgtacccggccacaattaagcttaaaaaccactgagttaaggaatttcaggtgtgtgccgtactggattataaatgctgaaaaacatacaagttagtaagcaaattataaaattaatattataacaattgttttcttttttatggctttcttattgtttattttactgttagttttgaaacttgttcttattgtaatatgattcttcatttttttctaggttacatttagtaaaactttgtgaaaattatcgtcatttctctcacctctcatctttggaacgggagatgactttttgcaccaaaatggttaggtttcttcttctaacgaattaatttgtggtttaagaatagcgagactatgaggtagagatgtattaggaattgaaatgaacttttggtgaactgcactgtttcataagctataacccaggtttattatttaaatagtaaagtgtttgagattatttttctgttacttcattatctctcaccctttcctaatgcagacttctttttaagataataaagatgaattataatagctgaggaaggagaagaatgcaagctctgaaatgacatccttaaatgctgatactggttacaacctctttacctctctgaggaaattgtaacagtgtgtcttttagggtgtttttattttaccagcccttaagaaagatctctaatacgttttaatgcttttttttataatttcaagttgaagtgtttttaaaaacaccttgttttgtaatgttttgaatctcttgagatgtatttaccccactagatacatatttgccactggttagttctccatctaagctcaagaggttattcatctctctttagattccagtggtttttcttttaacttccaggtaaaatagaaactgctatggtatacaaccaaattttggggttaaacataatcagaaaagaaaatccagttaaatttatgaagtgagattttcagatcctagatcttgaatatagcaaaggtcttttcatcttgatggccccaaagcttgttggtcatagtctatttctggccattatcttcttaaataatctatttttaagccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaataccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatatttttacaggaaatattttaaataagttggtagaatttttaaaatggtactgtattagctaataaaatattcagtacaaatatatgtttggatttatgcattaaaaaactaataaaattatttccaacttttgtatttgtaaattattttggtacaggagacaaagcatctaagaaagcatgctgcacattttacttattttagcattgtcatataatctgtttcagtgatgtgtggggcaaaaaaggaaaagagacataacacctaacattcataaaattaaagtaacacatttcagatgatgttacagtagcaaagacttgtaactaacccaaatacccatcaatgatagactggataaagaaaatatgtcacatacacaccatggaatactatgcagccataaaaaaggatgagttcatgacctttgcagggacgcgggtgaagctagaagccatcgttctcagcaaactaacacaagaacagaaaaccaaacaccatatgttctcactcataagtgggagttgaacaatgagaactcatggacacagagaggggaacatcacacaccagggcctattggtggggggtgggggtggggggcaaggggagggagagcattaggacaaatacctaatgcatgcaggacttaaaccttaaatgacaggtcgatagatgcagcaaaccaccatggcacatgtatacctatgtaacaaacctgcatgttctgcacatgtatcccagaacttaaagtaaaataaattttaaaaagtcagtagaactcaacaaaaaatggatgagctgtactaataaaatgttccatacacatatgatgttttcatatatatttatgttattttcatgtactatctgtgttaagtaactgtaaagcccttgaagatcctgttttctgtcttttctcatccttcacaatgcatacattttgaaattgaaattgttctcatataaagggagaaatcataggttgctgggcttactagccatgtttacactggcagtgctctttcttagccatttaaaaatgattctgtatagtcttacacagaaggcaatatactatgatggaaatagtgtgagctgtgtaatgagatgtatctaagtttgaatactgcttcttccattagttaggtaccaccatgtattcaaaagatattcattaaacacttactgtatgtcaggcaccatgctatggttggtcatgttacttaactccatgagctttcttcacctgtaaagcagaactcacaatacctacttggcagggtcattatgaggattagtgaaacaaagttttgaagtacctggcacataaaggcactcaacaaacattagtttcttctgcactaccccctacagctcactaataaccattttagtaatatcaagttacagagtgaggttagctcatttcagaattccaaatagtctcacctttatttgacgtcaacaaataggagtactgggctgcagcttgttcttatgcaaattgttctactgaattcttgcctgtataaattttattttttattcttttgaaacatgagaagattttcacttaattcaatgaagctttttccatagtttctaggatcctatgtttgcacactaatctgaaactatggctagaagtgaggtgcacacaagctgcaacaattccttcatctgcttcatccagttgtcagaagcaaatgcacagcttcaacagtatctgtgttgctttgctgctggtagacaccaaaaatctgagtactttaataataaaattatgtttatatttttatacattacatgttcctattatacatgaaggacaaactcatagaaaaattagttttgaaaaaaacaggacattttaaagaaggggacaattatatatatacatacacatagcagcaaaaatggcaatagctcaaaagtggttaagatatacatacagacactgcaatgaacatcttagtgcatactttgtgattttaaagttatttccacaggatagatttcataaagttaaatttccttaaataaattgtggacacccttaaagccttcaatgcagttagcctcaaattacctttgcaaagctatgtgtgcaccttttggattgtatgcaccaccaaaagttagtgtgtataacaatgctcattttacaacactctcattgggattaattagccttattaagaatatattttgctaatttgtgaggcccaaaatagtatttgttattattttcatttgtatttgttctatgtccagaaaaactcacaatattctttagaaagtgtatgtctctgaagctctgtatgggttcatattctttgattcattgagtctcttcataaaggatggggattgagataaggggaaagaaaaacctttgaaaattcttaataagagaaatataaggacattttcaaaaggacaggtatatatataacttcatgcacaaaagtcaaatttaaatgggtcaaggacttaaatgaaagtaaaatatttaaagtcttagaagaaaatagagaaatacagattaaaaccacatggtaacatttacatgtcagataagaattggtgaggacagggtgccacaagaactctcatgaaattatagtaggagtgtaaattggtacagacaccttagaaaataagttgttaattcctaataagttttaaagtatgtagtctctgcaatttatagtttcaccctaaagaaatgttgttacaaatataccaaggaaaccaattacaagaatcttcatggaagcattatttgtacctgagaaaaaaaagctgaaaacaactcaaaggcccaccaacagaatggataaaatgaatatttccatacaacgtaatattgtaaaggaatgaatgtgatctacagtcacaagcatcagtgagaaccaatgtcaaatagactgttaaagataaaaaactaagtcatcaaaggggatgtgtgtgcatgtcaatatatatgccatttacatagggcctaaaagcaaacaagacaatattatagaagatatagtgtggcaaaacagcgaaagcgtaggcataattaattcaaaacataggctggtgatcacttctaggaaagaatgcaatacaggagaagccctgggtgcttcaatgttaatattcaatttcttggtgttaagtatacaagtgttcattttataattctttaaaatgtgtgtttatatatgtatataatgcttatatatttatactcttcaaagtagggcttttattcctcatcagtggttcttaaacctcatgttctctttaggtaactctgggagcttaaataagcatcaagagttgttctgatgacacgtccagctattcaaataaatgttcaaattgtagattttattgtttccatttgtgcaatgtatttttttccttccaacttctattttaggtgcaggagtacatttgcaggtttgttatataggtaaattgcatgtcatggggtttggtgtacagattattttgtcacccaggtaataagcatagtacctgataggtattttctcagttctcgctctcctcccaccctccaccctcaaataggccctggtgcctattattcccttctttttgtccatgtgtgctcagtgtttagctcctacttatagggagcacatacagtatttggttttctgttctgtattagttcacttaggatactggcctccagctccatccatgttgctgcagaggacgtgatctcatttttttatatggctgtatagtattccatggtatatatgtaccacattttctttatccattccaccatgggtgggcatttaggttgattccatgtctttgctattgtgaataatgctgcaatgaacatacgtgtatatgtgtttttatggtagaacaatttatattcctttgggtatatatccagtaatgggattgctgggttgaatgatagctctgtttaaattctttgaaaaatctccaaactgctttccacagtggccaaactggtttacatttccaccagcagtgtataagtgttctcttttctccacaacttcaccagcatcttttttttttttttttttttttttttttactctttcatcataactattctgactagtgtgagatggtatcttactgtggtcttgatttgcatttctctaatgattagtgatggtgaacattttttcatatgcttgttgcctacatgcacgtcttcttttgagaagtgtctgttcacactttttgcccatttttaatgaggttgtttgtttttgcttgttgatttaagttccttataggtgctggatattagacctttgtcagatgcatagcttgcaagtgttttcccccattctgtaggttgtgtgtttactctgttgatagtttcttttactgtgcagaagctctttagttttattagatcccatttgtcaatttttgtttttgctgcaatttctcttggcatcttcatcatgaagtctttgccaaggcatatgtccatggcctttcttgttttcttctagggttttgatagttttaaggtttacattcaaatctttcatccatcttgagttgatttttgtatatggtgtaaggaaagagtggtacagtgtcttaaaaattaccagattgtgtttcataggattttgaaaaaaagatgtcattcatagaaattgcattaaaattcacatctctcaggatgtgtttcttcatctgtacataggtgataatacctacctcatagaattatgaggatcaagccaagtgttccatgtcaatgtgcattattaagagctacacatgtgatccattttaataccaccagacaataggccaactttgaattggatgttaataaaaaagctatgatgtattcataatccaaaagagcaaataagattatttatatttgacttagaataattttttgaggagcttttgcagctactgacttctttagtatgcttgcctgagattaaaatagatattgacttacttattgtgcttttctgaggttaaaattctttcatatcctttgagcacatatagataatggcttttacttttaaaattttcttccaagagatacatataactcatatgtaaatattgagattattcagatgaagctgcaaagccagttcacagaatatactggattgaatcatatccaagaacctatgaattttatttaaaaagcacctcagctattgaaaagagcaagactgtttacacagcttcatacagacctaagaaatacaatggagatcatatacaagagttatttctttaacaaggatggtgtggcagccacaaaatacaccacctttagggtattcctctgagaacctgctgtccagctgcagggagcacaggtaactgacagccttcaactgtagcgccatcagcatctgcatggcattcactctgggtcacattcttcctgggtaacccccagccaatgaccgagcaaggaagatatactagtctgttctcacattgctataaggaaatacccaagactgggtaatttacaaaggtaagaggtttaattgactcacagttcagcatggctggggaggcctgaggaaacttacaatcatggcagaaggtgaaggagaagcaagccaccttcttcccaaggtggcaggaaggagaaatgaacacaggagaaactaccaaacacttacaaaatcatcagctctcgtgagaactcactaccacgagaacagcatgggagaaaacacccccatgattcaattacatccacctggtctctcccttgacatgtggggattatggggattacaattcaagatgagattttgggtggggacagagccaaaccagatgagaagggtactgtagggcctggctgttttggcccaatgctgaactgcttcatcaggcaatctttgctctgaagctgctcactgagcaagccaagccctggtcagccgtcctttgcaactgaaggctctcctgctttcttcctctttcatagatgtcaacgggctgaaggctttacccacccaatcctgctccccctcctctaacagctatgacaccttcctagtttcaccccttcacccattccagttttacataagttttcctcactacacagagatggtgccaccaagaccttattcattttacaaccttactgggatcccctaatgaaatccctctgagactatagcacagtagaccctggcagaagacaggacccggtacctataagatgcctttcctatctcacggatccagaccattgtcagattttagagttcctagtatggagaaaagtcccttgggaacagtagaacctggactgaactcttttaaaataagtaggaggtaggcgcctgtggtcccagctactcgggaagctgaggcagaaggatcgctggagcccaggatgcagagagacacgatggcgccactgcactgcagcgtgggcaacagagtaagactgtctcaagagaaaaaaaaaaaagtgacagtgtgcaaaatgttcattttatgtatacttagtgccatgtgctgactatgaaatatgatagcatttgtcatgaaattacaaaaagtgttaaggtgctagtttgcacgttttcatggaaaatgggagaaagcaagagaactcaaggacatgcactacatttgttttagttttgtttgagttgtgattatctcagtggctcttctctccctcacccacccacctctcctatttgttcaatctctctccctcgtctggtgccttaaaagggtctccatgctttgcatccctcctccactccacgatcagggacccacccggcatcacacgttctgcttcagcaacaatgaactgctggaaatttccagcaactctttttcctgccagtgctcacactgtacccttgcctgttaaggtcttacctgtcttcctcgcacacccctgcctctcacctgctcagaagtcccctcctgccagcagccagtcctgaccatcccctctgtgatctgctaatgccactccacctgtcacatagttcgatcacttaaaaatgatctgttttcctttgaagtctttcattgaactctgaattacttaataaaaaggtttgtatattatttattcctgttttccacccgacacagtacctggaagatagtagatgctcagcaaacattgcacaaaagaataatgtggaaaataaatggttaaaacatagaaaaattttaaagatagggtatttgggtcacttttactgttttctgtccctacaatatggctgaatcatcccccatatggctcaacattttcttaattcttttaaaagtacccaacactatattgagtgctctggggatcaaaataatagtatatatattaaggctgggtttgaatctctgctctaccatttactagctgggcaatttatataacattttaaaatttcatcatctgtaaagtggaaatattaaaggtatcttcttcaaaagtgacatttggaagaaaaaaataaagtaatacatataaagcatatgagattcagtaagcactcggttagtggtgagttgtttttgttgcttttgctaagacccaggaacccattgtttgaagatcagcatagagcactaacttgttggatgggatttgtgttctctactcaatgatttgtttattctttagagactgtctgtcccctctagagtctattattaatattttctaatgccaatttatgggagttttactattgtgctgtttctctaataatagctaatttatatttttaatttttaaaagccattatgctggaaacagagcattcatacaaacaatacacgaatgaatgtaggttatactgcaaaatagctggttactataatgtagttgtattccatggctttaagtttaaaaataacttcgcatttactagagtggacttaccctccaggcataaaattttaaaacccaacaactccaggcctccagagtctttacttcccactaacttctcaccagtgaaggcgaagctaatgaaaaaggatagatgactgcttctcaattggaaatggatccaaatgccatcaagggaattggtgtcggtatacagattttacctactgtcacagcctggttgggtggaggatggggaaggtggtggtatcggtctacttttagagttttaaatgtttctctgaattcctgtagcagacaattttgagaaaattttgcctagagaaagagtctgaaaccaaaaagctaagcagaggcaaaggtttgcagcttggatctttaacattaataagtctgttgctttttcctacctcccactcctgctacctgaagaaggtgagtaggaggggagggatggtgaaagaggagggatatggagggaaaaggacataagtggtggttgggtagatgacagatagtggttgtctgcctgccgcccatctaggtatgcccccacgggtggcctctgcttttgcccacaggggactcattcacgcacaaaggaaggtgacagacaattggccagaacatagagcactgaaatgaaacacaaaggccactcttgggcctctgtgtttcatcacaattatattagtttgctagggcgccatcaccaagtaccacagacaggtgtcggagatcaaggtatctatcagcagggttagtttcttctgggatctttcctcttgatttgcagataagcgttttctccctgtgtcttcacatgatgtttcctctatgcctgttgtatcctaacctccttttcatataaattcacaattgagcacataactcctatttaataccatatgttggaataaaaagccttatagcaatgcataggatagaaattcttttctttaaaacttagagtattttgcagtaatgaaaaatggtcctgacatacagaatgccatctagcttacacctgcatggggcatgcacggcatgaggcatgaagaagaaagagatgagcaatccttacctgaaaagagaccaccctctcctttaatgggaggagaaattaaagaataatttaatgggaggggaaattaaagaaaaatgcccatagtttgctgcaaacactattgctcaatttaatactgtaatggaatctacaatgtgtgtacaatcattgttaactatacctttattatctttataatgttgaggtaaagagctttctgctattatgcattaataactccatccctaatgccatcatggttctagtgtccagggaaggagtctgtattagtctgttttcacactgatataaagaataccaccagagactgggtaatttataaagaaaggaggtttaattgactcacagttctgcatggctggggggggcctcaggaaattcacaattatggtggaagacaaggcacatcttacatagcagcaggtgagacagagagagagagagagagagagagaacaaaccaggaagtgccacactttaaaaccatcagctctcatgagaactcactcactatcgtgagaacagcatgggggaaaccacctccatgatccaatcacttcccaccaggttcctcccttgacacctgaggattacaatttgaaatgagattttggtggggacacagagacaaaccatattatttcacccctggcccctccaaaatttcatgtccctttcaagtttcaaaaccaaccattccttcccaacagtcttaaagtcttaactcattccagtatcaacctgaaagtccaagtccagagtctcatctaagacaaggcaagttccttctacctatgagtctgtaaaataaaaagcaagttagttacttccaagatacaatagggggccaggtgcagtggctcacacctgtaatcccagcactttgggaggctaaggcaggtggatcacctgaggtcaggagttcaagactagcctacccaacatggtgaaaccccatctctactaaagatacaaaaattagctgggtgtggtggctggcgcttatagtcccagctacttaggaggctgaggcaggagaactgcttgaatgtgggagttagaggttgcagtgaaccgagatcgcaccagtgcactccagcctgggtgacagagggagactccatctccaaaagaaaaaaaaaagatacagtagcaatacaggcattgggtaagtattcccatccaaataggagaaattggccaaaacaaagggcccacaggccacatgaaaatctaaaacccagccgggcagtcattaaatcttaaagctccaaaatgatctcctttgactccatgtctcacacccagggcatgctgatgcaaggcgtgggttcccatggccttgggcagctccacccctgtggcttagcagggtacagcccctccagctgctttcatgggatggcaatgaatgtctgtggctttttcaggtgcaaggtgcaagctgttggtggatctacctttctggggtctggaggatggtagcccttttctcacagctccacaaggcagtacctcagtggagactctgtatgggcactccaaccccacatttcccttctgcactgcctaacagaggttctcaataagggctccacccctcttgcagacttctgcctggacatccaggcttttccacacattctctgaaatccagatggaggttctgaaagctcaactcttgtattctgaatactcacaggccaaacatcatgtggaagctgccaaggttttggggcttgcattctctgaagcaatggtctgagctgtaccttggcccctcttagccacagctggagctggagtggctgggatgcaggacaccatgtcccaaggctgcacagagcagcagggcccagggccctgaggacattttccctcttaggcctttgggcctgtgatgggaggggctactttgaagatctctgaaaggccctggagacatttcccccattgtcttggtgattaacatttggctccttgttacttatgcaaatttctgcagctggcttgaatttcttcccagaaaaatttctaccacatagtcaggctgtacattttccaaatctttatgctctgcttcccttttaaatataagttccaatttcaaaccatctctttgtgagcgcatgtaactgaacgctttcagaatcaaccagattacctcttgaatgctttgctgcttagaaatttcttctgccagataccctaaatcatctctcttaagttcaaagttccacagatctccggagcaggtgaaaaatgctgccagtctctttgctaaagcatagtaagagtgacctttactccagctcccaataggttcctcatttacatctgagaccatctcagcctggacttcattgtctatatcactattagcattttggtcaaaacaattcaacaagtctctaggaagttccaaactttcatttatcctcttgtcttcatctgagccttccaaactgttccaacctctgcctgttatccagttccaaagttgcttccacattctcaagttatctttatagcagtaccacactaccttggtaccaattctctgtattagtccgttttcacactgctatgaagaataccaccagagactgagtatttataaagaaaggaggtttaattgactcatagttctgcatggctggggaggcctcaggaaacttacaatcatggtagaaggtgaaggggaagcaaggcacatcttacatgcggcaggcaacagagagagagagagagactgcaagagagagagagagagagagacagaaagcaagagagcgagagcgagcatcaggaagtaccacactttaaaaccatcagctcttgtgacaactatcatgagaatagcatgggggaaccacccccaagatccaatcacctcccaccaggttcttcccttggcacctgaggattacaatgcaagatgagatttcagtggggacacaaagtcaaaccatatcagagtcttcctcttaaaattcatggaaaggtcatatctatctaatctctctctgatgcttcttttggcagtatcactaaagacatttccatcccagagagtagatgtggaggatgtcagattcagagagaaaaaattatttgtcattggttacaaccacaaaaccatttactatagttttaatattgtgaatatctgttctgatcccaacagatcatcagtcaagtagagaaaaatagaacaaactatttctagagtgtctaaaggattcattctatcattttagtagatgatatacatgaccatcaacattcagtcatttcatgaataagacaagacattataatttaccttagagtgaagctgttctcatagaatttacattgtgcaattttgctttttcacatgaataaattaggggctcaggaagcagaaggacaaataaggcagagaacaagcaggaaaaataattgaggtaggaccagtaatccatggaggatccccaacttcaggtgaaagcatagaatatatctgaatgtgagagttgagccaaagatagactcatttatccatggactaatggatagtcaaatactagtaaaaataataataatagccatcatttacaggcttactctttgctagactctttatatattatataatttaatctttaggacatcttagtaaaactgttctgcagatgagaaaattgggtctcagagatgtcaagtgcctttcttaaggccctccaactagacaggggcaaagcttttaattagatttgggcctgtctaatccattgatacaatcaaacaaaaccactgtgccctggatggaagtcattaatttaagggcaagtagaactggacacctagaaactaagagatccaggagttctcattgtatatttgggactaggtggtagaggacatgaagaacaaggaatagctggctgggaatgaaagcactgaccctcctgcaagagaaaagtaagacagaaaccatgtagttgaagaacccagattccaaaggttatctcaagcattgtttcaaaaattgttgacgaagcaaattactcagctcttctcatccaaaaccttctcggcttggcgtagacctggaatccagggcaggactgaacctcagggatggggaccagtgtccaccagtgcacacggtggagaggggaagggaagaaagccaaaaggccattaattaaacccagggactcctggctcccagcaggatcctattctttctcttcccacagtaagaagctagtggggagatacagacaccaggtgaatccctcagctgactagtcagctgtaggataactgggaaagtgagaggatcctgcgtcctcttgaggaagtgcagctttctgctgtccaggctctggagtccctgctagatttgctcacacacaggacttgcactgggcagaagtctgtggcacatgccttcaaagcattccattagctggaatttaaaattctctgacggaaatcagaatcctgtctgaaggcaattttgcaacagtgtgagatgtgcatgaggctcctgaaggccatggagctgttccaggcaattcgatgaatggagtgttcagccggtcagggcaggcacccaatttaaaacatgcaggtgaataactgatgggacctcttgctcaaacatctcgaatgcattttgccaggctctccaagtgtgtaaaagtcttggaaaataacatgaaattgccttgactgcactcataaaatggctggatgtaaatgtcctttaaaaataaaaataaaaaaaactaaagagcatttttaaggcttttgcttcacaataggatgaaaatgatttgaggtgggagcacaatgatgtcagcgaagtgtggctcagccacgcttttggtagttaatgcagtcagagacacggaggaagtcagaaaacctattctaaaatgatgtcttaatgcaaaaagaaaaagcagtgatgtgtaaatagatactgagttgtgtattctattatgcagttgaaggaaattgagatcagaactgccattctaagaaagagttgacacagattctccatttcagtttctttgaggtgcttaataatctgaggttgaatacaaagacacctgactttcccgtgccttgatttacctatctctgaagcagagaagacacagtgtggccactccatgatactcttgtgtgtagtgtttacctttctcaggcatgagaaggctgcaattacaagatggttctcagagatatgtggggtatttttatcatacttgtttaagacgagaaaaatgttatccctcattccaagaatatgaaattcaattttaagcaagttcacaaatttaaaaaaaattattatgttccttctatgtgccagaatttgtgctaggaactcagaaggcagagaacattctctgtccttaaggaacctcaaggaggagacagacatataaaccagcaattacactaagtattgcagatataggtggcagtactagtacatgtttccagagtgtgaacataaaaatgggataccggatcaatatgatttgtgtgaggttgaagctaccaatatgcaaatgagtcccaagtagatgccagaaaatgcttacctaacaaagctgttcccacctctcccagtgaaaacagaagtcagcccacaatgtctctaaaattcccactatccagcattcttaaaagccctcctaaagagggtaggataggagatgcgagttgtacatggaattcaataattattagatgttaaatattactgagaccgccattgccggccaagataaagtcagccctctatagtctgtctctctcacagattacagctaaaaatgaatacagaaagtaactatttaaggactctgaaaagtaaacaccagaagatagtttgaaagtcaaaatttgaagaaaaaccagtattaggatgagaatcctgagttatttttgcttttgtatctcactgctttgaaatgaaaatggccctaattatggaactgagcagtaggagcagacatcaaaactcagagaaatctcctttgttgaaccaaacagatacagagacctctgtaagctgaaaagtgtagaatatattccaaggctttttttttttctgtttttcccctcttttttcctcctatctctaagcgaggagtggccacagtctagagcttctctgcagcagttgtggcatgtgcacctaaaacactgagaaagcaaacaaacaaaccactgtctctctggtcagaggatcttcaaaagagttccctatcatcccaagtggatgggggaaaatttttgttttcgttctctttgtctctccagttgtgtggaactgcatatcagggtggtcattatggaaaatcaatattctctagaggattttaacaggactcagagtctcacaacataatatcagattgtctaaaatacaatctgaaactacttaacatacaaagaaccaggaaaatgtgaccaatagtcaagggaaaaaccactaacaggtgccaacccactccaaaacagcaaaactcattcttttcaagtacctataaaggacacattctgaaccattaaataaaccttaacaattttaaaataattgaaatcataccaaatatgttgacaataatatgtatgaccatacatggttaaagaaaaaaataaaaaatcaaggatatctagaaaatacctaaacatttggaagttaaacaacgcagtgtaactgtgttaaacaacacagttctaaataacccattggtcaagtaagtttcaagggaaataataaaatattttaaaataattaataataaaaatacaatttataaaaaattgtggaagtgcttagagagaagaaaattatagtactaaatgctcatattagaaaagaaagtctcaaatcaataacttaagcttccacagtgagacattagaaaaaaagaacaaacagctgagcagggtggttcacccctgtaatcccagaactttgggaggccgaggcgggtggatcacctgaggtcaggagtttgagaccagccaggccaacatggtgaaaccccttctctactaaaaatacaaaaaattagctgggtgtgatggcaggcacctgtaatcccagctactcgggaggctgaggcagaagaatctattgaacccgggaggcggagattgcagtgagccaagattgtgctattgcactccagcttagaggctaagaatgaaactccataaaacaaacaaacaacaaaaaaaaaacaaacaaagataaaaagaacaaactaaacccaaagcaagcagagaaaatgaattaacaaaaataaaaacaaaagtcaatgaaaatgaaagcagaaaaacagtagacaaagccaatgaaatatcaataaaatgcataaatctctagctatactaagcaagaaggagagagagagagaagacaaaagctatcaatatcaggaatggaagagtggatatcactacagaaaaacaaatgactgtattaccacaaatttgtgtttaaatcagggttaaatcaggaattaaatggactaattccttgaaacatacaaactaccaaagcttggtgaagaaattagataacttgatttgtctcatatctattacagaaattgaatttgtagttaaaatacttcaaaaaagaaaactccacgtccagatggttttactgagttattctcccaaacatttaaggaagaagtaacaaatctatataatcttttctcagaaatagaaaagaaggaaatacttcacaacccattttattaggctagaattagaccagcattaaaaccagaccaatatcccttatgaacataggtgaaataattctgaacaaaattttagtgaatctattccagcaatatttacaaaggataatgtaacatgactaagcaggatttgtcttgggaatgtaaggctggttcaacatttgaaagtcaatcagtataattaactatattaataggttaagaaggaaaaccatgattgcttcaatagatacagaaaacgcatttgaaattttcaatatctattcatgatacaaattctcagcaaactaataatggaaggaaatttttttaaaactgataaagcgcatgtagaaaaaactgtatagttgatttcacacttaatgggaaaagactgctttcccctaaaataggaaacaagagaaagacttttgctcttaccacttttttacaacattgttctggaaggcctagccagtgcaataaggccagaaaaagaaataaaaggcattatgtagaaaattccaaggaatctctaagaaagctctagagctcataatcataattgactaaaaagatcaatatataaaaattaattttggccaggcatggtggttcacacctataatcccatcactttgagaggctgaggcaggcagatcacttgaggtcaggagttcgagaccagtcaggctaacattgtgaaaccccatctctactaaaaatagaaaaacttagccaggtgtgctggcacacacctgtaatcccagatactcgggaggctgaggcacgagaatcacttgaacccaggaggcaaaggttgcagtgagccaagatcatgccactgcactccagcctgggcaacagaacaagactcttatctcaaaaaaaaaaaaaaacaaaaaaaacaaaacaaatgtatttctatatactaccaataaataatttatattgaaattttacattatgccatttataatagtgccataaaataaaatattaagagtaaatgtaatatcagcaggatctatatgttataaaccctgatttaaaaaaaaatcccaaagaaaggccaaataaatgggaagatatactgtgtttatgggatattcataagatgtcaattctccccaaatttatctataggttcaatgcaattataatcaaaatctccacaaaattatttatatatattggcaagctgattctaaagtatatagggtaaagcaaaagaacgagaatagcaaaagaaatttgaaaaagagcaaagttggaaaactcataccactttatttcaagttagtgtaatcaagcgtgatattggcaaaaggttgaacacctaagtcaatcaaataaaataaagcccagaaatagacctatataaatatggtcaactgaatttctaaaaacatacaaaaggtaagtcagtggagaaaggatagtctttttaacaaaattaactcaaaatgaatcatagagctaagtataaaatgtaaaactgtaaacttttaaaggaaaatataggagaaaattattacatccctaaattaggcaaaaattctcatattaacaccaaaacaatactttcaaggaaaaaaattggtaaattagaattcattaaaaattaagaatttgctttgcaaatgacattgtcaaaataatgcaaagaaaagccacagactaggaaaaaaccatctgtgaattacatatatgacaaaagacttgtatccagaatataaaaagatctcaaaaatgcaacaataaaaacacaaggaaatttttaaaagaatcaaaattttgaacagacacttcaactaaaatacatatgtatggcaagtaggcacatgaaaagacagtcaacatcaatagacatcagggaaatacaaactgaaaccactacctgccaattaggaaggctaaagtttaaacacaatatgacagtacaatgtattagtgaggattcaggccactggaatatttgaacaacagtttggtagtttcttacaagaaacttaaatacacacttacgatctgatccagcaatctcattttaaggtatttatccaaaaaaatgaaaacttatgttcatataaaaccattatgcaaatgtaatacagcagctttatccataatcgcccaaagttggaaacaaatgtcctttagtgaatggatacacaatgaataagcaaattcagccataaaaaggaacaaactattgatacatgcaacatggaagattctcaaattcattatgctaaatttaagaagctaggctcaaaaagctacatatggtaacccatttacacgctaccctggaaaaggcaaaactacaggaaagaagaacaaatcagtggttgccaagagtttggagtgagagaagttgccccaaatggggggcagttagaaggaacactttgggtcatgaaacttgattgggggccaggcgtggtggctcacgcctgtaattccagcactttgggaggctgaggcaggcagatcacgaggtcaggagatcgagaccatcctggctaacacggtgaaaccccgtctctactaaaaatacaaaaaattagccgggcgtggtggcaggcacctgtagttccagctactcgggaggctgaggcaggagaatggcgtgaacccgggaggcggagcttgcagtgagccgagattatgccacagcactccagcctgggcgacaaatcgagactctgtctccaaaaaaaaaaaaaaaaaaaaaaaaaacttgattgggatccaaaatcatacaactatacactaaaatcagtgaatattaccttatgaaaattaaaaattaggaaatcaaaagaaaagcatacatataaaaaatagttttttctaagcatttctcatttgtaaggtgttttaattatgttgtatgttgtctcatttcacccccataacaaatctatgaaagaggtacttttatccccatgttaacgtgaataaacccaggtttggaaaagtcgagaaacatacttactgtcatatagttaacaagtgactgagcagggatgtgaagccagattcctctgactccaaggtctgagttcttcctcctgcacagtggtcaattggctagatccacataaacagcatgcacaaactcaccactcacacatacatacccacagacacacaccacacagatgggatacatctcacaatcacatatatggaatgagtgatatgcaaatataaaattgcattatttttatattattctcattttatataaatcctaccacgaggcatagtctgtctcattcattcattcatttatcatcccttcatttattccctcatttcctcaggaaatagcttcctttgtggcaggtgctattccagactctggagatactacagtaaacaaaacagaataaactcaaaaactctaaaatgcaacaataaaaaacaaggaaatttcaaaaaggatcaaagttttgaacagacctttcaactgaaatatatatgtagttaatacacacacaaaaacaagtaaataacaagtgggatatttggtagtgacaagtgctatgaagaaacactaaagcaaagtaagaagagtgagtaagaggaggaactgttttagagacaatgaccagggaggcctctctgcgaaggggaattgaaacagagaatggatggaagagaggcagggagtattgggaaggtctgggagaaggttttgccaggacacaggaataaccaggagaagcccctgaggtaggagtcgcttggcacgtttgaggtacagccagtgggctgctcggcttgggtgagcttgcagggctgagagtgggaggaagccagggaagctgtagaactttcctacttacggtgcgtacttgtagctgttcttcaattctccagtataagtgtatctccctggttaattgcaaattatttacaggaccatgctttctattttttaaatgaatctcagtctgtacctggcacttcactgggcatggagctaatgccaaataaaaacgtgatggttgatgagtgctgttcatacacatttcccagtggttctacccccggaaggcagctatgtgatcaataaataggacgccaggagagtgggaatttccagcagtacttcatactgtcacctttgagacctatagagagttctgctgagggcaagtttttgtggtataggaggtcatcctgatgagggttttttttttttttttttaatggtggcttttagcgtaaattggcagggattgatcaggtgtttcctctaggctaatgctccttggggatcatgggatgtggtctgcacactcatctgagaagttccagtaatggcaaggcagtcaccaggggacccatgtcctcagaggacctggctcctcagagaaactgcaggttcactgggggagattatcaggactttagacctcaggatgaagagacacactccaggaggggctgtggatagttactatggtgccccagaaaggtgtcagggtagtgcatggggaaagccccccagggtcctggccagcttagaggcaatggggaggagcatgctgggcagactgtgcgggatccagtcatgatcagcctagctcctgaggggctttgcgtggcacaggtgtgaggataagagcaaagattccagtaaggaacaaagagacagtgagtctctaggaagcctggacttttgatttagccagacttgggtttgcagcctagctcctgcccagggtagagtaagctcctttcaccaccaccgccattataggggaatcctagcaaatctatgagagccagaagctagacacaatgcctgctgcttagtgctcaccatatacttgtccttggatagccaatgtcaagttaaatttgccagaattgtcactctgggccagaaagagctgtgtcctggcaatggtggcagggagtcaccagcaggatcgggtaggacccatggtcaccacagtggctagtgctgtgaggaggatggagatgcaggagagtttgctcccataggcaagcaccatggtggggccactgagactgagaccagcacactgagggctgggcctggcagtggcccctttgcacaggcagaagagcctcctggaagaggactcagtctgggcccactatgggggctgactgcttgtaaggaacggaatagaccaccaggggagaacacctcccacatgaggtagtgccagagcaagacgctggacctgacaacaaagccttcagtggtgaagacagcagagactccaagctccctgtgaaggaagcgactcatcccatccctagcccagctcctttcctaaggaggaaaaaggtgagaattccaaaaagaaaaactctgtcagtaaattctaacatgcgaggtctcaaggagccctactcggcccccgtccaacagccagtaacacaaaaagctggccgctcagagaccacagtacagtctgttcttaggacagaagagcagatgggtggcacacaggccataaccaccaacatggagttgctacgccaggtggagccagggcctcactcctgcaccccgtggagctgtgacagctggtggcgggcattctggtgacaagtgagccatgagcaggcttgcgtggcacagagagcgggctcgttcttacatacccatgagacaccctctggagagtcccagaaatactggcctggagcttacaggtggaggaggtgtgaaggtctgcaggtgcaaatgaggccaagcagtcagtgagatttaaattggtcctgttaacctgacctcatttgtatcctcagtatggaggcactttgggaagataaggcaagaatagtgatgatcagtaatagcatctacttgttgagcacctattgcaagcaggcactaggcttaaaactctaaacatatttttttttactctttatcccaaccctgaaataaggacatttgagacgggaggaaactgaggctgagcattcatgtaaaggttgcggcagcatctgggagaggtgtgggaaagcacaggaacaggacccaaatgttcacagcagaagcagtccctagcaggggcccttctctggcatgctcactgctccctctggactcaggaggagtctccaggctccaggaaggacatggggcaaagctctgctttttgacctgggcatctccttttgagggagtggtgagttagccaaatggggcatggaaatgactgtgaaaatggaatggcagctgaaagaaggccatgatccaggaaagggcatgaggagggcaaactgcaaaagcctgaggcactgcagggatgggaatgttgaagggtataacagcacatcagggtttccatgactttgatgcaaggggaaagcgattttcacctcagactcaaactggaagtttttctccctaccaaaaggcaggatgccagagaaacagaccttttccctcctgggtaggagtttggtgtttctccagtgctccactctgacctagcagggagctagcagagaccatcccacagtcacctcatccagcagaggattttccacatgtgccacgggctctgttcctcagcgacttcaataacagaagttcagcatttggggggtgccaggctaaaggaagtcaatcaagcttcttgttttgtgtttcattttgcttttaccctagcattttccagagcctttaacatgctaaaacgaattgtcactcaccaggagtggagatgcagccggtcctgaatttatctgaaaaatgaaaatctttatttggaaaatgcttattaacatcttagcgaattggtgttctggggaagatgatttaggaaaatctgctctatgcatgtcactgcctgcttcatgattgcttactgcttaatttgatgcaactttttttttaaccaaaagtcaaataataacccaggtttaccatttgcaaagcttctccctactcccaacacacacaccttcctccttcttcctcttctccctttccctctccctctccttttcctgccctttactgtacaagaatgccttgaataaagaaaacctataaaacagaaatataaatttggaagtgattatttaattggcctttgatttcatgacaggcaaaaataagttggccctcaatttttttttttttttttgtaaaaaatgatactttaaatactaaaggatttaaaggatacttggtaaatatttgttggtttaattcatgaaacatgtggatgttatgtgaaaatacattatctgtatcccagaaataaaaaaaaatatcctttttctggcctagagcataatacttcagccctgggggccccactcacctggtattctatgtatatggtgccccctgcagcagccctgggctcattacaagtaacactgattcttaggtgttctatgcctttttaccaatctctttagaggaagcagatgaacatttagaattttaacagggaatgtttacctgaggacagaagctagatgaaaagatcagctggaacccagaacacatatttttcctgacaatccagccaaatgtgaatccagggactcggtgtaattcatcagaacaaagcaacactgcaggcaggttgtgtggtacccatttgcctttgtaataccgccatgctcaattccaaacacagtctgtcaactcatcggagccccactggtgagaaagccaaggctggcagcaggtttggtgccacctcttggtgccagagccacctgcacacagcatggagcaagggaatagccagggtgccctggatccagttccttccagaagccagcagccctagggctcctccatcccactcccagcaagaagaagctgccatgaatatgaaggtgggaagaggaagctcagaccaggggaaggcttgggctgtgtgttaattcttctctggtccccaggacccaacacagttgtctggttaatactgcattaaatgcagttaattgattctagccccatttccactaagaaattcctgagtgctctcagaaagttacttctcttggagcctgcagcacaacaaaccactcagaacttggtgctataaaacaacagcaagcatttgtcattactatctttcacttctttaggggttgatggggctcagctaggcagtttttggtcctcatgcagtgacaatcagacaatggctggggctagagttctcttgaaggcctttccattcatattctctggtgcctgacttgggaagacctaaatagctggcggctggaacagtcggggctcctcaggcacctctgtctattacaatgtgctccctccatgtggactctctgtcagggtagctggacttcttacatgaagtcacctgtacccggagacaggctggtggaagtcaataacccattgtgatccagcttcacaagtcaagcagtgtcacttccaccatattatatgcacggagacagtcaaaagtgctgcccatgttccagggcaggagataggtctctcttcttgatgggaagaatgttaaagaatttacagacttgctttgaaacagagccttaatttctccatatcctctaaatgaggataataataccttcttttttccctaaggtataaccccttcataaccttctattataagtgtttgatatcctgatatttctttctccatgccagaacatactttcagaaaaagctgaaatattctttatagtaggatgtaaataactgataaggcttaatatggtaccattgccaggaactttagtcttttcatagatcgcaacatatttaaagccaatggaatatatcacggcattttgaacatcactgaacagtactcaggcagagatctgtgagcttggaaatgaagcacctactcttacaacctacctgaaaagatgtttactgttgcctgtcttggtgaaagagcaataagggactttgagtttgggagaaagaattcagaagaatagttaaaacctccagtcccaagaacagacctcctctctacccccaaccacttttaaacgcagacacgagggacaaactgaccacatactttgaagattacagtagatcttgaactagtaaagagaatgtatcatatgaggttaacagaatcagaaattttggccagtgaagccttatcatgtctgtcttaaaacatcattttgacaaatatttcttcttgaacttaggtaatttttgcagtcgtttaaaataaaagtctgaccattcttctttcgtaagaggcagacttggaaatagtgttgatcattacttaaattgctgtcccttcaggagttagatttccaaaggaaaaaacttaatataattcttgtcattcacttaaaatttactgtctatttctcattgtgattatctttaatagtatgatattttttattttatctctcacaccatagtatttcatttacttttaaaatggtcgtctcatcaggttctaagatcaggttgcttatttgacaggcaaaaatactcgtggattctaaattatattttctccacagcatgttattatgaagtcaccagtttagtatttgacctcaaataacactgaggtccattatgttaatatgcgctctcactatagtttaagtttattacagaatattctgaaagatccaaatttattggtaactcatgggcgaactcccattttaaatcctctagttgtttagagtcacagcaaaactagcaacttgcctttcaacatttgcaatagcataatgtggctttccacaagccacacttgtttttaaaagtatgtgctaaagaggctgactcagcattctgagatgctctggcattgtattacccgcccccaccacaaaaattttttttctttatctcacacctcaaattacaggttatttgtatgcaaaaattgcagatagttcatctatgatactaactcctggcaactcaataaaagctttttagtaatatgtttttcttaatcgaatattgtgtttcttttataatatctacaaactaattgataaataatctcacacttttaatcattttactttggaacatactctatttattctccacactaaaatattgggcaaaaaaaccttttataagaagtgcagaaataaaattgctaaagtctaattataaaacaaaaatatttggggtttgattttaaatgttttaattagaaaaggaaaagcagttttaagtgcagcttgctatatagccatattcatatgaatatatattattatgttaacacaataataactctttgcccttttcatatggaaaatagattgtgaaaaacagaatgacctttgttctaccaaatgttaaacaataaaagcatatcgttttgtctgaccatttaagacccatgatcacttttaaaactcaacaatgcttagttaaaaagtcttaattctttgtagtctgtgctacacatacaaagattacacagatttcttttctaaaacttttaaattattttctagtttcactagaaacaacaggtgtaagattctatttccaccacaaggtgtcagtccacggtaatttaagcttcaaagggctttaaactaatccaaggaaagtcagtgactacagaaaatacttatattaaaacatgctttgttaaacggatgcttgaaggcggcatgctagttaagagtcatcaccactccctaatctcaagtactcagggacacaaacactgcggaaggccgcagggtcctctgcctaggaaaaccagagaactttgttcacttgtttatctgctgaccttccctccactattgtcctatgaccctgccaaatccccctctgcgagaaacacccaagaatgatcaataaaaaaaaataataataattaaaaaaaaaaaagtaaaaaaaaaaaaaaaaaaaaaaaaaaaacatgaacagtcttcggtgccctagcagtgaataaaaaacaatcatggaaaatgtggttgcgcgtttattttcctttgtgttttctactcagcttagtcctgagaatgttgtataccaaatccccagaattttgcaattcatgtctcagaccctatcttgaggctggttccaacggagagaagtaaatcccctgctcaagttgtctttttctaaaaccttggaatattaacagttaactttactttaggtttggaatacttcattgagctaggatatgggaagctgcacttaaaagctaaggcaaggaagggagggacggagtaaacatggggtttaagggtttttttttcggctggggagcagggtttgtgcgattaaaggtacacaatttgaacaattcagggagcaagtcactctcagaaattcagcttcggattcctcaaactgtcaatcacagccacttcaggaccggctgttaggttttaaataaggtggctgggcgcggtggctcacgcctgtaatctcagcactttgggaggccgaggcgggtggatcacgaggtcaggaattcaggaccagcctggccaagatggtgaaatccccgtctctgctgaaaatacaaaaattagccgggcacagtggcaggcgcctgtaatcccagctactcgggaggctgaggcaggagaatcgcttgaacccggggctggaggttgcagtgagccaagatcgcgccaccgcactccagcctgggcaacagactgagactccgtctcaaaaaaaataaaaataaaataaaaataaataagctaacgtgtgggagggtttgtaagctctaaacggtctatctcaaagtgtgatctgggaatgcttccatatctcatgggaacttgttacaaatgagaatctcagaccccatcccagacatactgaaccggaaactgtgggcggacagcccaacaatcggtgttttaataagcccccgggtaatcttatacacgctaaagtctgagaaccactgctctagagaaatgcacaaacgttccttagtggagattaaacaaaaggcgaggggttggagggcgcgaaacggacctcaggtgcagggcagacggcatttgagaggaaactgggagaggccggagtgcgacttggggagtcttagcctccaaggacgttccggaaccctgcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtgagtcccttgaatcgttctcactggccgtttgctcctcgagtccgcccgcgtgtccctgcaaggctgggcgcccgctcccagtcttgggaggggtgtagcgggtcgcaagccttctcgtgacctggacagcggccctcctgggcgagcgctgctcaattctccgcttatgcgcggctctggggcgcgctgccttccagcccagctgggttgtggccgggccgggggttggggagagccagggactcacaggaagccttttcgctaggggcttaaggttgtggtagattattaagtttgtgctcaggttggattttgatggcaagttttttaacgtggcaaagttgccagagtttgctgtgcattgacgaatgactggtgcacagtacttaaaatcgtgctacttctcgtcttcgggtttcctggtaacagaggttttcatttttagtccttagaacactggccctactctttcaggatctgggtggggttcaggttccctccaaaatagtcaatcaaggctttaaatatgtaattctggtcaaatccactggaaggtgtttgtagacataaattttttgtacacttccaaatttcttactttgttacttttgtaaaatacatttccctccacatcctgacgtgtaataaaaggttattcatttaacatgaatgttaagcacagagggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggatcttgatgtttctctttgtatatatgtgatgagtttgaaatatttgtatttccttgcagattttattcaaagcaaaaaaactttttaaaatgaatctctagcactttctttatgataaaagtaagcatgaccaaaaaatcacatctgatttgtcagattatgtagcattataaataatcaagggctttgaaataccagttgttgctacccattatacaggtatcattagctatgaaaagataattttatctgaatctacaacaaaagtgtaataagcatttacttacgattgttaaagaactttcatttgtctgtatccaggttttactcatggaacacctatctccaaaaacactcagactatgtctatacaagtaaagcagcacagtaatatcagatacacagccaggcaaaatgaaactcaggctatccaggagaaaaaaagtaaattcaataatttccacctgagtcatgtacaattcagtttaacttactttaatgcattggtaaaagtataacataaaacatttcctgaaagaacaaattatacattagctgtcaggacttgctaactcaactgtttgcttcagaagtttttcataattagcaaaagtaatcacaaactttatctttcatagtggtgagccatttattactaaagacaatagagctaatcgtgcaaattaggaaaatcaattaggctattcagtaagtggagtccagtttttctattttttgttctattgcaaaggatgattattcattattacatgggggataaggaacctccttgggcacaaatttgaactctgcattattggagttcagacatacagagatatattcgcaggcagtgaagaaaggagttgagagcagcaattctgaactggagccagggcagacaagagtgcccttgagaaaaaactcagcataaaagaaaaagaaatctaggactctagaattgcaaaccagattcatcaagggaacaacatactatgggaccacttaactaatgacacatgtcattccgtaatcaaccagctctgagatgcagcagtcaagtaccatagtctcacctgcatggcaaagtgccagctcctccagtactgagaaggagaaatcaagtttcaaccttcctagtaccaagacattatagaggctgcagcttggaattgtttgcaggtgaagtggcacctcagtgaaactttcagggacaatagccgagttctggcttgattatgggagccctgtcttgttagccatggtaacaagcaacaataggcctattctgaaacacagaatatacctttttgaggattcctagttataagagaaagggaatcaacaagggccttaaaagcaaggcacaaaacatctagattccatttttactcatagattggtaagaactaaagcattcacactttgtagcttttctgaagtttttacaatggttgggtaatattgttatgagccaaataaaacaataaaagatgtctttaaaagaacaattataatgttctggtataagcttgaattttactcacctcgccaacatctatagagcatattccatatgccaggtcagtgctaaacagaggatatatcaagatagaaatgatctagtctctactcgcagtcatggggaagacaaattttagtgcaccaatggattctaaatgtactggtatcacttaggaagaaatgaccggttccctttacaagagcaaagccaggaaagtataaggttgagccagaaaaaaataaactgttgtttgagctgggtattgtgtatgtaaaagttcctcagaatgggagggcagggtgtaatgtgatgtgttggaagacctagcttagagtggctgcaacagaatatgtgaaagaaataccagattacatatagacaaaggatagataggtcaaggtcattgtatgacatgaaactaagtttgggttttgccctttagggagtagggaagccattaaaaactttaaataggagctaaacattattcgggagctcctacacattattattttaggcgctaaacatgatcagatttgcattctagaaagaactatctgtagactatccaggagattaatttgatggtgaggggcaaagggtgaagacaagttagaaaacaacaaaaatatttaaggagacaactgcaatatcccagggcagagacaataaattcccaaatgaaggtcattacagagaagaagataaaagaagagagctaatgaaatatgataggaagatagaagttctcatcattcatgaacaatagaagatgaggaacaagggggaggaaggcatttagggcagagcttctaggattcttttagcttggataacttaagaatgataccattaaacaggatagaaaaattccacagaaggagcagatattttaaccaaaacaaaaacagtgtgtgctctgtacattgtattgctgtttacaatcatctcagttgttaaggaatgcagtgtgtttttttagtttcagggtacacaaatataattatgaaagacatatagtttgggaagcggaaaggaaaaggtatttttcctgctcctttgaaagggtaatttttaaataaaacttttgatatggtcaacacacttatatctggataattatagatatgaacgtagatatgagggtcactatgctataacacgcacagggtcctcctggagtagaaggaacagcgcctagaaaacagctggctgtgagcccagtgccttccttctccaagcagagctctccttcctgaacaaaatgagtccacctggggtttattttctttaaagatttgctcaatagagattttattatctttggtttaaaataaaagttaaaatgatatatttactattttaatgagttacatttaatgttttatggcaacaaaaaagaaatatctgattctgatgtgatttttcagatcatagactacatgtctaaagaagcctataagaaattatggcctatgaagtgtggaatctgagactgctggcaagatggccgactaggaacagctctggtgcacagctcccagcaagatccacgcaggaggtaggtgatttctgcatttccaactgaggtacccggttcatcccattgggaccggttagacagtgggtgaagcccaaggagggcgagccaaagcagggtgggacatcacctcaccagggaagcactaaggtcagggaactccgtctcctagccaagggaagccattagggattgtactgtgcacaccagcccagatactacgcttttcccacgttcttcacaaccctcagaccaggagattccctccggtgcctatgccaccagggccctgagtttccagcacaaaactgggcagccgtttgggcagacaccaagcgagccacaggagatttgtttcataccccagtggcacctggaacacccatgacacagaaccgttcacccctgtggaaaggaggctgaagccagggagcccaagtggtctggcttggtgggtcccaccccacagatcccagcaagctaagatccactggcttgaaattctcgctgccagcagagcagtctgaactcgagggaggctcaagcttggtggcgggagtactttcagtactggcttatcttcatgtatttctataagaactctgttttctctcctattaaaactgctattacacatcttccttccactaaaatcaacaatagtgtctccacttatacccagttggtagattttccttaggaaatagatgcaattggaagagaatgagttcatcttctcaccaacaaaatctcttgattgatgtacatgcgtctggtacccatatcttctgcatattacaacagaaaaattatccctctcccagtctatgtctaactcaaagagttttggtcttaaattgcactcatttctcttgtgtcatcaatttacccctttctgctggattattcccattaatactcaagcattagattaaataaataaataaataaaaatttggaccaacgtccccctgtagtttctacccatttctctgctaacctttaaaacaaaattactatagatacttgccactttgatattaatttacctattcagctttcttttggttagtatttgcatgacatatgttttctcatcctattatttacaacctttctattttcctatgtttttagatgtcttttgagaaccgtatatagtttagttttttaaaaaaaaattcagtcaggcaatctttgcttttaattgcaacctataggcctacatatttaatgtcataattgatatatttggacttcattataccaccttactatttgcttcccatttcctcattagttctatgttttttttctttctctcttatatgacctcatttcagattgattgagattatttattatttcagttttcccttctcaagcaagcatactttatcttactatttttagaagttactctagagattataatatcatcattgacatagcagtctaatattaattggcacttttacctcttcttgttcaatgtcaggaacgtctaccctttaacttcagttaacccccttttgacatatatgctattgttgtcatgtgttttaattctatatatatttaaactcaatagaaattataattatggttttatatttattgagatttatacacagttaccctttcggttaaaaaaaaaatctttagtgttccttttagtgtgtaatgcatgcctgctggaaaaaaaaatttttttcacaagtttttgttcttaaaatatctttattttatcttcattattaaagaatacattttagatgcttagaaatctaggagggcagttattttctttcagaactttgtagaaagtttcattgtttctgatgaaagacaaaaaatctcattctaaccattgcttcaagagatccctatggctactttataattttttttttttttgcgttagttttcagtacttttgctatagtgaggttaactttggttttcctattagttatcttagttagggcttgtaggcattcttgaacctggagtttaatacgattatcagatttggaaaattctcagccattatcttttcaaatattgctgatgtcccatttttctctctcctttttcaggatttcaattacccatgctagatgttctcattatatctcctattttataactctgtctttttattttcttttttttctatacttcctcctgggtaatcctacctatttcttaattctctcttcaattgtgtctaattggttattaaatctatccactgaatttttagttttagttctgaggtaaactcagttttataattttaatttgttttcatagcttccaattttctgtcaaatttcctactcttgtccttaatctccttcagcagaataagaatcttaaaggtaaatctattatcatctgaagttcatatgagtctgtttctattgtcaggtttttttctccttatttttcattaattcattttatgtcctaacatgaactggttatttttactgagtgctggaccttatagttttttaaaatcatacaaataatttgaagctatgatgacattatgttactccagagagaatttgtgttttcttcagacagccagttaggggctctaacaatgtgggaatctcttaatccaattttaagaattgagtttacttaaaattgggtttaagcccctgccaaacttgaactacttctggttcacatttattcctaagagtaagttccctgagattccgacccagagcttgatggagagtggctccaagggctctcctccttggcatactctggattacagattttgttccattagtctcttgaggctactaaaagtactgttcaagacttgtaacctctctgttacctcttctagaatcccctaatggaaaagtaaacctcagtgctgggtttacctctcttgggttctttcttcctccaagacttattacccatcaccattttgttagctactcaacaccttcaggcacagagtttttataattggtcttgcttttctagttgatcccaggtttggtacatataacccaggaatgaccagcagcagaaatcactagagagagttgattacatttgttatctctatgtccccctcttccattttctctcttctattctgtacaattttatctctcactgttgcactacacctctcttgtcaagatgaccaagtgataaaatctcagtcctcactttacttgctcacccagtaatatttgacaagtttattcctctctttcttgaaacattttattttcttggcttctgggaaaacctactccctgagtgacttttctgtgtcatttgctggctcctcttccctttcctatcatctcaatgttagcaagattgactctttgatgtccttttcttctctttttataaccacaatagaagtaatcatctcctttaatctcatggccttaaatattaggttggtgtaaaagtaattgcttttttccccattactttcaatggcaaaaatctcaattacttttgcaccaacctaacaaaaaacatcaaaagtatgttgatgagtcccaaatttatatccctaggctttcacctgagctgcagcctattacatctgcctttttgacaacttctcttgaatatctaagaagcatctcaaacataagattctaaaggcaaaatcttaatttctttcccattctcgcccagttgctcaagacagacactcaggagttatctttggtacttccttttacttcatacccatatcccatttaccagcaaattctacgggcttgaccaccaaaatatgttttgcatccaactgcaacctcactaaactcatcgaggtccaagtcacagcaatctctctcctaggattcttgcaacaaacttccaaaatggtcttcctgttcccactcttgccctcatcccctgctaccactagcagaatattttccacccagcaaccagtgtaattcttcaaaaatgtaaatgctatccggtcactcctatgcacaaaactctccaatgttttcacataaattttaaaataaaacccaggctctttaccatggtctacaaatccccaaaacatctggaccctgctcgctttctgaactcatctcctgccactctttacctcactcaagccactcacattccactggtattcttgcgtgtcttcaaaaataagctcattcctaccttaggcccttcgtattctctatatcctctgtctagaatgttctacctatgcctcagtttttacatgattagttttttttcatcattcacatctatgttgagatgtcacctcttcagagtgcctttctctgactactctacgtaaaatagctcctttcctgtatccttttcctgggctttatagttttcattactctgcatattatgtcttttataggtgtacttgtgtttcctggttgtctggttctcctactcaaaagaacagagattttatcttatttgtgacagtattctcatgacttagagcctggcacatcgtagaagctcaataaataattgttagatgaatgaatgaatgaggaacatggttgtgttatcaataaatggttgagatagtagtatttagaaaacaaaaatgacttagataagtgattctcaaagtacgctccacagaccaggagtaccaccatcatctaggagcttactagaaatgcaaatcctgggaccccccagcccagacctactaagttagaaactggagataagcagagtgatctattttttatcaagaccttccaaagattctggatgcatggtaagtttgagaaccactggtttcagggataggccaaacctagcctactacctattttataataaaattttattggaacacagccacttgcattcatttacgtgttatctatggctgcttttgcactacaacagcagtactgagtacttgcaacacagacattatagcccacaaagcctataatatttactatccagcccgttataaaacaattttgattacctctagtttagatcaacgccttatgctatgtaattacggcaaagtaaacacatacgattcatcttctttttcaccgaaatcccactgaaattaaagaaaagctatggctaaagaaggcaccatagcatactgaaaaacagaaaagggtagcatcagtggaccagattatttgaggaatttccaggacataaaaaacatctcggagagaggagacaacagtgagatcagattaaaagaaacaagtatagagactgcaccacaagattcaaatagaggctattgcaaaaagcagcaatagtttctaagaaaaccgcagatgagtattattttccaagtaagcaagctaaatcaaccaccgagaaaacattgggtgaatcattaaaggactaccatcagaagatctggccagtgacccttctacccaaagacttgcacagctggctacagatctcatttataaacaaagctaaaaggctttgggaaaggctcatggcttcagtattggagtctgagaagcagagtacagcaagactgccacagtgacagcagaggcacaggaagaaaagggaagtctgactagagcatttgccaccaagaaaaagtgtcatgtacaggtctctaaagtaagagtactgaaataggagactcccagaatagcttcaggaaaaagtacaaggtaaggacaggaagcccatgtttacccagtaaacaaactacttccccatagttatggattaaattatgcccccccaaaaagatatgttaaagtcctaatccctggtacctcagaatgtgaccttatttggaaataggttattgcagatgtaattagtcaaaatgaggttacaatggagtatggtggtctctcaatccaatatgacttgtgcccttgtaagaagagagagatggccgggcacagtggctcacgcctgtaatcccagcactttgggattccgaggcgggcagatcacttgaggtcaggagtttgggaccagcctgaccaatatggtgaaaccccgtccctactaaaaacacaaaaattagctaggtgtggtggcaggcacctatagtcccagctactcaggaggctgagacaggagaattgcttgaacccgggaggtggaggttgcagtgagccgagatcgtgccactgcactccatcctgggtgacagagcaagactccatctcaaaaaaaaaagaagaagaagaagagagagacacagagaggagaatgccatatgaagacatgaagacacacagacacagagagaagacaatcatgtgaaaggagagacagagggccaggcatgatgattcacatcagtaatctcaacaatttgggaggcctaggtaagagaattgcttgaggccaggagctcaagaccagactgagcaacatagcaaatccctgtatctacaaaaaaaataaaaaattagccaggcataatggcatgtacttgtagtcctagctacttgggaagctgaggcaggaggatcacttgagcccaggagtttgaggctgcagtgagctatagtgcactgcagcctgggtgacagagcaacaccctgtctcttaataataataataaaaagacagaggcagagaagctcgaagaagaaaataatctcctagaggctttggaggttgcatggcctgacagtacttagattttggacttttagcctccagtactgtgaaaaaataaatttctattaagccacttagtttgtggtttgttagggcaaccctaggaaactaatacagtagacctccgggccacacattctactgctccctctttatcaccaaaagtggaacccgaattaacagacaatcaaattatcaccaaatacttggggaaaattaacatcattagaaaggatcatctgattcaaataactgaataactaaaacttgaagaaaattaatggcagcaacagaataagactttttaagtataatttatttggaggtattcgagaatatattactttaattagcaaaaatatgacagctatgaaaaaaacagaaacaattgggattcttggaattaagactattattactattttttttttcttagggatgagatctcactatgttgctcaggctagactctaactcctgggctctagtgatcctcctgcctctggctcccaagcagctgggactacagaccagcatcaccacacccagtttagttacaaaatattttttaaactataaaaaactattctgcatagtaaaacactgtttattaagttaaaaaaagaaaaacactcatggaaaacaacaaaataccttttggcatacaaaaagacatgcatatttaagaacatatatgaaatatcttaaatagaaacaatggtggggagaatgggaacacgcgtcaaggatgaaagttttaaaaataaacaaataagctgggcatggtggctcacgcctgtagtcccagcactttgagaggccaaggcaggcagatcacccaaagtaggaagttcgagaccagcctgaccaacatggagaaaccccatctctactaaaaatacaaaattagctgggcatggtggtgcatgcctgtaatcccagctactcaggaggctgaggcaggagaatcgcttgaactcgggaggcagaggttgcggtgagccaagatcgtgccattgcactccagcctgggcaaaaagagtgaaactccatctcaaaaataaataaataagtaaaataaacaaatgagcaatcctaagccaaaagaacaaagctagaggcatcacactgtcatgagatccttggggtgttgctttgccagccggaaaacctctgtggctggtggcacatttccccaggtttttactcaggcccactgggctcattccacccacctggcctggcaggctgtgcttggctcacaccactggcccaaatctcatgcctaccaaggacgagccaggcacagagtagcaaggggtatgtgagtgagagtggggttcagccactgggcacagccaggcacaccggctgtggtaaggttggcagctccaggtgccagcatgggtgccagctccctatgaggctgcatctggaccaggcatacctgaagcagcttccacagctggcaccagggaatgcggtagcacccagaagcttggagatgccaggaatctgcagagcctcagagagggtggcacagccctggtttggggagctcctaggtctgggatccccaaagggccacagctgtctctccttctctcttctttctttcttgttgcctgcaacgtggtgagcaaggggcatatttcatccctgtttttgttacagctcttttagccctcccatttggcaagtcctgagttcttgtcttgcatccaggaagaatgatgtacgcaaacaagtggaggtgagcaaggtgaagaggagctttattgagtgacagaggagaccctggagtgggtagctcttctccacaggcagtcatctgatcatctccttgatctggctgagcccaggggttttatgggcttcagaggggaggaaggggtggtggttggttcatgggtggccatggggagcccagagaaagcaccataagttcccatcctggctcttcagccaggcctctggattcaggccatccatggctcaaaggtggggcttcactagggacctgcctctttctgccctgcctcctgctgtcatccatagcactcaggctgtttgtgccaagaggcaactgcaggccagtgccgagctgccttcagcaacccccctcaccctctcccgtgcttgttgatacccaaagtctgaagggcgccaaggcagcaggggtctggtgtgtcagcactgctccaagcatgtgcacccacccagattgtgacagcacccaggctcagcctcaattttgcttcaagatcagagcaggcaccaggagtggggagaagccaggctgtgggagcagacacctccaagcctgagggggcagaggggcttcctgggcccccaagaacacaggtatgcccaggtccacagctgtggcttgggtggctgcagctgtacctgggaagcttgaggcttctgcactgccaattcggaagggcatgaggcttctgcctgttcccagctctcaccagctccatgaagctcaaagccaaggcagcgcctccccacctgcagctggtgtcttcgcagccaccactccaggcaggcggctgctgccatcaacattacccgacttaaaattatattacaaggctttctatcagggtaaactgtcagtcaaaaaaagaacaaaaaagaaatagaaaaaaattatgctacaaaaatatagtaatcaaaatatcatggtactggcataaaaatggacacatagataaacagaacaaaatagagaactcagaagtaaagccatgtacctccagccaactcatctttaaccaagttgacaaatgtagaagaatgaaactggtcccctatctctcaccatatacaaaaattaacccaagatagattaaagacttaaatttaagacccaaaactaaaaaaatcctagaagaacacctaggaaaaactcttctggacattggcctagacaaagaattcatgactaaggcctcaaaagattcagaggggtaggaggggagtaaaggatgagaaattactcagtaggtacaatgtacgttatttgggtagtggttacactaaaagcccaaactttacctttatgtaatataaccatttaagaaaacgaacttgtattccctaaatttatacaaattaaaaatgaatgaatgaatgaaacaagacacatgggcaaattataaaactgtgctatgaattaagatggtgtgattaactatttacacccaggatccaaaaaggagaaaactttacatattaatagggaaactaatttccaaaatagatatagctgaagattaatttacagaactaaacgtctaaactgagggattctcccagaacacagttcaaaagaaaaaattcataaaatggaaaactttaaagaagagttaaggggcatgaaaagagacccaaatgatctcaaatacccattgtgtaagtttcagaaggatgcaatagaagcaataaaataagaaaacaaataaataatggagggaaatttcttggagctagagaaagacactagacttcagagcaaaacctctgtaagatgaaggggctgaggagggaggggaggaatgcacgcctttgcaagcttgatggaacttcaggccaccaaggataaagagaaaaatcccaaaaacttccataaggaagaaacagacttttttctttggaaagaagaatctgattccaaataattgaggagacaaagtaggtgattatgcacattgctaagatttggctctagaaaaagctgggcagtagatggtattgctagaagggatgtcatcaatagtgagctaagtgtactaaaattatcatttttctcacaaagcttcatgttctgaagggaaagaggcaattataattctggtcccagctataaatgggctggtgccaatgtatcatcacccaactgcttctctaaaatccagctagcatccgtctctcataagaagcagcatttatacgaagacattctaatgtctacacatctataatccaatatctgtaatataatctataatctaatatctgtaatccaatataatatctgtaaatgctaactagcatcatttcaaattataaacccctatgaagtctccctgataactgacaatgaagccagcatacggagacttttccagagtcatgagcttgtgggtggcagaacaagggctgggaggcaggcctcctgactttgtagccagtactggtgccaccatgtcatgctgacagctcagcaccaatccttctatactctcgtgttttctcctgtttgtgataaagtatgtacatctgtgtcattggaaggcttggagaagagtccaaaggtgcaaaacaaagcaaatctccccacgcctggcagaatcttcagtcctggcctaatgagctcaccagctcagtaagttctgcgactgcttcgggttaccaaaagaatagagtatgtaacagtgctaggaaaagagacacttaaaaacccacatccaggcattgttcaatgactgctcataaatactttatggcaaaattctttctggtggcacagaaggccatgaacaatctgacacctccattagtcacctctgttagtcaccactacgacttcctgacccatctctgggtttcacttcagtttttagatacccagccctaacaattaagcaaaacttcattgatagttcctcttcaaaagtatttccagaataactattaaaatcccatggactagtcaagatagtgagatatgcttttgagtgaacagccaccatttcttccttttagagatttattttttaacttaacaaaaagcaaatctaatgtgaaacttaatgaaaattgtttcaaaaacttgaaatgcaactacaaaatagcccattattgcctaagctttctatacttaactagttttctaaatctatattacataggctagagaaataacatattgtttttatatgtacaatccaaatctagtctctccgaattttctttaaggccaactattttaatataggccagtattttactctattattcaatcgcaaaccacgtttctttcctcacagtagtgcattttgacaaaatcaatcttttcattcttttcagcaaataatacagaaattgggattcattcatgagaagtcagtgaaaataaaaatgatttcagattttctttacatttgtataatatcactagtagaggaggaatggctttccagaccacttgttaggaaaaaaatatgagtgggaaattacactaagcctatataaacaattccaaagtagaattctcttttctccttggtaaataaatgcttgattttcataattcaacatataattttaaactagggcaaccaaacttgtgacatgaaaagaggaattttattgttaagttacactggtatactgcaaagtcataccaaaaaaaaaggagcaaaatatattttttaataatcttacacaagaatgctcaagaatcttctacatgaggtaactacagaaaaaaagaacactaggtcagctgaaggctgaactaaatttgttccataaaagttggtgagtttcatttttcgcttctaaggggataaaggaaaaagaatgtgcattgtgtttaagaaaacccagaatactgccaaaagtttgccacccactttggcattctgcctttatcctgaaagataatttcttctccattataaacagcctatgtgagatgaactgtcaacaagagggaagctagagtgagaaacagagaaaaagaacagcatcatgcaaggaaagttatgaaacaaattgactcttgattctctcttggcttgcctttcttaatgcaaatagaattaaaaagtcaaatagccctaatgttagccaggtgaagtgtggttagaaatggttgactggaaattcccttgctttcatcaaacaattgttatgtgaatattgcatcagcttggtccttttgatgttcctacatgacttaagaaaactttgtatttccagtagtgtatttccaatgacaaaaactctgctgtgtgattttagaaaatcactaaaattaccagtgcttttgctagatctttcacagttgcaaaaacaaatgtttttgaacaaggctctatttttcatgaaaatattcaactgaatgcagggaaagtaaatgcaaaatatctagggaaggcaccaatcaaatcatgcaagaagagatttttctagacttcaaagaaaaagtattcagtgactccaaggtgtggggcaagggaggcaggggagtgatgaatttgttttctttgcattgttccacttccttgtttgctgtgttgcacaaactctattgaatatcaagatttggcctcttatgaataagatacttaatagagaagaatgtcagttttttcaagcccataaataccttttaaatgttcttagaattttacaattggatgaaaaagcatcaaaaaacatagtttgtataattttatcattaaaaatattttccattattattcaaggagttcattgatgctgaatacaaaatgcctaagatttattatttaagtttatgagctaaaggaaatcttagtgtttatctagcctaacttccttgttctacatttctgttttgttttttcaaatgatgtatcttgtttgcttcacgattatgttaaagaaaaagttttttttcagaaataagaaatagattataaatttttaaaaaggaaagaaaattgaggaaaaagggaattaaaggatattggataatatagagaaagatatttatagggcataaaatcatttctagtggaaggaggacacatgggtttgtcattgccagagcaccttttgtttttctgagcattttgtgagatggccaattttacccagcatagaatcgagtaagaatgaaactgaaataatttgcaaagttgaaagttgagtgtgaccataagcctccaatcctagttccagcctgcccaccatgctgggaatatagtttggatatttgtccctgcccaaatctcatgctgaaatataatctccaatgttggaagtaggaccttgtgggaggtgtttggaacatgggagcagatctctagaagctgagcaaatgccagcaccatgcttcctgtaaaacctgaagaaccatgagccacttaatcctctttttttataaattactcagtctcatgtgttactttacagcaaggcaaaaatggcttaataccttgggcatgctccagtagagattagaattcacatgaaacaacaaatgagaaacagggagaaaactattaagaggtctatggtagggaagattgtggctattgtctccatttacttttagaatttcttcgtgtgtgtgtgtgtgtgtgtgtgtgagagagagagagagagagagagagagagacaactagtagaaacagagtaaccaaatctcttaactggaaatgactttatatgttgtattactaaaagacgtccaatttccaacatcctgaatatatacagtgacagaggacagataactcactattttatggggtagtttattcatttttgtaaataccagccattgttcttaatattgttatcaagggtctcaacccgaaaataaattcatctcccctacccatctttcgcaacaacaaagcaaaaaattccccttccagactttgtcacatctgttaatgacatagccattttatcgaactcaaaaactttgtgttcccttgcatttaaaaatccagttatcaagtgttgctaattccaatttggactccgtagcatccattcctacccagtttcgtttacagcataccatcacttctgctgtacatttattcatcacacagacaaactctgatataatatggaggaagattatgcaagggcatgaatactaggaggaaccattgaggaatatcatggaggctggccaccacacaaggtaacagaatagatgaccactgataagatcactgggaagaggacatctttctccataggtctagaaggaaaagttctagagataactctgtcttagtttagatcatgtgcccatctctgaaccaataattatgaccagagaaatggactcccttagttaaccagacttgggtcatgtgctctacctatggctttttttttttttttttttgagatggagtctcgctctgtcccccagtcttgagtgcagtggcgtggtctcggctcactgcaagctctgcctcccatgttaacaccattctcctgcctcagactcccaagtagctgggactactggtgcctgccaccacaccggctaatttttttgtatttttagtagagacagggtttcaccatgttagccaggatggtctcgatctcctgacttgtgatctgcccgccttggcttcccaaagtgctgggattacagacgtgagccaccgcacccggcctacctatggcttttgagggcaaatggtgtcatctccacctgaatcactgaatcagaaaagaggggatgctgaacggaaatactacatatatcctctattctacctcacatttcaactgctttcttggtcttctaaacatcctcatattactgtctctatcttccttttcaaacagtacatagctgacaaattaacttcagtaaaactcaacttggatcatatgttttcttttctcaaaatcttccctaaatgggtcctcacacttaaaaggtaagtccttagtgcttacctggcattcacacttttctataatctcaacccagattcttctggtctaatctacaattttatacctccctaaaaaagtcaatttactcactttcttcctaaaatgactttgactccatggccttgttcacattgttcacattcttcattcaccaagaatacttttctctcttctttcctgttcaaagtctacccattcttcaagtgcaagtcagagtttacttccatatagatttttatagtcatcccagcctgaaggaactcctttctctccctttcgctctcatggtatttttgttgtatcattcttaaataatgataaatgttttattctattatgaattcatatttcaataagtaacacatattatctagctatccatattgcaaacttcttaaaggcaaggacaatggcttatatttcttttcattctgtgagagacgtagcttgcatttaataaacatttattatatatctggataattataaatatgaatatagatattagtgtcactatactatggcactcagttttaaaaagaaaccttcaacacactagcttcaaccaaagtccacaccagacaagagctgttcagtaattagaaagacactacaattctaaaacgatgtgcacttactactacatagctgcagaaaatgagttgctacttttcaaaatgaacgggattgctgaagcaataatctagattattttagccaacagtaatatatatatatatatatatatatatatatatatatatatatatatatatatactcctacttcaagctagctatctacaatggttagatatatcacgtactgctattttgctcttaaaagagtttgtttgaactgaagcatagtcagcacaaattacttctgggaaaccatttctgagagaatttggctctttacatctttggccagaattccttgagttttggcttccagtctgtattttgctttcctggtagaaatgtgtactcctagtatcttgctggcaaggatgcctctgccaaaaggaaatacacactactttattcatgaaaggacgggaacactctcaggtagactattggcatgtagtctaagtgaaatgagcccacccatcattacaaccttaccaaatatgtaagacacttccaagtattgtggataaacactcctaggtgttgtgcatatacaaaatcatccagaagttaccctagaaaggatggcaatacaaagtagtatgcatgttccaagagaataataataagtgtcataaataattacagaaggtagagtttttttgagtttggaaagctcaggaaaggtttcaaaaggaaacggatctaaccgatggatcatttagtaaagatggacgatttagtagagtcccacaagagtcaggactaaaaatgacatattctaggccaataggatagaaaaagagggctaacatagaggcataataagtaaaataaggtaggcaatttggaaatacactagagaaaagctttaagattctgtattttatactatagacaatggagatttttgagttttcaagcaccagcaaaatagtgttttaataccaaattgagatataattgtcagttttttaaaaaaaaagttttctaaaaataaaataaaatcactaaaataattttgaagaaaaagataaattgaaaaagatcttttggattgttttcaaaaagatagaaaacatgcttttggaatagaaataacgcatagcttggaatggaattaatgaagctcaaagtcagatcatgagtaggaagcatagaattcaagcactttagaggctggaccatgaaaggtaacattataactaaaataattcagcacttttattcacatttagtgcttttttcctgattataaaataacccagatatatggataggaagaatcaatgtcatgaaaatggccatactgcccaaggtaatttatagattcaatgccatccccatcaagctacaaatgactttcttcacagaattggaaaaaactactttaaacttcatatggaaccaaaaaagagcccgcattgccaagacaatcctaagccaaaagaacaaagctggaggcatcacgctacctgacttcaaactatactacaaggctacagtaaccaaaacagcatggtactgtaccaaaacagagatatagaccaaaggaacagaacagagccctcagaaataataccacacatctacaaccatctgatctttgacaaacctgataaaaacaagaaatggggaaaggattccctatttaataaatggtgctagggaaactggctagccatatgtagaaagctgaaactggatcccttctttacaccttgtagaaaaattaattcaagatggattaaagacttaaatgttaatcctaaaaccataaaaaccctagaagaaaacctaggcattaccattcaggacataggcatgggcaaggacttcatgtctaaaacaccaaagcaatggcaacaaaagccaaaattgacaaatgggatctaattaaactaaagagcttccgcacagcaaaagaaactaccatcagagtgaacaggcaacctacagaatgggagaaaatttttgccatctactcatttgacaaagggctaatatccagaatctacaaagaactcaaacaaatttacaagaaaaaaacaaccccatcaaaaagtggtcaaaggatatcaacagacacttctcaaaaaaagacatttatgcagccaacagacacatgaaaaaatgctcatcatcactggccatcagagaaatgcaaatcaaaaccacaatgaggtaccatctcacatcagttagaatgtggatcactaaaaagtcaggaaacaacaagtgctggagatgatgtggagaaataggaacacttttacactgttggtgggactgtaaactagttcaaccattgtggaagacagtgtggcaattcctcaaggatctagaactagaaataccatttgacccagctatcccattactgggtatatacccaaaggattataaatcatgctgctataaagacacatgcacatgtatgttcattgcgacactattcacaatagcaaagacttggaaccaacccaaatatccatcgatgatagactggattaagaaaatgtggcatatatacaccatggaatactatgcagccataaaaaaggatgagttcatatcctttgtagggacatggatgcttcatcctactcttcaccagttagagtagttcccttaagtacataagcaaacagctacttgcatcacaaattattgtaattgtaacaaagtaatctacattcctaatgacgctgcatcatgaagaaaacataaaattaaatagcacgcaatctatttaagagatcttaaagaaataataatcatgaataatttttaaaaactattggacaattatctaaataattccataattattctgaataaatgataagctgtgatcatcctaattagcttgggaaaggttttatattagaataacattcaaaagctgaaaaaatatgaaaaattaaggtaataataaagtaacataaaataaattaaaagttgcaattacattaaaaatcactgtggccataattatgacctgtagacacatctggaatacaagaacacaggcacagaagtcacttaacaaatttttctttttatgagtgatcagcaatgagtattttaacaggttttaacactacattcaaacattatcacacttaaaaagagggcttattattgtatcaaaatatctttttggcaaaaagttaaagcataagttgaaatgtgatgagtacaaaatgattagggggtataataaaatcattattcatcttaatgcttcattccagctagcaatccaagttagcaaaagtcacaggaaaaacaaggattttaaaagttgagtataagatgagaaatactaacaactatttttggcacctgtttaatgctttgtggctctatacatttcttaacttttcctgcttagactctctctttcagtgagtctttattctagtattcatcctttcccaatccagtctatgtgctctgaaggaaaattacctcttccctagccataggggtggactctggatcaaaccatatctgaagcttcctcatcactggatctttcaattatgaaactaatacacttcttttactggtcaagtcatttggaattaaattttatttcattagaaaattaaattatatcatatataatgtgtatgaaatatgtatacacaattaaaataataataataaaatgaacactcatgtaccagacacccagcttaagaaataaaacagtgttcagagctcccctaagtgccctgccttattataactggcttcccatcccaaccctgagaggtacacaccatcctgaacttttggtttatgatatataacaaatatcttttcacaatgtgactaacctttttcagttcctctatggtttccattcattatagagagtttttaattttaatgtcaaatggatacattttttcctctgctagttcatattactgtatgtgtcttatttaatagacctatcctggctaggtacagtggctcatgcctgtaatcccagcactatgagaggcccaagtgagaggatcacttgagcccaggagttccaggctgcaggaagccatgattgtgccatttgaaaatattatagatagatagatgatagatagatagatagatagatagatagatagatagagatagataaatagatatttttctatgttttcaagttttccttttcataataagtattttattttattagaattgatttttgtggggtaaagtacaatttcacatttttcataaaattatttttcacaaagtaacataatgtaaccaaactcaggtttggctggtagctgcctgaaaagccaagtgcacaagaggcaaggtgtggtggaaggaaagcagctttattcaaatgccagcagttgcagaaatggctgggctcaagctgcaaagaaaccatctcaaatttttaagctaagtgaaggagtttacgaggggaaacacatgggaatgggagtagtgcagggtgcaggcctgcatgtgttgttcccatggttatcttgagctattgcccatctgggtgtggctggccccatctaggttaccagatgagttgtaaattaaccacctaaagaggaagaagtctgcagctaggtctccatatctggtttgttttgagattagctggtggagtttctaaggaagcctgtagtcagagaaacatgcacggtgcaaggaagtttctactgggaaagagggagaagcaaagagcttcaaagtacatttcaaagctatattctgagattggagaaataaaatctaaaatgctttttaaacctaagatactcagttacaaaaaacaatagttcttccttcctgctgacatacaaggcctgctctgtcataaatcaagtttttttttcctctatgcctgcaccagtttttttttaattgaggaaaaaaatatatatataattcaccatatttaccattttaaagcttgcagttcagtggtaataaatacattcatatttgttattttccctcttcatcccctacaccctcttcttaacctctggtaacccacagtctactgtctatcttcatgaaattcacatgtttagtgcccacatacgagtgagaatgtgagatatttgtattttacttaatgtaatggcctctagttctatccatgttgatgcaaataacaggagttcattcctttttatggctgaataatattccataatgtatatataacacatttctttatccatttatacattaatggacatttaggctgattccatattttggctattgtaaatggggcagcaaaaaaacagggaagtgtagctatctcttttatacattgatgtcctttcttttggatatatacccagtagtgggattgctggatcatatggtaagtctatttttagttttctgaggaacctccacgctgttctccatagcggctatactaatttgcatccccaccaagagtgtatgagggttcccctttccccacattcttgccagcatgttattgtgcctgggtcaattttaatgctacctattctgttcccttagtctgtctaaccctataatatagaattttgtagctatataattatcctcggtatctaggagggcaaatcatactatattgctcttcttctctgggaattttgtgactattcttacctcttgctcatccatattgatttttgaattaatgcatctagtgccataaaaaatcttgatgggattttgacagaaactgaattgttagatatatttggaaagagcagcattttcacaatactgagtctttgtacccaagattatgaacgatctttggatattctttaatgtctttttccatacggtttatacttttctccatgaagtgcttacatatcttttgttagatctattaatggatacttggtattttcaattgccataataaatggtatctttcttaattgcattattaaactgctcatagctgatgtattgacatgcaataatttatttatgttaatgttttaaattgagcaatcttgttaaactctcttattaaatctcataatttttctgtggacccttgggttttctatgtaaggtcatttcatttatgaatgacaatttctccccctccttttcaatcattatacttcatttctttttctttcctcactgcagaagccaggactacaagtacaatgttgaacagtgaggtgatagagagtgtccttgccctgtttcttatttaagaacatgcattcaacattacctcagggagtgtcataaatccttacggggtgctgaagggggatggtctttcttctgtaccatcttcctgctggctttcagtggtgaccctgcctaacaggggacctcatatgggcaagatgattggtggtagccaattttaaaagaagacaacaagcttttgagccaggttgtccggctccagcttattcccttagcctgtcaatgcagttagaaccagaggaacaaagttacaggagctgaccaaaaagctgaaggaaagagttatttcttggtccttctcaaggggaggaaaaaaaatactgaaagcagtgacacacagcaaaagtttaatttttgagatatgattctgagaaatttttttaaaagaaacaggtcataaaattaaaagtaaaatattttgcaattttagtgagagaaaaacaatactttaagaaaactttattttaatatacgggaccaatcttagaagattattataaataatctctttttaataataaccaacttaatcacctacaaaattccttttataaagtccacttcatgaaccttatgatgacttgcacagaccatctatgatatgcttggagtttctgacttgtcctaaacttttctctttcttaaataatcagtcattttactttaggacaaaagtttaccatagaagatgcttttttatataaaattattctcttttttaatcttccttaccaaaaaatacatcttcatatctatatctttcttcaggtctctctttttcctacttactgattcctttctagcttacctcataattaacatttttagtccatagtttgagttgacctttagataacctctgaattacataaaattattattttcttttttaataagactagaaactgggagacatctggcctccaatgcttcccagagtgatgcagaattaaacaacccaaagaacaaaaatcattaagagcagaaagaaaattgtaagtgtaaagttcagggcatgcaagcatagggcaatgtgcatcagaagctgctgccacaatagcacacaggactctctattttactggcatgttgcaaataggcctagtttccacacaggaaagagtgtgctattcccaccagggatatccctgtggtaggtacttgtagaactacatgaggtttattggtgtttatcccagatttattagctggtatgcttgcatcccactctccccaagggtcaaagttcttaggcctcatagctgaataacagtcatcagcacaaaaggggttacagtcttcatcagcactgtaatgggagtgattagattgacataacatattttggaatattaaagtaataatattccattttatcaagaattccagttttggcccctagaccccatgcttcctttcctcttctgaaactgttaactgggtcttgaattatagctgcacccctattttgaccataataccattcctagcagggaaactgggcaacttggcactaccagaaattcttgttgaaatatttgggttctttgttttaaattgacaagtcagagaaggagtaaaaaatctagtttgtggcttttcttccattctgataacacttatagaccgagaggaaacttttcctgcatgagcagtaaggacatagtagttttcccctgtatcaaaaagaaactgaatttggatgcccatgctgtccagagttacctggggttcctcaatggtaattatgatattcctggaccaagggtggtgagggagaccctgggccccttcagtcttcatccagttcctccctttgcattgcaagagttttgactggccaagcccctagatgggagtagggcagtcaatcctctagtgccagagatcatgactggtatctttgcactgatggcaggggcctggtgggagtctgatacaatccttcatccaatgtccattctttttgcacttgaagcaagggttactacatttgggccctcacaggtttccctttgacatcttttgggcctttagggcattgccaatgacagcagccataattttagcttgtcatttattttccctccctttctctaggtcacaattgttgtataccataaaagcagtatccagaagctgtgtctgaggccctatttccaactttagaaacttgcatctaatattaagggcagactggcttatgaagtgctgagctataagcgctttcccttgttaagaggctgggtctaggttagtgtacagttagtttaaccagctgtaaaacatagccgggatttttctccttttcctgggtgacttccctcagttattccttttctcattcttccatgaaaggtcaaaacccaaagacaaggtttgaaaaccatttgcaaacttcctaggattttcagagtaactctctagtttttctttacattgctgtgtatctgttaccaaaaaaggggcttggactagcattgggcacactggccctgccacctctctgagagtaaataggcttggggggtggtgtatggggtaccttttctattgtgcagaggactcagcaggatttctgttgactcttgtggtttttcttccagtgtgctaggtgaagagttacatggaggcagctgtggttccctctgagagactggtgacccctgtagcagagaattatttatgatgtctacacctgtcttggaactctccttttgagtaccttttcttgaaactttgcatatagatgggttctactaggggaggcattttatctcctgtgttgttaaatgcacacagtgaacaggtttgacaaacttgcttagccactgaagccatattagatctgatgaagagtttgtttaccgtggctagtatggcatccctccccttgtggaaggagtcatgcaaggtttttatagctttccactgggctgcttgagggagatacaattttggccacatatgtcaccagagtctttgtttttgacccccttgctctttttattagttgtttttcttgtactgtgtagttaggttttacaggggaattagcataaggaaacaaagctaaaactggttggtattgtattctgagggttgccactttggctttcttatcagccttcctgttttccagcactatgggctaagtgtttctcatgccccctacaataaattatagctatagcctttggtagatatatgcttctaataattgaagaatttcagccccatgttttatgggggaatgcctgctggttagtaattctttttctttccagactgtggcatgaacatgaaccacaaggaatgtatatttggaaactgaaaaaatgttgagctttttctctttttctaatattagagtccaagtaagagcaatggtctcagctttttatgctgatgtgcctggaggcagcagctggacctcaatatgtgttgtaatttactattgcatacccagcctagcattctccatttgacacaaaattactgccgtctgtgaaccagccatcttcaggatctgggagaggctgatcttttagatcaggccagctcatatatgtgtgtacaaatatctgcttgcaggaatgatcactgggcatgtgggcagtagtggagctggattcagggtgttacaagttttaaggataacttctggattattttaaaaacatagcctgatatttggttaacttttctcctgtcatccaaatgtgttcttttgcctccaagattgatttaagctggcatggggttagtacttccagtggttgacccagagtaatcatagtggcttcctctactaaaatagcagtgactgctattgcccacaaggagcttggacatctcaaggacaccctgtccaatttatacctttccttttttttttttttttttttttttgagacagagtctcgctctgttacccaggctggagtgtagtggcaccatctcggctcactgcaagctctgcctcctgggttcacaccattctcctacctcagcctccccagtagctgggactacaggcacccaccaccttgcccagctaattttttgtatttttagtacagacagggtttcaccatgttagccaggatggtctcgatctcctgaccttgtgatccacctgccttggcctcccaaagcatacttttccttttagctacatgtaaagaaaaaggcttagtgaggtctggggtgcctagtgcaggagccttactgacagcttgttttaacttagtgaaggcctcccttatttttggtgtgcattcaattggctcattctctggcccccacatgactgcataaaggagctttgctataaatccaaaattgggaattcatattctgcaaaatccaaacatccccagaaaaggacaaatttgtttggtgggggtgggtctaatccacatatggcttgcacacgctctggggatatctgttgggattgaaccgtcccccagtgattgaggatgcagccaagggggaagtcgggtgagattgaaactgagtttcttgtcttctgtctgtagagaacaaggaaaacttgaaatttagagcgttctggcctagggccacacactggggcgtcccccattgaagggcctatgctggggttgagggccaagagggcatcccctgcttgggcctcttcatgacatgccacatgtctctggccttagatgggcatcagcaccacttgaagaaggattccgccatatttggtgacctatgattaagtttccctttagtccccaggtgctgccctcagcttttggcatctctgtagctggccaaaatagttttcttccccaaatggtttccttaactattgtggtaactgtagtttgaagggcaaggaattgcagactccccagcttgaatttgttaaagattggcctcttgataagggaagagaatgccctctgaccagataaactacatgcagtgatttccccatggatccgctgcacaacttaggcaatgatccgagagtctccaccaggatttttctcttagcaccaggtctgctaaactaaaacgatccagatctggtccctcacaaaagaagcagggtttttttccttatttagctattgcctgggtcctttgggtcggggtacagtaatttcttgtttcaacattacgaaaacaaaaatcagaatgttatgtcttgccacacacacaaatacctcacaggcacagggatttgtcttgtgcctggtgaagcctaattgctccgttccccaccagcttatcctgtccgagtcttccagcaggggggcaccctagtggctcttaactacccatcttgtgcccccaaagagtgccatcagaggaaagaatcagaaagcaaaaccaaaaataaaaatcccaaattggcgcttacctcctggctggcttaccaaaaatactacgttaccagctgatgttgcaaagtcccaggttcttcactgagcaaagaactggacatgacacacaaatagcaaagcagcaaaagatttattaagcacagtacaatttgcaatggactgggctgacccacaagtggtatcagccccgatttgtaacatttcatggccttttattatgtttttttactctaacttactcaactttatttttttgtgaccaattgctcatccttgcctttcccttattgcaccttaaccttactttatctcttgtaggctaattgctcattcttgcctttcccttattgtgccaacttactgtttacttctttttatctagtatgctctgcttttgtttttgttttgcttttgtttttgttttgagatggagtctcactcttcgcccaggctggagtgccatggtgcaatctcagctcactgcaacctccacctccaaggttcaagcgattctcctaactcagcctctggagtagctgggactataggcatgtgccaccatgcccagctaatttttgtatttttagtagagactcggtttcaccatgttggccaggctcatcttgaactcttgacctcaagtgatccacccacctctgcctcccaaaatgctgggcttacaggtgtgagccaccacacagccctctgcttttgttatcttgcatgttctccttaagctagcctacatccaacagttccccttcgcccccagcttcctctgctattcacctacctcaacagtgatatacttacatcgtatttcttttcattgatattggcctggtatctcttttgaatctgtaatttttagttgttctgtgctcttgagctttatgcttaacttttataaatagtatatatatgtatttgttttaacctaatctgaaaattctctcttttaaatgaatagcttattccattcatatttctggtgattactgatacatttggattattgccaccttctttttctttttttagagagatagggtctcttctgccaccccgcctggagtgcagtggcaccatcatagctcactgtaaccttgaactcctaggctcaagcaatcctcctgcttcagccgcctgagcagctaggactacagttgcatgccaccatacccagctaattttttattttttgtagagacgagggggccttgctatgttgcccaggctggtctcaaactcctggcttcaaataatcccccatcttggctacccaaagcactgggtttacaaacatgagctactgtgcacagcctatttccaccttcttattaactgatttttattcgcttcattttttatgccttttcttctttccctaaatttcccttcttcttcctcactcccagcagacaactttgcatcttatttcacagagataaaagaagcaattagaagataacttccacatgccccccacaacatctagctacttcactgcatgagggacccatctataaccctttcttctattgaggataaactgctcattctcctagccaaggccagcttcaccacttatccactaaataccatctcttcttgcctacccaatgaccttgctcaaacaattctctactcttttaaatcatcaatctttcaatctctgctggatcattcccataaccatacatatataggattgtttttccattttaaaataactttttttctggactctatcttctccttcagctaccacaccatttctcttcttcagcttacaagaaaactcttaagaagagttgcctatacttgctgtctccagtttctgttttcccattctctgaaccaattcctatcaggtaagttaccaataatcttcctttctttttgttttttttttttttgagatggggccaaagtgcagtgctgtaatcatagctcactgcagcctcaaactcttggactcaggtgatcctcccacctcagccacccaaagtgctgggattacaggtatgagctactgggccccctggcctgcacattttaaatcttgttctcatttttcattctacttgatcactcaaagtccaagctactcaggaggctgaggtgggaggttcacttgaggccagcatttcaagtctagcctgggcaacatagcaagaacttgtctctaaaaaaggaaaaaataaaaagtatttgacacagctgattattcccctttctttgaaatatttttttcacttggcttctaggacactcaattgtcctgctttttctcttacctcattagtggcatctttttagtttcctttatccttactccttctctctctcactaccaaacagtggaatactccaaaactcaatccttggggttctcctcttttctaactactcttacaccattggtgatttcatggtttgtatatctcatatgccaataactccaattaatatctctagaccagacttctcctctgaaccccagactcaaatatccaactcctcacttatcatctctaacataacattccccaaactgaattcctgatctatttcccatcctaattttgtttgacacaatctctaccttctcagtgaatggcaactccaagtcctcctgttgatcaggcctaaaatcttgccattatctttgactcttcttttctcagaccccacagtcaatctaccatcaagttctgttggttttacttttagaatacatttgagaatcctacatttcccctaactccactcctaccaccttcatctattccactatcacctttcacgtgtattattacaacagctccctaactagtttccctgcttccatccttgtctcccttcaatctatttactacactgtagccagagttagtctgttaaaatataaatcaaatcctatcacatctgcttaaaatcctccaaggcttcacatctcattctgttaaattccttatttagcctgcaacaccctaaacaatctcagcccaactgcttccccacatcctaccttctgtccaagctctctgacctcatctcccactagttggtctcattcagtcttttctagacaagctggctgttctgtggacacagctcctgtctggcctcagggtctttccacttgatttcacccttactaggacatttccccctagctgtctacatggctcacctacttatctctcacttcccactaaaatgtcaccttgaaggccattcctgtccatattccttatttatttccctttcttaatttttcctgtagcatttatcatcatcaaacatgcttatatttctatttgtataacttatgtattgtctgtctttcttcaatagaactgatgcctcatctttggcatcttggtacaaattagaaaatgattcaggcatgtgcgtgtttgctcgtacacacacacacacacacatacacatacacacatacacgttcatcccaccccatgcacaggatttggttagcagctacatttgtgtaaagaaaaaggcatgggtgggagcagagtaaaagacgaattttatccacctccagtgtccccctccccattcaactcctcagccaggtgcctttgggcagaacattatgcacatgattgacagctctaagtagaatgtaagcttcatgaagacagggatattttttgtcttattgcttcttgtgtccccagtaccttagaaagtggcacacaaacactcaataaatatttgaaacataaattaatagtttgaaaaaaaaacaaagggtaaaagttattagttgttattttaaaataaaaaactaaatgacataatcctggaaaagagggcctcagaacattgatgaagttcataaaatgggtaaagtgactgctgtaaaataacccagaaattaagataataaggcctagcatacataccaaatattggaaagtatgggaattattttactatgtaattgtataataaaaataagaacaggagaatgttgttcttggcacttttaagtcaatgacctactttttacttcttgccttgactaagatgcactacaaattttaaagtcctttgaatggtacattctttggtgatttacttttagagggaaatagttgattgttcaaaatcaataaacaggaaaaaataaaaagactatggaaagtctgtacacagtagctgtcccagtgtctcttttattaaagttttatttcctctttattaaaatgtttgcccaattctcttgcccatttatggcaagcataaactgttgcttctcatctgaatttgtgtgagctattttgaaatatttaagacattaatctttcattcagtttacagtaaatattttcactcagtttatgttttggaaaaaatatatagaactttaaattttatttagtcaaatttgtaagtctttatctttgagattgctgtcatctattcaagcttaagtagcctaccagcaatatgacaaactttcatttctgcttttctgattttcttttccatgtgactttgaaattttaaaatttacatacctaatagaaattagtttggtgtattgtatgaaactggtactataaagcattttgttacttaaaaacactgtgatcaattctggtaacatttgtttagaaataaactctaacctcttttcagagatagttggatttagagtcataaaattccaacatttcaaaggacatttccattttacttaaatttgctttaaaaataagttaactatcttaaatgtattttaaaagataataaaacagagattaaaatcagctcctgctttaatatctcctccattactaatcctctgatctctttacagtcatgaaggtcaaacatttatgtttatagaaacagaagtcctatttgtttcgtaaagctggtttattttatcaggtattaacaatgggcatcaaaaaggtgatgtaacagtatgaaagcatgaaataacgtctttgtgattttttttaaagaataaagcagtgcttctgtctggggacttgggaggctgatgagggaggattgcttaagcttgagagtttgaagctgcagccaggtgtgatcacaccactgcactccaacctgggtgacagagtgagatcctgtctctaatatatatatatatatatatatatatatatatatatccacacacacacacacatacacacactatatatatacacactaagtatactaatacatttatactatatatagtatatatactgtatatagtatatataatatatagtgtatatattttatataaactatatatagtatatatacactatacatactatagtatagtatattatatatagtatatatattatagtatactagatatactatatagtattctctatatatactatatatagaatactgtatatattctatatatatactctatatactatatattctatacatatactctatatagtatactatatatacatatattatatataaagagtatatatatagaactttgatcacagaattgatcacagtgttaagtaactatatatttatacatttatatttatactatatataatatactatttatatttatactatatagtatactatatatagtataaaaatatagcataaatatagtatatatagtatagtatactatatacagtatactatagtataaatataaatataaatgtataaatatacatgtataaatatgaatgtataaatatatagtataaatataatgtataaatataaatgtatacatgtatagtataaatagaaatgtataaatatatggtataatataaatatatgtatataataatataatataaatatatgtctataataataaagcaaagaagaaaatggtgtgctaaaaaagtgtttacaactgtaccttaagtttttgagcagtttgtataagagatacagaatatatattattgatcaaacaaggaaaatgaacatttttgggttcttgttttggttatctatcattgcacaataaattgcccccaaattgacagcttaaaacaataacttattattttcacacttcattttaaagacaattgtatttcacaactttcattttaaagacaattatatttcgcaactttcattttaaagacaatataactaaggctcaaaatggttaagcaagttgctaaagattcaaataagtcattgaagacattctaactcctgatccacattaatttgcatggcaacatactgcctttttcatttattaagtagtattccaactataactaaattatactagcaattcaactgaaattgggtatgactgatccttattaatttttaggacttaaatgtgagagttgtgaggtaatggagagtatagagcagagtagggaattaaaaaaaagcccaagttagttctagactagtgtttcccaactttgaataaaatatgactcattttaaagaaagaagaagggaaaaaaacccatgactacactgttgacttaaaacttttaaattaataaaaaatgataaaggggatatcaccaccgatcccacacaaatacaaactaccatcatagaatactacaaacacctctatgcaaataaactagaaaatctagaagaaatggataaattcctcgacacatacactctcccaagactaaaccaggaagaagttgaatctctgaatagaccaataacaggagctgaaactgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatctttgatgaacattgatgcaaaaatcctcaataaaatactggcaagccgaatccagcagcacatcaaaaagcttatccaccataatcaagtgggcttcatccctgggatgcaaggctgattcaatatatgcaaatcaataaatgtaatccggcatataaacagaaccaaagacaaaaaacacatgattatctcaatagatgcagaaaaggcctttgacaaaattcaacaacacttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacgtagtgttggaagttctggccagggcaattaggcaggagaaggaaataaagggtattcaattaggaaaagaggaagtcaaattgtctctgtttgccgatgacatgattgtatatccagaaaaccccattgtctcagcccaaaatgtccttaagcggataagcaacttcagcaaagtctcaggatagaaaatcaatgtggaaaaatcacaagcattcttatacaccaataacagacaaacagagagccaaatcatgagtgaactctcattcacaattgcttcaaagagaataaaatacctaggaatccaccttacaagggacgtgaaggacctcttcaaggagaactacaaaccactgctcaatgaaattaaagaggatacaaacaaatggaagaacattccatgctcatggataggaagaatcaatatcatgaaaatggccatactgccctaggtaatttatagattcaatgccatccccatcaagctaccaatgactttcttcacagaatgggaaaaaactactttaaagttcatatggaaccaaaaaagagcccgcatcgccaagtcaatcctaagccaaatcctaagccaggaggcatcacgctacctgacttcaaactatactacaaggctacagtaaccaaaacagcatggtactggtaccaaaacagaggtatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttctttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaagaaactagcatcagagtgaacaggcaacccacaaaatgggagaaaatttttgcaacctactcatctgacaaagggctaatatccagaatctacaacgaactcaaacaaatttacaagaaaaaaacaaacaaccccatcaaaaagtgggtgaaggacatgaacagacacttatcaaaagaagacatttatgcagtcaaaaaacatatgaaaaaatgctcaccatcactggccatcagagaaatgcaaatcaaaaccacaatgagataccatctcacactagttagaatggccatcattaaaaagttaggcaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattaaggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcatatgtgggaattgaacaatgggaacacatggacacaggagggggaacatcacactctggggactgttgtggggtggggggaggggggagggatagcactgggagatatacctaacgctagatgacgagttagtgggtgcagtgcaccagcatgtcacatgtatacataggtaactaacctgcacattgtgcacatgtaccctaaaacttaaaagtataataaaaaaatttttaaattaaaacttgcataaatatgttcaaatataaaatgaattataaatttcttatgattacagtttacacacaactataaaaccaaaacaaattgcaaaattgttaaattatatctaacatgtatagtacataataagtactaggcactttacatctatcaacttatttaatattcacaacccaatgagttggacatgattattatcgccatttaatagatgaggcaaccaagactggaagaagttaaacaacttgtccaatgtcccaaaactgataaatggcagagctggatttcacagaaaagttaacagacaagcgaatgtgaagaatgataccgttttacagaagttaaattgttccttgtaatgtgaatatggtattgactttaactgtagatcttctggctttaacatacataaattaaaatgagcgggatagtgactaatttctcccaccacttgtttttctcttctgtcaactgctaaatatatattggcacagcacaaattaatgtcatttggtcttcattttaagggaatggcttgttacaaattaagtctacatctgttctctcaagttttttcttaagacaattcctgattactatttttctttattattgggatttaattcacatactatacaatttatgcctttgaagagtacagttcagtggcttttagcgtattcacaaacttgtgcagccatcatcactaattccagaatattttcatcataccaaaaagaaatcccacactcactaagcagttaatatagtttagatattcgtgccttcaaaatctcatgttaaaatttgatccccagtgttggaggtgaggcctagtaggaggtgttttggtcatggaggggcggacccctcatgaatggcttggtgccattcttactggagtaatcccatgagaactggttgttaaaaagagcctggcacctccctcctctctttccttttcttgccatgggaaacctgctccccttcgtcttctgccatgaatagaagcttcctgaagccctcaccagaagcaaatgctggtgccatggccatgcttcttgtatagcctgtagaactgagtcaaaaactcttcataaattacccagcctaggcattcctttatagcaatgccccacactcttccccaccagccagtaggttggcaattatcaaactattttctgtaatgattttcctattctgaatatttaatataaacggaattataaaatatgtggatctttgggtctggcacctttcacttagcataatttttcaaggtttatgttgtaatccatgccagtattgaatccctttttatacctgaataatgtttcattttgtggatgggatcatatacatttcatgtacattttaatcaattaatggacatttgagttgtttctacctttgggctactatgataatgctgtgataatatttgagtgcaagtttttgtgtaaaaatgttttcagttctcttgggtatgtaactaggagtgaaattgcccaactgttttccagaatagttgcacattttactttcccaccagcaatgtatgaggatgccaatttctctactttctcaccaagacttgatattgtgatactgactttctgattatagccatctcagtaggtgtgagtggtatctcaggtggttttgatttgcatttatctaaggattaaggatgttgagcagttttttgtttgcttattagccatgcatatcttctttgaagaaatgtgtattcagattctttggccattttgtaattgggttatttctctttttattcagctgcaagagttctctcattaagatctgacaggttaatacaacaccaatgcaatgataaatgcaaaaaacagggactctgaaattgcgtggttgtactcagttataaggtggtcatccatgagatccagaatcaaatttgatgaaatggttaagattataatgttttataatttgtttatttgaaaatatacattttaaatgtttgctagagagctctaatatcctcaagaatacctacaatgtaaacactgttctatgcatagactaaatccttagcaatagacagaaggaactgagtgctctttgagtgagggaatgggcttgaccagtgtttgaagatttaaaaatgaatatgaagacatgttgtgacactagggtatgattatatttttatatttaagtagaatctgattatcatcagaaaaactctaattttaaaatccatagctggcaatatccatgaattcagcccaggtcatcaaatgctgaaagcacatgggtcagattgactgtctccattttttcttgcttacttcaaagctatgaagaaatccaaagcccttgctgatactcttccatgatatattccttttaaatgcttgaaaagttttcccttcctacaggaatcccccaaacacagctgtccttacactgagcccctattcaaattttggttcctctttctaacattggtcgtcagtcaattttgctggtctataccaactgcagatctagagccaatgcttatagaacttttctgagaattcttttaatttcagataattttttaaaattaccacaaaattagtttagaagaattcgcagagaggtacattgggagggaaatagctttgaggccctttatggatttatgaccaaagctatccagtcaaattcctccaggtatttttgctatttcctatgggtatactgaaattacacacattttaaagcttccttaatcaacttaaacaaatacaaataataaaattcagtgtcaatgagatactgaatctaaaagataaaagtacatccatatttttataatgatttttcaattgttatggaaagaaatatgagactatgtaaacagaaaaaataaaatttcttttaattaaaaaacccacattaaaaaatatatcccaagaaaatattcccatcacttattactccaaagagtaatttgttcaaggaggttaaagcagtgttacttataatagttaaagaatcagaaaatgtactttcctaaaatttagggttaagaaaactattctaggccaaacacagtggctcacacatgtaatcccagcacactgtgagagggatgggtgatgtgggaagatcacttgagcctaggcatttaagaccagcctgggcaacctagggagatcccctctctacaagtaataaataattagctgggtgtggtggcgtgtgcctgcctgtagtccagcttctgggaggctgaggcaggagactcacttgagctcaggaggttgaggctgcagtgagccttgaccatgccactgcactctagcctggattacagattcagaccctgaaaaaaaagagaaaggaaggaaggaaggaaggaaggaagggagggagggagggagggagggagggagggagggagggaaggaaggaaggaaggaaggaaggaaggaaggaaggaaggaaggaaggaaggaaggaaggaaggaaaaactagtctataccaatatataaactatatagccattaagaattataagactttagaacatgttgatctctggaaatatgtttatgaaataatgttaattataaatatgtgttttgtacagatgtacattcaagcattttaatagatttataaatccttgtgtatcattttgtgttcaaacacagcgtatttctttttttaatcatacttaaacaatttattttttatttcaatagtttctgaggaacaggtggctttttgtgacatgaacaaattcttttgcagtaatttctgagattttggtgtacccatcaccagagcagtgtacactgtactcaatacgtagtattttacccctcaccccacttccccctggagcccccagactccactatatcattctgatgcctttgtgtcctcatagcttagctccagcttatgaatgagaacatatgtttggttttccactctgagttatttcacttagaataatcatctctaattccatccaggttgctgagaatgccattattttgttcctttttatggctgagtagtattctgtggtatatatatactatattttctttatccactcgttggttgatggacatttaggctggttccatattttttgcaattgtgaattgcgctggtataaacatgtgcaaacacagtctacttcagattatatttacatgtataaatctattgatgtatattaatgtacattgacaaataaatgtaaggtgatgttaacagaatttcatgtttattgaattctttggttttaaaacaaagcagcatttcacaaaaattattctattttattataagcactgcttacaaacaaatttgttcaaaacaaatttgggggtttggggaataggttaggtaaaatgtttttaccataggaattttcagagcctttaatttattaacatacattgtggatctctaaaatgaagagatttctcttattgtttatctcaaaatctactatttacatcacgacttacatttattttgtgtaaataaatctgcataaatcttatttgcacttgttactaatttatcgttttcaccaaactgtaacttctatcaggacaggtaaatatatctgtcttcttcaccactgttcctagagtgccagccagggcatatagaagtggctcaatatttttgaagtgaatgacttgctagagcagcatttaggcaaactagtgcctaaagtcacacattttgggaactaccactctaaagttatttaattgtataataacttcaaaggaaaaaaatgtgttaatgcccctaggccactagagatccatttaataattattgcttcgcttcagttgagtcacttactactttagggaacagaagagatttctcagagagcacctcatgacctggaaaagtcttgcaaaatcattttcatactctgcatctccagctgaaaaacaatgataaaattagttaccatggaagttaaaggaatcatgctttgcattaacaccaacagtcttctggaacacatttggtaacattagatttcccatcaaagatatttgtttattttaatagttcaagcatgaaaaagagatatcccttttggaagctgcaaattgttgactcactgattctcatttaggaaaagggatttcacattactttatctattttctcaatagtcaaagcccatgttaagagagcttttaaacatatttaaaatatatggcttacctacatgttttacatgataatttatggttatagaagttagaaagtgcaatttcttttaatatccccgtggggaagttatataattctatagttttttaaaatatatggaaaagcaatatactttccgttaactgctaagattcatgaattttctccacaagttctccagaggaactactagaaaaaactccacgaatctcattatttgacagttttgttgaagtgaaattattaaaattgatattagatttaatgacttgtttccagtaaccaaaatggaaagtattctaccagctgtcgatggttccacaccctgacacatcgttaaaaccttagcttctgcctaaactttaaaccttaataatatttggcggtaggggaggggttacatttcaagtcaaacaaaggatgtatttccaaagcagcatttacaaaggttaatctgtgtatggactacaaaggggaaagtgcagtgccccagtgatcgatctaagacccccctctcgttgttgttgttgttgggtttttttggtctggttaataaaccacctagagggataatttttaaacttaatttgttgaaatggtactttactaatgtatgaaaaaaatttccccaaatttgagaatttttggtaagttgattttatatttgggaataaagatctcttgcttcttctactgacaccttctacacaaaagataaaaggtacttttacttggtaatccgcagggagaaaatttacagaaacccagagccaaaggtgctctcaggggatcccctgaaacattcaaagccattgcggccccagaaggtaaatggctttcgcaggaacacaggtctcctgactcacggcctaaccttcctttcccccacaccaaagctcgcgcggcaccagctagagtgaaggtcaaagtcaacagaataatctctgcagtccagggtctgtgagggtcctcctatccgagggagttttcatgaaagggcatttccgaacattttattccaaggacacagtctagtcaaaagacgtttgggatagggtaaacatgaggcaaaagaacacttacaaaagaaaaaagcgcagtttcttggaggcttgtcagaagctaagactggggagatgagaaccagggcccttggcgagagttggggtgggaatcgcgtaagaaaagcaatttctagagcggaaaggtgaccccacattacaaaaagaaatggagtagaaaaataggcttgactattctaaagctgcttcagaaagaatctccggaagaccacggaggaaccccgcaggggagccaggcggatactcagccgctcgcggtagaagggcgcgcaaagctgcggagccgcgtgtgtggagctccccagtgcactcactgctggctccccctcggtgctctgggcccttcccagctccctccacacagcccggctcccttcacacacccccgccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagtatttgatggaggccttctaatacttttctgagttatttcttttcagaagcatccagaaagcaatacatgtgatagttatggaggggttttgtttgtttttactaaaatagtcatttagaaaaacctccatttacatttattttattacattatttcattttactagcattcattaagcatctttaaatcagaacacacacaatattcaagctattctgtaaactccccgtagcagaaattttgtcttatttactactaaatccccagtatctagtataatgtgatctatgatggatactaaagagatattataataaataattacccatttttacagaaaattatgttttttatcatcccgcatccatgcagccatgcctacatcctcttgcctcttcctcatgccttgcctcctggccagtggcctagcgctaccctgttgtcctaaagagtttctgctgctgctgccactaccaccaccaccacactgctatatgttgaggagtcctgtacactgtgccactgacaaggagtaactgacctttgtgcctgtgcaccagatctgtctgtggaggttctggcttccccagctgctgcctggaaatgcttaggtgctaatatcctgagaggaggattgtcaggtaaaatacaggactctcagttaaatttgaattgcagacaaacaataaattactttttattataagcatgggctttttaaaatttttctaaatctggcaaccctacttaaggagtgaactttgatcaaggaggtacagcacaaaatgaagctagtagataaattctcccttcctttcccccagataggctgttctaaagtgcaataattcataagaccttcatgaaaatatcctcaaagaccgagcaattaactgcacttgttgcaaagctatgacaagctcactaacacctgtgtttgtgttcccttctcctactgcctcacttccatgtttttcctcacttctgtttctcagagatagtactccccatagagtggcagcaggtgagtgttggtgttgtttgtttatggcaggcttggggaacctagactagtacagtacttttggtagtggattcttctaatgggaagtgaaacaagagacaaatgatgactttgagaaagtcaggcacgggaccctgcagactcaaaatccagatttgttgagacccctgagagtagaaaaacccctcaggggcagattcacattgatcaaatgtacagtcatacactgttaaatcaaaatagtaactcagcactactgtgtgaaatatcagtgtcctgtaggcgagaataccatttgtgccttgattaaacatactttattcttgaatctgctgtttataagaattgaagttataattcaaaagatactgggatctgttatgggctgaactgtgtttcctcaaaattgatacattgaaatcctaactcccacactacctcagaatgtatttggagataggatctttaaagaggtaaagtgaggtcatacagttgggccctaatccagtatgactggtgtcctcataagaagaggagattaggaatcaggcatgcacagagggaagaccacgtgaagtaaaagggagaagacggcatgccaaggagagatgcctcgagatgaaaccaatcctgccaacaccttagtcttcaacttctagcctccagaactgtaacaaaataaatttctgttgttaaagccacccagtctgtggtatttgttacagcagtcttcaaaaactaatacaaggttcatagaatcaaaacaagtcaatttagatatagaactcaaataattaatgtcattggaacaaacctgtctgattaatcttgctccacaacaaagacagttctatcctggggttattgcactataactacccaccatttaaacacaataaatagttgttctaaaatctcgggaacatttttttttcatataattattcccatgtcatggaactgaagctttgggtaaaagcgctttataaattcttcttttaattttttttactttcaatttgtttacttttccactaaacacgagtagttcctgcagcttcctacttaaaaatcacttgcagtttgggttattgttagtatacctttcattagaatggttgtcttcaggggtgactattcttttactttcgttttctgttccacgtgcttattcttcccaaatgtacattaatgattctgttggaaagaggtaattacttttgttttgtttttaggctttgtttctgtgctgtcaacctgaaaaagttttttaaaacagtgaagtataggctgggagcggtggctcacgcctgtgatcctagcactttgggaggccaaagtgggcagatcgtttgaacccaggagttcaagaccaacctgggcaatatggtgaaaccccatctctacaaaaaacaacaaaaattagccagacacggtggcacacacttgtagttccagctgctcgtgaggctaaggtgggaggtgggaggatcacctgagcccagggaggtcagggctgcagtgagcagagatcacgccactgcaccccagcctgggtgacagagtgagaccctgtctcaaaaaaaaaaaaaattaagtataataaattctggttttgtatgcatttcttctcttacagaatttccctaaagctaacctactaaaaactatgactagatttcatatgtgctataaacattctttatttaaaataaattactctaattcagaaaggaataacatttgcttgcacatttagaacatctggcattagagactataaaattcatatatagtctcaaatacttattagacatattcttaattcaagaatatataattattcatatgattagaaataattataattttactaaacattgctaattaggcagagtacaaacaagaaaaagtcagaaggaaaatagaaccacaatttgcaatatatttattttaaaacatttttagctttctttgttacttttaaaagtaaaacttgtaagtcaatatattattaaaactactagttaatctttaagtctacaggtgctactaagaaattgcaatttgtaacttaacagagatattaaattctgtagaattgttaccacattcaagcatttctattctgtaggtataactcatttcccatgtttctctgctatttatctttttgctgaaataatttactccttcagtagtcatttcaccctttcacccttctgtgtttttgtgtcataacagaagaatcactaaataatgattaaaattaagtcaacataccaaatataaagttaaagcttttatgaagcttaatctttgtgcacttaccaagaagaaaagtaaacccactattatttgggaacaaaggacttggaaaatccacgaatggaataattagtgaaaaccagttttatggatgctgttaaaactactccaaagcaataataatgacaacacacataaacatacacacacacacacacacactcacacacatgagcagtgcttctcaaattttgatgtgaggctgaggatcttgagagatcagaatctcagaatggagattctgagtcagtaggtccaccaggcggcaagagagtctccattcctaacagagtccctagtaatgccagtgcaagtagcccaaggaccccattttgagtagcaaggacctggagtatttaccttactttggataacttacaaaatgctttaatttggcttcaaatcaaaataaaaagtaatttataatccttgaaatcttttaatgaacattttttgagtgactagtatgatatggaccaggaagtcccaaagtatgttctccagaccaatagcatcaacattgtttgggaactggttaaaagcacatatccttgggcctcacccagacttactgaagcagagactctgcaggtagggcttgagattctgttttaactatttctccagacgattctgatacacattaggttttgaaaactactgctctagacagtatgctgagggtctggggtgcatatcaaagtgactctcaagaatctcagtacagtaggaaggggtccaattgctgaaccagttgataccattaagtatgtgatgagtacaaaaacggaatgacagacaaggttgcacccaacacagcaaaggatgtaaaggtttcctagaaaatgtcatgttaactgaatttcatagggattagccatctgaagacggtggcatgtacaacataatgcaaatgttatgcgggaggaaacctgctggcacctttcgaaaactgcagtaattcacccaagatggctggctgtggggtgtttgaagactcctctacccttgtccttctcacctgtccatgagtaaaacaaataccgttagagctagaaaaaaaaaattacaaagctgagtctattaacttgccaagcaagagaacttactccatgaagaatttcactgaggagggaaagtcaggggtttttaaatgttagaagtggggagcttatggggcttatgctaattaagcattggaaactggcactctggatatggggcagaatgaatatataggtctctacaccattggttaaataaaataaatatcccattgttcactagtcaggaaagtctcttcagttaggtccagtgaggaaggtgcctgtctaaggttactgaggcttaaagacccttatcagcttcagcctgtgctgttaaaatacaagagtcagttgatgtctcctaggcaagctctactttaagtggaaatttttcctttcccctccctcctcttcatctttcctgatcctgagatgctaggatgaccacacaaaggatatgcaaataatccaattgtcagctctctgccaccatcttggtttggggtgccattccacaggattccattgtattcatccaagtagtttcagtctcctttcgatgtggtttacttggactgtgtaacagcaatttaagtcatatgaataaaacacttaacatgctttgcactttccctaggtggaagcaaccttagacctactaaactgccctctagatgtaataaggcctaagaatggttctaaagatatctatcagtagctaggcagcagagtggtgcagcagaagcatgctgggcccataaagataccaatgagtagctgtagagatgaaagaaaaacaaaaagaatgtggaagcctaggcaagggggttgtaaaaagaggagaggggtcaacagtgtaaaatactacagactagtataacaggatgagaactgaaaaatgttaatagactttgaccccaagtgttggtgatctcacagtttcagagggctgaggatgagaaaagcggaagaatgactagaagtgtggaaacaggtgctagaaatgctcactactctcaacaaaacttggtctcttcggctaggatttacaatcaaatgctgccagtcctaatctagtgttaccatttttcttttagggccagaaatattcaacgtctgaggcagaaggaaccttcaaaatcacttatcaacctcattctagaaatgaggagagaagctctgagaagtgaagtaatatttattttcattgaatttatatgtaattttaaattcataaattctatggaagatacaaaaatgcacgtttaaatcttgaataatttttgaaagtttaaaaaacagattaaaagagttagagttttttaaattttcagttatggtgtttgagttattaaattatactgatgatcatcatgagaagctttccattatagtcttgacccttcttgtattattattcagtctacaatggataggcaacaacatgtcaactgaaaaatcataagatctataaatttagaaaggagactttgtttcttataatgagttacaacctgcaggctggccattctgcaggctgggaagcccaggctcccacagagacagtcaacaggcactttgaaggaggtggggttggagcagaagctttatgctgaatgagttggctaaacagacatattcaacagattgtaagaagagctgtgaatcttcactaagaggggtgctgaataaacatgcatgtgacatgcatcccatgctcactgtggagtggaaacttaacatttaaatgcattacagtccctatacatcaaaaggagaagcagagacatgaatgtactagtgctcagtctctgtaaacctgccagaaccagtccatagtgggtggtcttttatcaggggaaagttactgaatcggtcccttgtccaatcaaacctgcagttatgacttgtggaacaggagggtcttgttagtcaacatctggccatggatgagctgcaattatttcaatattgcttatgtcgagggcagttcttatttaacagctagagaaaaataaaaacattgcagcagttaaaacaaaggttattctttaagtgtaggtgtgagtgacttaactcttgcctggcatggccttaggtcttgcttataatttgttattgccacagagtccattctgttagccttctgatctccattttaacattaatgctggtcagttgttgagtctaagccctcaaagggagggggagccgagcttggtggcatgtgcacctgtactcccagctattcccgaggctgaagcgggaggatcgtttgagccagaggttggaggttgcagagctacgatcctgccactgcactccagcctgggggacacagtgagaccctgtctcaaaaaaccaggggtgagggggacgtgaaaagggaggaggtaggggggtatagcgaggcgtgtccgtccttccgtcccgtcagggcgaggaattcagcttttaaggtttatcgggggtcctcttggccaaaagggggtccgttcagtcggttgtggggcttaggatttaatttttagttctcaaacagtaataaagataatgataatcttgaccatacgggatgctgtgccaagcaccacttaacaaacactgtcatctcattcaatcctcacaacagtcctattttacagatgagaaaagtgagacttcaagggataactcgctctagattcaataaactgactcaaaagccttttaacattctgtacaataccttttatgtttgtttatttaactgtccagttgggccactaaagtacagataaaagctggggaatgtaagcgagactggtcacttccctggggtgagagaaacgctttcaacactatccgtccatcgtatcacgcctaacgtatcccatagacatccctcacccctccacccactcatgcctgtttgaagcaagactatgaagaccgaaacacaccgggagcctaaggcaccactccccgctacctaccgaggtgcatcctgcaggctccttaccgcaagcctgcaaactcgccctgccgggcgcggagtgcaattaggctttggggtggtttggctctccggctttccgtagcctctggccccgccccctagcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggtatgagcaggtgtctgtgctttcagaggtggagggggtgggagtgaagtctcgagacggggtccagacctgggggtggcaagggtggaactggggacaggagtgaagatgggggaagccgcgggatggagattccaagcgcagagctaatcctgatcccccaccccctgcgaactgcaccggttgcgaggggctggctgttgtcaaccatcctgtctggggaccagcgctgtgtggtcctcctggagggtcctagcaaactgagtaggcggggttttgccgcgcttcttcgaaaagtggtcatagagctacagggaggaaaggaatcattcttagcaaaatcttgatttgatgacctgatcagtttgaactgaactttttaatacgtagatccctgttaccgagtgatgttcttgatatagatgtaaattttcccatgcttaaatttgctgcgactaaagcctgcacccagaggggaggaaaacgctgttaaattagaaattaagcatttttaaaatatgaaattggaagctggttgttacacgttgggtcggagagaaccgggagagaatagagttgatttgttttattatgcttgtactgtatttggttttgggtttgcttttgttatgaatacaaaattcactcttggaagttgatctgttgagaaattccatttgaggcccttggatctctattcgaggcggaggtgtttagaaaccccaagttgtttgtttcctactaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtggtcagttgactggggaatagagttgagctctctgaggtctgacatttacgcagtaacctgcggagcaacagcattttgcatgaggagaaataggtgttaggggaatttgcctaatcgattttgtggacctattcccctctgggcggggagaattttgaggaacaatagctctccactccctgggctgcaagaaagatcaacaatacagccatactcccaggcaaggggcaaaactgaaaagtatgtgaatttgataactgatggctctcagtcttcctttacttgctccaagaaaaattgggcaacgttatacaaggcaagcaagcgtggatttttttttttttttagggaaaaatactttttaaaagccattgccaaaatagtccaaaacataccaaatgaaacaagtatacctgtgtatatgtgtgtgcattttctccccattttaattttctttcttttctttcattactactgctctttccagggcctaggattctcttccaagaagaaagcaatcaatttgcattaattcatgtttctgacttgttaattactaattctaagagtagtaacattttcgaagtactgaggaaaaaggtagtttctccccaaagaaatagaataggaactttttatagctgggagaaatcttagtgatcctcagccttcttgttttttgcctgtggttgtttttacaaatgagaaccctaagttcatgagaagttaactgagttactcagtttctttactcatagaatgggggtctagagaccctggaacgaaaaaatgataaccttttaggcctctgccttaggccagtttaggaaagatcctgggaactgtttccagttctttcaaaccactgcacatttgcaaacttctcttctgcctgtgtgtgcttctgagacagtatatcctagtggctaaaggtgagagtatcacaactacttcagttcattgtcagcttcatcacttaccagctatgtgaccaaagaccagtatcttaacctttctatcaaatggagataatgacagtactcatgtccattgtaaagattaaattaaataatatatataggccgggtgtggtggttcacacctgtaatcccagcactttgagaggctggggagggcagatcacgagttcaggagatcaagaccatcctggccaacatggtgaaaccccgtctctactaaaaatacaaaaattaggtgggcatggtgatgcacgcctgtagtccagctacttgggaggctgaggcaggagaatcacttgaacatgggaggcagaggttgaagtgagccaagattgtgccactgcactccagcctggcgacagagtgagcctccgtctcaaaaaaacaaaacaaaacaaaacaaaaagaaataatatataagcaaacttatacaataatatagagaacttatagagagacctatatatataattgaaaacaagcagttatcaacatcatcattgtcattgtcatcatcctttatccagggaactagagctcataaagttatttgggccttaaagctaagggattctctagaattctgattgttcccactggcttccaggatgtgagagtgagactggatgcccctgaaatcttacttgctttaatgcagatttcggtctgctcactttatcccttcagagatgtttctaagttgcagctggatttcctaatatagaaatgctactttggctacctgggcttttgatagctgttttatatcattttctttattacagacctaaattgaacctttcagttaccctaaccttagtttttagtaattaaagaaataggcttgaatattgctgcctaaggcagcaggtaaaatgtacgggttattttgctgatttttctgtgtgtatgctttacttctgcattaagtggtatttttttcctgcatctttcacaaaaataactttgtaaaaggcaatagcgcctataaattctatctaagctactacaaatgatattcacagagtattagatttttctaactttaataactttgaaatgttctctgatagaattatggaaaatgtaaatatagattatgagtaaagttattagtaaatagggaaaacaatagtttaggaatctgggattttgaattgttattttcattccatgttgtgaacttctcatagacatattctatgtaaacattatatcttcaaattttctctctataaaaattttgataatccctactgtagtgattccagcgtcttcttttttaaagtgattatcatacttttccagtttcgaaacaataaaatagtaccagaattttggtggccattttctaattgtgaggaacttaggacatgttgcttgccctttctgtgtctgtttcctcatctgtaaaagatatttttagaaatgcctacctcatcgaattattgtgagaattaaagtatttgtaaggcatttagcacagtgcccagcacatacattccaagtgccccataaatggtaactttctgctattattaatgactctagtcataacagctttattaaattattaaataaattcagatgatatttacagggttatatggtttggctttgtgtccccacccaaatctcatctcgaattgtaatccccaggtgttgagggagggacctggtgggaggtgattggatcatgggggtgatttcccccatgctgttctcatgatagtgagttctcacgagatctgatggttttataagaggttcttcctctttgctctctctctctctgtctttcctgccacctgtgaaggaggtctttgcttcccctttgccttccgccatgactgtttttcttgaggcctctctagccaggtggaactgtgagtcaattaaacctctttcctttataaattacccagtcttgggtgtgtcttcatagcagtgtgaaaacagactaatacactgggtatcaaaacctaccaaataggaagatagttctcagattgtttttctagtattaatcccagtgtttatgtggctctggcttcctacaggaaggtagaggtaatgtagtttaaagggtgctttatcccctggagagtgatgggattggcagtgaaattcaccttaatcatatgttgaaatcacaagatatctaatttatctattttctatttagttttgttcccctcattctaaagtatcccaaccccctttagagcagtgcttctcaaattttaatgtgcatatggagcacatggggatcttattaaaatgtggattctgattctgtaggtcttagatgaaccccagcactccgcttttctaacaggtttccaggtgatgcttgtgctgctagttggaggacctcatttcccactttgaataacaattaatataatgattagttgactggcgtaggtatcatgcctgaacttccttgctcaaatttgctctccctctgagaacccatgagaacttccacaatcttttagttgatatcatatcctgtcactgtcagtaatacttccatgaactgtgtgcttaaaattgtctagccttgtttatagggtttttgcaagaaataacctctgtagttggctgcatgtgtctatagtgccagctacttgagaggctgaagcaggaggatcgcttgagcctaggaattcaaagctagcctgggcaacatagggagacccccactctttaaagagaggagagagagagagagagagagagagagagagagagagagagagagagactccttggttgtccattgaggagtcaggcagagaactaaggaacaaagaaccagagtttctacattagacagacctgctggcccatttattattaatagctacgtggctttaacaagttaggtcccagggcctcagtttcattaagagggataatagtgctacctttacttggtagatttgaagactaattgagatcaaaaatgccagacacatgaaaggaccactataagtgttagtctctttccctgtaactgagtatcaaatgagcaggtttctccctctgaaatgtccctgggtaaagtgggaaataagttcatcctataatttgaatgaagtaagtctgattgtcttcaaagcaatttattaaacttttgatcttaaaaggttttgtgaatgcttttacaatttctccataaacatcttaagatgatagtattttggtatttacatatgtatgttctgttttgtttctattctctgcttgtgtgatctcatttacccaaaatcttcaattgtcacgttaagcctatgattcagaaacctctgccccaaatttttctcatctccaacccccaacacaaacctcttcctccagcattccctgtctcaggaaatggtgaaatcatttatgtaattcctcaagccagggaattgtcttcagctttttccttctttctcccactgcgtccagtaactcattaggtcttgatgaatctacctcttgatgtttttaattccatttgctgttgtctataccagttgctgctacctattcaaggcccaaagttacaatctacctccaacccagtcttctcccagtctacctccaaatcagtctcacacagcatacaagatgatcttttcataattaaattcttctggttaaatcttgtggaaataaatgaaggctaccacaataaacagagactgtttattcagcggttgctatagggagggattcagccactatcactttttggcagagactccaatgcagcctgggaagctttatagtggtaaaaagaaaggtgtgggggaggcttcaggtctactctaattgtaggttgctgacatgggaaagctagaggtggactagctggaagtagggtatcctctgtgattgacttggaaagcatatttggctttctctggttggtcttaagttggaagcagagggacaaaaaccgggaaagctggcagtcattggccaaatcctgacttttctgagccaattgcagcagaggttgttggccagagttattttgtcacatatagtctgaccagttttgtttatatgttcagtctcaaaccattcaatggctttttaagatccttgtgttacatacaaagccttctataaaatcccatgccagaccaatagctgcatgaggtgaggacattgttattccccacacctagcacaattcctgaaacaaaaaaaacctactaataaatagttatagaaggaggaaaagtctagggaaggtagagggagagagagaaatctttaaaaatctgccaagcaggtaaaactagagtaacatgaaatggataatgcaagataaatctaagaggaatctatgctttaatctttactactctctgttcttttaaaaattatacctgctcatttggagaaaaaatctgaaaatacacacaaatattagaaagaaaatcctgcaattggggtggcccaagtgcagtgctctttacagctaattgattacagctagttacggatttcttccttttccattcccactgcttcccttgattagccttaaaaaaaaaaatcctgcattgacatttcattccaatatccttgtctaaccttctaaacaaatatttcagaaaaccagaaaagaaaaacccactgtgtgtgtgtgtgtgtgtgtgtgtgtgtgtgtgtgcatgcgcgtataaaatctgagagtgtaggaggaaaagagaaaagacagctgaggtagtggtggatatcactgccaaatccccaaatcttaaaaggcagaagtctatttaccaaaattttttgtaacagtaaatttaactatttaacagtaatatttaacaatttttaatggtaacataagaccaggtatagattagtatttagtaaatcctttttaaaattattttaaaaagtaaaaatggctgggcatgttggctcatgcctgtaatttcaaaactttgggaggctgagactggcagattgcttgagcccaggcattccagaacagcctgggcaacatggcgacactctatctctacaaaaactacaaaaattagcaaagtatggggtggtgtgcctctgtagtcccagctgctcaggaggctgaggtggaaagattacctgagcctagggaggttgaggtaagcagtgagccgtgattgcaccactgcactccagcctgagcaacagagtaagactctatgtcaaaaataaataaaaataaatataattttgagtaaatgagctcattcagatacttactccacagacttaaagttagcatgtttcattacaaattgtttttgatgccatgacatctcagttaggattaatttctaaaaattgtttttgaaagaaatttcttgagatcagaatatatgaatttgtaatttttaaaggcaaggaaatactaaaactaagacaatgaataatgattatgtagaagtatggaaaagtatgtattgcagatttaaaactcagaagctgccatggtattaactaacactaagtgaaattgtgtaaaatacttatgcatgtaaggaaaaacaaaatatataaaaataaaaatagatgcatttactacatgataggaataagtaggattttttcgcttttgtttgtatcatcattacatcaccttttcaaacatttattttaaagtagaagtaagcgtgaaagcaggaaagaggatacaaaggaaactgggagagcttaactcctgtaatgggggtaagcactgtgacataaccctgaattaagataaaatgtcaggtagcaaggcattaacccccaagataaatatagtcaaaaccacacttagaatttgtagatccctgtatcatcataaatactttacctctgatcggattatttcatttttgttgttgttggggttgtttgttttgttttgttttgctatttgtatttgtttgtttgttttttgagacggagtctcactctgtcacccaggttggagtgcagtggtgtgatctcgaatcactgcaacctccacctcccgggttcaagcaattcttctgcctcagcctcccgagtagctgggattacaggtgcccgccatcacacctggctaatgttttgtatttttagtaaagacagagtttcatcatgtttgctaggctggtctcgaactcctaacctcagatgatccacccgcctcctcctctcaagcgctgggattataggcgtgagccatcacggccggccttgttttgctattgagttgtgttccttgtatattcttgttattaatcccttgtcagatggataggttgcaaatattttctcccattttttgggttgtctcttcactctgttaattgttttctttcctgtgggtacactttttagcttggtgtaatcccgtttgtctatttttgcttttgtggcctgcacttttgaggtcctacccaaaaaaacctgtgcccagactagtgtcctaaagtgtttccccaatgttttattccagtgacttcttagtttggggtcttatatttaagtctttaatccattttgatttgatttttttatttggtgagacataggagtctagtttcattcttctgcatatgtctgtccagttttcctgacaccatttattgaagagactgttctttccccactgtatgttcttggtacctttgtcaaaaatgatttggctgtgaatgcagggacttatttctgggttctctgttctgtttcattagcctatgtgtgtgtttttatgccagtaccatgctgtgttggttactatagttttgcagtatattttgaagtcaggtagtgtggtgcctccaggtcttttctttttgctcaggattgctttgggtgctcgcggtctactacttaaactttggatgatagtacccatttccttccccgtttacctatgaataactttattataatatagcctcttcttggttgcattttccaaatctttattaagcaactaacaatattatatgtcaggcccagtgttggatgccgggagtgcctgaaagcaaaaaaatttttgctcttgagagaactttggggcagggagtggtggggaacgaacatgtagaccctttcagaacaatgtgatgggaattttaatggatataaacttagggtgctatgagagcacggcatttttctagcctttttcatcctttgggaaggtaacacctgagcttcgtcttgaaggacctgtgggaattaaccaaggagaggaataggaatgtaacaacatgagtgacaacagaggagatgtgagaggcattaatggggagtcattgaatagtttagacgggtcatgttcagatttcagttttattgttctgatggtagaatagaggatggtgttgaagggtgcaagagtggagtcgacgagaacagcaggaaccccttgaaattaagtaagagctaaaaactgaataaatcagtaagatggaatggactcaagaaatatttaagatgtaaaatctgtagaacttggaggttcctgtttttttaatgtggatgactggaagaatgctggtactaactgagataaggggatacctagttgagaaaagcaatctcctacctatagtttagaagctactcttaccatgtatctgcataggcaaacttagtgtaatgtgtatacaagataattttatttctcaacttatggaagtactattattctaaatattttcttgggcccttcagggctgatgaaattttaaaacattaagattatacaaaatactagaattcaggaggggttttttactccaaaatctatttattcctgtgagttttcatctactgttcattctccccttactatcgtagtgtcataaaacattttttaagttaccaagggaaagtatcatataaattagtgtgttagatatgacttattgatatagaagatgatctagaatagtaagagttgtatgttttttaggatgttttcaagcctatggaccttaatcgtgtcatcaaactcctcgaagagactgataaagtgagtaagctttgagagaaaattactccgctgcattacttacaaactatttccctgaaaggtaacatatattccttcaaatgtaagtctcatttatctcgttttgttgaaaacattttaaatagtacatatcttatattcaaggactatttaaatttagtatgaatatatttaatgaagtggggagactggaggaagagaatagatttgcttttatgagatagacaaacccatggtggctgtaacagaaggaatcctaagagtacagaaaggatcatctagcctctgttaagtgcttgttacctagtaggattggaggacagaaatggtagaaaacagggtaccgtggtgtactaattatgaaatcaggatagatacacacaaacatgtacacatagataatttattttgagaacaatcatatataagatgtaatggaaattaagttattttagacacaagactcaaaattgggaaagcaggcattgagagaaaagacaacaaatgtatatgcacacatgctcatataccacctgatgttatcaagaatcgactgaatgcctaaaagccagcacacgctaggaacttatgtggtgatttccaaaaaggaatacgtattgttagtaagtagaaaatgagttgaccacaaatgcccatcaatgatagactggataaagaaaacgtggacatatacaccatggaatactatgcagccataaaaaaggatgagttcctgtcctttccagggacatggatgaagctggaaaccataattctcagcaaactaacacaggaacagaaatccaaacactgcatgttctcactgataagtgggaggtgaacaatgagaacacatggacacagggaggggaacgtcacataccagggcctgtcaggggatgggggactatgggaaggatagcattaggagaaatacctaatgtagatgatgggttgatgggtgcagcaaaccacatggcacgtgtatacctatgtaacaaaccttcacattctgcatgtgtatcccagaacttaaagtataaaaaaaaaaaaaaaatttttaagtaagtgggttgaccatagtatagcctatcaaaagaaaacaatgtcctatgaataggaggcacaaaaatttggtcactgttttaacattttttattctctgcttttttacatataaaggagaaaaagtgactattggaataatttatctttttctggctatcattgttgtgaaaagttattttttattgtgactatatctacatttccttaaaaaaccacaactgcatagagtgcctattagctgtttaataaggctacagagaaaaagtatagacaatatcacagcttttcaggaacatttaagattaaaaggacagacagaattcagtcatggaaacacatcactgtgtagaagttttacttgcttattttcatttttaattgacttaagatgtttggcttgcacagaacactgagcatattttagaagttaaaaatacaatctctacagtcagctttccaaatttgtcttctaacaccaccactttttagctgtgtattttggacacgttactttaaaatgtttcagcttgtgtttcctattctggaaaacagagatcatagtagtatcttcctaatagggtcattttggaaattaatgaagtgatatgtatatatggtacccatgtggtacatgacgtagaaaaaatattcaatgtactttagctgttgttaatattatttctggaaacaattactgcttttatattaacctggttttgattcccaatttcctaatcaaatttaaataatagtttatttttgatacataatgtctgtaaatgtttatggggtacttgtgatattttgttacatgcataaaatgtgtaatgatcaagtcagagtatttaggctatctaccacctctagcatttatcatttctatgtgttgggagcatttcaaatcccctcttctagctagtttgaaatatacaatacattgttgttgactttagtcaccctactttgctaacaaatattcactaacacagtcttcctatcttttgtaattatcattctagtctatatctccatgagaacaacttttttagcttccacacatgagtgaaaatgtgtgatatttgtctttctaaacatggcttatttcacttaatatcttctagttccatccatgctgctacaaatgacagaatttcattcttttttatggcttaataggattccattgtatatatagaccatattttctttatccattcatccattgatggacacttaagttgattctgtatctttgctattgtgagtagtgctgcaataaacatggaactgtaggtatctcattgatacactgatttcctttcctttggataaatacccagtagtgagattgctagatcatacagtcgttctgatagtttatttttaccttcactgtttcagaaaacattttataacgtttacattataatatagtaatttaagaattacttgataattttaaagtgtctacttttatgttgaagaattttttaaaatctcaacagatttaaaagcacaaaagaactaaaataggtgatctgttttaggatggcttggaagaaaaacaacttaaatttgtcaagaaactggtacagtgttatcagaatggacttgtatcctttacatatatatgtatgttcatttcatttattctgaaatgagaatttcttttagaaaatgtgttagttttccattgctgttgtaacaaattaccataaatttgatggcttaaaacaacataaagttattatcatacagttttggaggttagaagtccaaaatcagcctcagtggactaaagtcaagatgttgacagggctggtttctcctgaagactctagaaaggaatcatttccttgccttccccagcttctggaggcttcctacattccttgcctcatgccctcttccccccactggcatcactctcacctctgctgctgtcgtcacatcatcttctctgtctgaccctcccttcctccctctttcctttataaggatccctgtgattacggtgggcccacctggataatctagtataattttctcatctcaaaattcctaatcatatgtgaaaagtccctttgctatgtaacatagttacaggttccaggaattaggacatagatatcttggggaaggccattaatctgtctaccacagaaatactggagaggccattattctgtctaccacagaaaatatctaacattttatgttctttataagactgtattttctatcagataatgtaaataaaattgaagaaacaatataacacaagtaactgtggataatgtcagtttttgtcgattcagaaagacaatggatgtagttagagggccaagtcaaagtcattatttctattaatttacatgggcagttgtacctttgataagctctccacccttgtaaagtaatagaagctcatgaggttgttagcaagattagatgagatcatgtacatccaagtgcttgataatctgcaaaatattatataaatatattatccctactaaatatacgaccctgaccagaatacatgaaaaccagtgtgtcttaaaactatctgtacgtaaaagccaggtgtgatggcttacacctataatcccagcactttgggaggccaagacaggaggattgcttgaggctaggagttcaagaccagactggtcaacataccaagaccctgcctctacaaaaaaacaaatagccaggtgtggtggtgtgtgcccatattcctagctactgggaaggctaagacaggaggattgctgaaacccaggaattcaaggttacagtgatcaaagattttgacactatactccagtgtgaacaactgagtgagaccctgtctcaaaaacaaacaaacaaacactacctttggataagaaccagtttgttttgttttgttttggggtgtttgtttgtttgtttgtttgtttgtttttgacacagagtctccatccagccttagttgcccagactggagtatagcggggcagtcatagctcactgcaacttcaaactcctgggcttaagcgatcctctcacctcagcctcccaagtagctgggactacaggaatgcacccaccacacccagttaattctttatttttttgtggagtctcattatgttgtccaggttggtctcaaattcctcagctgaaacaatcctctcgcctcggcctcccaaagtgctgggattacaggtgtgagccaccacagctggccatttttttttaacatttacatatatatgctattgtaaaatacaataaaagtatcccacaaatattagattgttataaaagtttttatatgtccactctcactttatgtattcattttgtcacagactagtaaatatacttccagaactgacagtggtccatagaccacactttgaatagtattcatctaaatcaagcttgtccaaccctcaacctgtgggctgcatgctgcccaggatggcttggaatgcagcccaacacaaatttgtaaactccttacaacattatgatttttttgataattttttttagttcatcagctatcattagtgtttgagtattttatgtgtgacccaagacaattcttcttcttccagtgtgggccagggaatccaaaagactgaacaccctgaaaatgatcttgaacagttgtctgacttggtctaaagaagttatcaagcccgtgcattgtggctcatgcctgtaatctcagcaccctaggagtctgaggcaggaggatcatttgaggccaggagtttgaaaccagcctgggcaacatagcaagaccccatctctaaaaaaaaaaatagccatgtatggcgatgcacacctgtagttttatcttctccagaggctgaggctgaggtggaagggtcgtttgagcccagaaattcgaggctgcagtgagctatgtttgtgccactgtactccaacctgggtatgggtgactgagtgagatcctgtctctaaaaaaaagaaaaaaagaaaagttatcaagctctaatattagctcattccagttcaaaacctcttaagacttccattcaggaaaatgtttcttataatttaatctaaatcttttattatgttttagccttggttttatttggacctgttccatcttagggcttgtgtatatcaagccctatttactggtagctgaaaatgtctactagcagggatttcttttcctattttaacctgacatctcaacacctccattttttttttcttcatgttaaaccgttggtggcaattggctctatttctaaatccctctcataggctggctatagaagttgtaaaacttagcaaagttagagaagtatcttggtcacttctctaggaagttaacagagctttctatttccagtgtaccctgctctcccatcttttcctaaaaggtcctagaaaaaggctaggagtaataagattcaaccaagaagtgtaagtcacatctaccataatttcttagctgtaaaacaaaatcaatgaaatgtgtttatgtgccaataggatttttttttttttttgagacagaatctcactgtgtcactcaggctgcagtgcaatggcatgatctcagctcactgcaatctccgcctcccggcttcaagcgattctcctgcctcagcctcctgaatagctgggattacaggcaccaccacgcccagcgaattttgtatttttagtagagacggggttttaccatgttggtcaggctggtctcgaactcctgacctcgtgatccacctgcctcggactcccaaagtgctgggattacaggcgtgagccagcaggatttttaaatagataaaataaaagatgcttttatctgaatatctagaaagtccatattttgctttcatattagtttcagataaaatcctaaccaatttaagccttaaacacaggaaaatgcatctcagtttaatattaataaaatagtggagtaaagtaatgtttaggttgcttattctgagacagcatatgtttgtgtgggcaggggtagggggtgaagatgaagggtataattgagcctaatcagtaagttaatgttttcaatgtgctattactcattgccagtgggaagttattgatcaactgaatctgtgttgtagcagttggtaatccaattctaaagttgtgagaggaaaaaaattttgagtaggcatttactgaggcaaaaatgaaatggtttttttaaaaatatggttctaaatttccttttttagacttcaaaataagaataattaaaacagtatctaccacatttggcaaaatagttggaattctatagactttcttcacagaaatactataaagaatatgttaataaagatattaatctgaattttatttcttaactaaaaatattaaagccattaagggatttagcacagatatttaaaattctgaatctgtgttcaggaaaaataaaaaaccagcctcgttttatagaatctgcatatgatatcataaaactgtgtgggtaagttatctttctttaactttattttgtagtaacatggagtattttattatgtttcttatatcacaaacatactatgcattatagtgtagcagattgctacagaactcagaaaacttcagttcatcacttgattccagcagttggcatttcaggtaatcagtttgctgtggtctgagattgctagccacaagagattaaattctaagtatattgaaatgctttcttgtaattagttactctgaagtaaatgctaaatattagatgtaaccaaggaattatagtattttcagaaaatctttgagtgaacttatggatatgcttataatttcagtctagtttttttctctgtctttagaaaatttgagtctcaaagatatattaggttatatatgtcatgttttatttgatttttgaaatttgagtgaagaataaaaatcaccaattacatttgatatatattttaaaaatgtaagttagagataagaattgtaaaattaacatgtcttattctttctactgttggttctctaacaagttctgggaactgagtatatggtgcttccttggtgccacatagtggctaatctaggtatatattaaaatatccatttttagttgctaaatgtaatgtagtagggaggaataaaccttttggacaattttaccttctgaacctttctaccaatttaactttttagatagcaattatttattttaatatacaaataatatataaataatagaaaggtttagtagaattatgcatacatgataggttctaactctcacttttagatttactagcaatatttaatatgtaaccacttaaatttgtattttctgatatctgaataaaataaccaaaataatatattgaatgcctataccatgccttgctttttaatagacaggtacaatggaaaataaatggttgctctggtgttttcaaggaacaaattggaaattattattatattgacatacgattatataatgtaaaacttttaaatctcaaggctttgcaaatcctagaatgccaagtttataagaattgctttcaacatctatgctcctacagagctctgcacaaagttcattgtctatgaaaacttgtgactgaatgtttaattgtataatatgataaatcctttttagctgcagtcttcattttccctcatatttcataattattcacattgttaattttttctacttttctaatttcagcttatgtctagataacttctctatgcctcaccctcacttgtttctcttttcaagacatttttggaagataaaaacaataaaaatagaataataatgtcaagcctttccgttttggcctccaagtagtatggttttctcatggcattagaagtataatgctaattttttcataaactttttggttgaaaactcttctgatgctttatcttatagattgtgtcctttgctagaaaaggaaaaagtttgggaacaaaaagtactagttttagagtccttcactttagagatccaaaaagcagctggataacaaatataatacattatttgtttcaaatgacaaattctgacaaacactagaaatgaacttctgtggcatttataaaattgtcctttttgtagcttgctcttcagatatctttaaattcaaattggcctgtatattgctattgatacatcctcatgtgatagttctcaataccattttcaactacttctttaatttttcttgaaaaatatgaattggccaagcgcggtggctcatacctgttaatcccagcactttgggaggccgaggcaggcagatcacgaggtcaggagatggagaccatcctggataacacggtgaaaccccatctctattaaaaatgcaaaaaaaatagctgggcgtggtggcaggcacctgtagtcccagctactcgggaggctgaggcaggagaatggcgtgaacccagaaggcagagtttgcagtgagctgagatcgtgccactgcactccagcctgggcgacagagcaagactccatctcgaaaaaaaaaaaaaatatatatatatatatatatatatatatatatatatatatatatatgaattaaaagtcctgtctctataggatatattgtactttaaatagtacaggaggttcaaattttgaactcatgaaatgtcaagatagtttatatatttaaaaaataacttttatattttctttgaaatttagactgacccaggtttatgtgctggatcttttatgatttataaataagttactttaaaataactttggttatagaagttgtgaaatgcgattctaatataattaatatttgttaacttgaatgccttaatgtctgcaaaaccattctgttattttgtggatagttactaacccagctaataagcaaaaatgcactgatctctaagaatgaataaactatcgattttgcctagagttttgaaaatttcaggaaaagctcttaaccagtttttaagttactggtgagcttagatctatggtttgttccagattatccaatgtcgtactaactttgatataattatagctataatttattactattttgacctctaagagaaagagggttcctaagtttttttattcatgaagcgatgcaaaatggctttcttaacctatgccttttacatccatttcttaattcttataattaatataatattttctttttggtcagttcattagaaacattttttttctttttttctttttgatggaggctcgctcactctgtcgccaggctggagtgcagtggcgcaatctcagctcactgcaacctccgcctccaggattctagcgattctcctgcctcagcctcccgagtagctgggactacaggtgcacgccaccatgcccagtgaatttttgtatttttagaagagacggaatttcaccatgttggccaggatgatctcaacctcttgacctcgtgatccacccacctcggcctcccaaggcgctgggattacaggtgtgagccaccgcacccggccccagaaacatttttaatagttacaatactattaaactgtaatactgtgtattacaactggtagttaataattgtcaatccccagggctaaagaatagaatattattattaatttattctttagaaatgaactctcccccacttacaaatgatgcttcaattaaagactttattaaaaattactgttacaattcttcattcttattgaagcttgccatttttgaaaaagaaagtgtcggatgaaataacttatgctgaagatactgctaattcaattgcacttctgggtaagttaagatttccttaaggtatagggatgtaacatacgacaggtcctactgacaagggaatatctattttccccaagtttcactaagaggactccttctccatgtctaggatcttctcttgttagtgaattaatcacagtgtgcttggtgataattctggtattgtattctgttcaggttgtttcgtgataccaataaaagtccatcttctaagtacaaggacaggctgataatgtagtttgatgaattattatttagtttaatgaagtgtttgttaactatttttgtaaatcagaaagtgtacataccctttttaaataatcacaaaaacatttcaactttgaactctaatattgaattgctgcaatcatagaattattcattaaatgatctaaaattttaaatcaaatcataaaatagcatattaagaacttcagcataatgcacataaagatgcagatgcctatattttgtacacaaaaatatgaaaaatatcataaaagggtaggcacttatgtatgggttatcacttgattttctagagaaagaaaacaatttcctaggaaactagatcagggaaacactggctctttgagtcagctcctgggacatgatggcatgttcccaaaacaaatcctacattaaatctatacttactagtttaggtctttatttgtacaggaggaataaaagatacacaattgatccagtgcatttttaaaaatatttacggaataatgatgttcccagcattatactccatatagaaagatgttagagattcaactggaatgaagaaaaaaaggatttttatttttaacatagacactaacccttttatatctcagtaggttttatagtttttagttactttgggaaaactacctagggttcacctactctatatcctagagtaggtgaaggtgttgttgagattaggttaaacatgaagggggcaatttaaagaaaaacaccttaggaagcaggcaggttcagaaatatgggaatttttaattatgtgaatctctatcatcagcagaaatttacaatgagaagccaacccaaaagaggacatggtagtattaacagataaaaagtgtagtttttgttggtaacattattttttaaaatacccctgttgccattatttttaaatattgcttccaagagtgttgacagtcacttgtattataaatacatggctcactttttactgagtgtcaacttattctttgcttaatgactggtaccctgcctgcagaacatgttactatctcatatgacaacagtatgaactcttaactttaaatgagcttccttcgctgattactgactgcgagtactgctcttctgtttcttggtttttttaatggctggaaacattaatttaaactaaaataattgtatataagatgaaatgttgaacaaaaactcttcatgattttagttagaacttccagtttctactacgtactaataagttatattacattttcttccaaatgatacatagatatttctgactcagaggcaagattctggaaatggatgggggaagaagttggtactctgccctgggattatgaaacaggaagctatgataaattatctaaatttacaggaactaaaacagtggaaaagcagacgaaagaccctagaatttcccataagcctgcatatttggatagtcttgttggaaaagcttagttgttcttgttgcctaatatgttttaaaacctaagtagtgattttgcaactccaaaagaacagtccgaaaaataaataaaatttagagttagaataatcttaaaactgtcttttaagtgatatcttttgcagagattctcctgaagctagggtcaggctttcctttgtgcttcctccttctttccacttgccaccccacttgctgaccacctccagagatgagcgtcttgcaagggctaatgcaaaagaggaattcctaattattcttttactctcagagagtccaaccagttctagtttagttctaaggtcgatattactgactaccgctgtccttgggcattcagagaacctggatcatttccagagtcccacagatcattttcagatacccttggggatcatgtttataggacttcaacagagtagatgcaatccagtttgaaatacaggctgaagccaatttaattgtagtttagatatgactgaaaacgaaccttcctattcgccaaccccatgcagacagcttgaacataaaactattacccttgcatgtggggcagctgcttaaaaactcactctcttccagtctgccaacaaactgaagagcaaagttcacctggaacttctctaagcaaagaatgcattagtaaaggcaaaaaattactgaccctctagttagggagaaaaatgctaacccatatcttgtcaaaataataatagtatctaacacatgtagaacttacaacatgctagatgcttttctcagcccttttctcatattagctaatttaatcctcacaacaatcttaaatgtggtaactattgttatacctgcttaatagatgagaaaagtaaaacacaagtttacatgggtagtaaatggcatagccaggatttaaccttagacagtctggttctagcatttgtattaataatcatcattctttcttccctagaaaggagaggctgaattgattgaggggccaaatgtataaggatggattcagggtactgtttatatgtatgtatgtgtgtgagcatatgtataaaaatatgcatataaattgaacatgatccagtttgaatctctgagaatatttttaataatcatcatattattaacattttatgcctaaattctacaaataagcttatgacagtgttgttaaatagcacctgtttatctttctggcaggtgacttaatgaaaataccaagttctgaattgaggatacaaatttgtaagtgtattgttgatttttatcatgcagaaccaccaaagaagcatattccaggtgaagtttacaatggtctttcagtgataacttgtgtatgtagaaaacagaacattctcatatctctttgaatttgacagacacagtgggctcataaatgtaacacattaaaaagaaaacttttttgtagtcttgagctctttggtcatcttttgaaagttatatatgtatttttcagtttttgatttgcatatttttattctgatgctaaatatgaacaaatttgtaaagtgatgcccaatttagtttattaataattataaatgttactattatgttatttaataccattgataaaattattttttaaacactttataattatttataatatctgcccccactcagttaaatgttaagctaccaatgccagggccattctccatcctgtttgggaaaatagttctatgtgttatagctaagggaccttaatatatagtggtaaatgagccacactgaattggttgggaccaagacagtggcacgtgcactgtgaggatataatgttaagatgtacttcttaccttcatagtttctgtaatttctaatcaatctaggaagggagagaggatataaacaataatttcttaagttatatgattcttaatataggtggaaataagtgtctgtggtagttcaaaagaaagattatttaagactaaggaaaaatgggaaccagaagtcagttaaaaaaagacaatttaaaaaaaaaaaagaaattcagggaaaacagaaggaagtcaaaaagtaaaacaaaaaaatggaacagcacctaaactagagaaatgaataaggagattattaaatgtccagtttgaactgttgatgagatagatggggaaggagtgtcttggtagataaaagatattggatactaaaagcaacaggaccagaaatacaggtttggaatccacccaaatagagttgaaaattgaagccaccagaatggttgagtttgccaagagataaaacatataagcagcaaggcatcaagaatgacatggagagtgtccatattgaggtttggaaaaaatgattcaaagaaattggcagtgaagggaggctcaaagaggaggaagaaaacctaaagactgccatgtcttgtgtgccagtgaatcaaatatttgacaaaggaggagaaagttgtctcagtgtcaaacgctgcagttttctgtaatggaagagttaaaaggccaagttaatgtgacacttgaaaagttgtagttaaatctttgacagatctattgatataaagtggtcagggcagatgcaggattaaagaatcagaggattgtgagagtagaggcactggatttgagagtgagagagtagtggcagttcatgaatgcagacatatcttaagatcagatggtgaagaaaaagaaagaagatggagaacagctcagctagtgcaaagtcagagaaaggttatttgggttttgttgtttttaggataggaagaaatcacatttgtaggcagaggagctagaagctggtaagaaagaaatgggaaggtgaaattctcaaagaaagcacaagaggatggaattaagagcacaagcttagagttaaccttggcaaaatacagacgcccttcaaagaaagggaaaccagtggtgtaggacttaagaaaaaggagtattatggggcaaagacgtgaggttgatttggtcagtctctgaaaattaggagtcagtgctctcactatcacacagttggtttcaagtgatgggtatggccagacatccgggaccacggctgaaaagtcctcagtatggcagttgaaagagacatagccctggagacaggaattaagtccatgagctttaatggtgttatatccctctgttaaaatgtacctgcaatagaaaaagatacagtaagtataaagtacattttggtccatccatatgatagactattatgcacataaaaatcattattttagaaaacactttataggatggggaaaagcttacaataaaagttttagtgagtacagtagaatataaaattctgtatactagtatgttgttaaaattgtatgcatacattaaaaatatcacaagaaatatatgaaaatgttaatgttatctctagattatgaaaatataggcaatttttaccttcctcttcttactttttaaatgctttttataattcatgaggtgagtagctagagcatatcatagaaagctcatcacagcattggacagggccttgtccacagccagagatcatatttacaaagataagacaaactgacagatacctcagaactagggcaaagttaaagaatctagttggactcaaaaatcaaaaagtcagggtgttagataaatgagatcactaagaaaaaataaagcctcatctcagtaaatgaggaccctttggtgtttatttaatccctctagttgaatgtaattaggtatacctgcatcaaaaggagagatagtatttctcacaggtgctaagacagaaggaatttttataagacatgtcaccaagaatcaaacttccctaaaatactattaaattcactcacaattatcagagtagcattacatttttcacctcttattttattgctgacactacgtaattgttgtcccttgaaagtactgaagtaatgcattgaacctgaacagtgaaactgactagtgaaaacattcagtatttgtcattaaatcattttccattattgaaagtcatatctactgacaagaaatattgttcttttttagaatttaggatgtttccaaaattcatcgtcctattttaaatactacaccagggatcagcaaactctgggtcccaggtcaaactaggcctactgaaaacaaaattgtgttagaacacagccatgtccacttatatttgtactgtttattactgctttcttgctacaatgtgctatagagttgagtagttggcaagaaaccttataacctgcaaagcttaaaatactatctggccctttacagaaaaaatgtggcccatccctatgctgcgcaatttttaaattccatatacttttaaaaagtttttcttgctgttgcttaataataaattactcattcttttgtcttaatgatcattctgtgagataactgtatgtatttattaatgaattgttgttaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctggtttgtatattattaagtttaaacacttcattgtcaactacttttgtttatgtctaaaaatgtcaatattgtaaagcacaaataatttttaaaatttattttcagaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagactttagaagaactatttcatttatttatccagtgaatctattattgagtgcttactatctcccagatattgcagtaagcattagcaacaaaatgtgcgtaagccttcaagttgcttcttcacttattcaacaaataattgtctgctctatgccagcttcagtattaagccatagaaataccactgaaaacaatatagatattgtctctgctttcgtggaatttacattgtgctaggagggatggacaagtaaatagacaactaaaagagaacatactaaatgttatgaaacagattattgtaagatgctacatgttcttcagaagaagatcagtcagcacatttttgtttgcaagtgactaaaaacccaaatgaccaaagcaatatagaaaatttatggcttatttaactacaaagtcaaggataaaactggtttcatgtgcagctttattcagggatcagcagatactaggacttcgtccctcctctctctacattgtcttccatggtgctggcttcacacccaagcctatgtagtaagacctaagaagtctacgatcacatcatttcaacctcaaatcaagcagaagagaaaccttgctatcctgaaggctcagagaaaagtctttgaattgagtccagtttggccctgaatggtctaatattggtcaaatgcctgttccacagtgatttattagtgccaaaagaaaaaatgctctgactggcgaaaaggcagctgaaggcagcctcacaggagcaaaagtcaggaaggagtaaatgcctaaataaaaataagaatgctgttcttataaaaagggcaagtaggtcccaggaggcaaagcaacaaatatctactattaatacaagggaacctaactcagagttggagaattaataactgcttcctaatgaactcaagtctagtaactgaatgacaaacaggacttggtaacagaaaagttttgcatgcggagagcatcctagacagggaaaacaagtgaaaatataattagcaaaatcagaaaactaaaattcagtatgatgagagcagaaggaacaggctacaatggtgagagatgaggctaacaatgttatcagggaccataacatgaaaggtctaataagccttgttaaggaggtaggacttaatcctaagaacaaagaatagtctttaaatggttttacaaaggaaaatgacatgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgagaagtatccattatttcaaatcgttattcccctatgtataatatatcatccttttctctcactgttttcaagattttaactctatctttggttcctagcagtttcgaaatgatgtgctaaggtgagatctcctttgtatttgttctgcttaggtttcatagagcttcttggatatataaatttaagtctttgagaagatttggagaactcttggccattatttcttcaaatattttttcagccccattctctctccccacttcttcagaggctctgattacttttatgtttgactttttgatattgtcccacaggtttgtgaggctctgctcacttttttcaatcatttttctctctattcttcaggttggataatttgtattagtctatatatttaaattcactgacttttttatttctgtcatctccattctgctgttaatctcatccagtgcatttttacttcagatatatttttcagttttagaatttatttttattcctttttatagtgtctctcctgagagttcttatctttctattcattatgagcatctttactgtagattctggtatactcctctgaagaatttttaataactacatatttaacttagctgtactcatccctttttgaggtatggcagcccaaatcttaattcagttcttgcctgggatgcttgagtattctctgcacttgtgtggttcagctatcagccagatatttgggaagagtttgtacacagaatttagcattctctctctctggctctctcctttatgggatttctcccttcactttccaatggctgtggttgcctctgccctctggttcttcaggccactaagaccacagggttactctgagttttagcatttccacgaggtgtagaatacggcctgctctcaggccaaaagcctttttttttttttttttttttttttttttgagacggaatcttgctctgtcgcccaggccggagtgcagtggcgcgatctcagctcactgcaagctccgcctcccgggtttgcgccattctcctgcctcagtctcctgagtagctgggactacaggcacccgccaccacacccggctaattttttcgtatttttagtagagacagggtttcactgtgttagccaggatggtctcgatctcctgacctcaggatctgcccgccttggcctcccaaagtgctgggattacaggcgtgagccaccgcgcccggccccaaaagccttttttaaaatgggaaactcgtgtagtgccattcccttctacaaaattctgacatccttccagtgtctgcttactcttggtcacaagatagttttatttgtcaccagcaggagaatttctctcggagctactactcatctgtaccagaagctgagccttcacatattttataattaaaaatcattgaatgattgaaattatttaatagagatccttggcaacaatattcacaagtcagtcacgtaagttctagttgtgctacaaagaactggctgtgacgacctcagcccactaacagtggacgtcaagtagtcccaagagtcatggaattcatgctgtgcaaatagggaaacagtgctacatagtatcctagttaaagctgcaacttataggtagacctttgtttctctagaatcccctggtcaggtagtaatttctcattagtgtccttgcaaacattcagatgaatttcacgaatgtgagtcaaaggaaataatatcttcagcatctaaagaaaccatatagatcctaaagtaatggggctataaaactacaagctcataagcccagggtttgcccctgtaaactctccctaatgtgcaaaatccaactaggatatctctgtcaggaatgctgatatgctaaaatgtttgcaactctggtgattcttcagggcttttcatgctaagtaggaactactttattatctcttgaccaaacatttgacataacaagaatggttggggtagaagtggaagtgtttaagaagaaaagctgttgagaataactggattttcctcccttactgtgtcatttgaagtataggtaacgaattatagaagtaactataaagacctaatatactttggatccttaacaattttaaacagactattcatagaataatataaaatatttcttagaacctacagaagtaagtttaaaattaaataaatctggcttatttaattttaaataagcttatctggctatatgtttttattttttgcctcactctttattactattcatgctttatgaattcaaatgaatgacagtaggagaatttgataaatgtacttaagtagtaaatatgagcatctgcatcataactttcatcttattcattcatctttctgcttattttatgtatttatattaggaatgtggctttaccaaggatttgatactgtttgccacctttaatgaaggtaaaaagaataaaactttaaacttcttataattatcttgataagtcttgtacaacatttaagctttcattttactttttttccctcacagttaaaagtcaaaatcttttggtaaaaggacttaagctttctaattcctatgaagattttgagttgaagaaattactattcaacgtaattgtgatcttatgtaaagatttacctactgtacaggtaaagagtaatcaaggcaggaaaatcaataaaaattgtcttactttgtagtataactattttaaagtcttgactgtaaatattttatcggttcatatatttaccacagaaagcagtaaaatcttactggcctgaattttagcttttaaattttttctttgcttatctgttagtaaacagtgaagtacttaaatttaaaccacataaaccagagaaaaatagtagaacctaagagatttaataatacagttagatctcttgaattagacagcataaaatgaaagaagcttcacataggcccattccagcctaataatctgtctctgaccataacaaggactgatttaatgctggagaaaattattaacctctgtgatgccaatctcaaactcttatgaacctgctttttcatcacacaaacctaatgtctttaatcacttttactctctatgaatttatcttaatactttgtttcctgcataacagcgtgatataatttgaaaaatattggaactgaatttcacttctggcttatcacctactagctatgtggccttagaaaaattacctcgtctatctgtggttcatttcctcctcctgtaaaggaaagattataatgcttcagctctgctcacaggtctatcgtgaagttgctatgaaggctttttaaactataaagtgacagtaaatgtattattaacaattctgtttagttagttactgcattaagtgaaatttccatttaatctaaaactctaccaagctccaaggattactatgaaaaagaagtaggaattcagtctatcaacttcactaccaataatagaaagatggggtagtctagcagtaaaggctttagtcagacagaatctcagtgctaccgctttctagctatgtggcattaaatgggttgtttgatttctctaaatcccaggtagctcaacttcaacatggggataacacctacctcgagattattatgagcatttaactgagctgaacattttcttagtaatgcaactttaaggaatatatatattttcaaatgctcaggaaaagaaaagttgtctttataattataactttattatttgtgacaaaaaaatacatactgtgtagaacctaaatgtattttccaaaatgcaaatggaaaatcatttggaaaattattccataaagtatggtttattattccaatacagtattatataaatattaaaattagacctataaagataataaaatttatactacagtttataagtcaattctaattaattgaacaacactttataggcaacagagccaagtagcacagattatggtgaggagcttcttaaaacactttgtgagcggtgaaatcaacaatttttatgtgtcacataatttgtggtccagtaatattactagtaatgataatgaatatgtacactatcatttgcaatacacaggggtgttttttgaaacattatatacttaattctagcaagaatgttagaactagtagttattcctgttttctcaactctaaatcttgcattcttttcacatggactagtaaggaactagaaaaattaattgtttttgttaaaatctttatagaataatgccaaattaaaagaaaattaaatatagcatatggtgttttattctcttgtgaatcataaatatgtatccatcagaatcagctgtattaattctgttgtcataatagctatgcattttaatctcatttttattaaaatgatgggttcaataaaattttaaaatactaggcatgtaatgaaacatggcttgtgacctaactgacatttatttggtagaatgtttatgtaagtactgttgcatgtggttaaatattcactgtagtcattacctcagacaaaattcttttttatggtacacaactgagtctgtgagatatttccttttaaaaaaagagtgaggaaagagatgtcagcacttgccccaaaatattctatgttttattgtacgttaaagtaaaatacgttatacgttttattatacgttttattatacgttaaaatatcctatggttttattataagcaggaactacattacatatatgagcagcaaaaacaaaaaattaatacatattttatattattgtcagggagtacatacctcagaaaagaggattataacttatttaatttttggtgttttttttttggtacctatcatagattggggttattttataaaggaattattttgaaataatccccaataaaacatcaaaatgtaaatttttatttaattgccttaaagtatttttggctatgtttctaacaaagtatcctttgttctttctcacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaaggtgagtggcccttcaagattcttgtcaaaattctaatcttcatatttcaactgaatgctcagtatatgcatagaaataacaatgaagttaattaaagcaatgagaagtaaaaacacacagacctatcttcttaatgtatttatatgttgttttaagaaaaacacagattttaaagtcagacgtcagtaaatgtcatagttgatgcacacccgaaagaaatcatacatgtaatttgaatttttgtattattagacctatctaaaaattatatttgggaagaaaataaatgctggcaatattttatttgctttgtttgtttgttgagacagggtctcaccctgtcacccaggctatagtgcaatggcatgctcatggctcactacagcctcaacctcctgggctctagcgatcctcccaccccagccttcccagtagctgggactacaagttcatgccaccacacgaagctaatttttgtattttatatagacagggtttcgccatgttgccccggctggtctcaaactcctgggctcaagccatctgcctacttcggcctctcacagtgttgcgattacaggcgtgagcctgaaatgaattacaatattgcccagtctggcagtattataatgcattcattcaacaaatatttatgactgcctactgagtactagatactgtcttaactactgaaaatacagttaggcttaaaataaatatccttttctctatggagcttaaaatctagatctctagccagaagtaatgactccagtgtggtctaccaaattagtagagccccaatttatttgtattttgttttagttcttagaaaggaaataagaaatacattccttttttaaaaagttttataaggaagatattgcctcttttctggtagaaattttgctctggcaataattttgtatgatgcattttcattagatcaagaatatcacccatttatgcatgaaggaggaaaaaatgataggctttttattctctagtttctaatatgctgagctactaaatttagtcttgtaaaattattttccactgaataaagcaattcttcagcctatcctttatatcatttatgtttgtagaagactttaaggcaaaaggggaaatgctggctaataagagaaagactgatagctaatagttattcagaacctactatctggtgagctttaaacaccttccaagtattaagtcatttagtcctctcaacaaacctaggaggtataggtactcttattatccctttgtatcagatgggtagaactcagtctaagaagctaaataattattcctggccacaagtggcagagcaaaaatttaacccaggttctataatagaacccacaattttaaccaacatgcaatactcagaacagtattttcaactttttttttttttagctagaaacataaagctacttctaaaagcagcttttaaagaaagcatagcataaagaagggaggatttgccttgctatttatcaagacctacgataaagctatagtaattaaaattatgtggtactgggtcatggagagaccaatggcatggaatatatgaaaggttggctttatgagagatgatactgccaatcagtgagggaagggtggtgttggggcagttggtcctccatgtgaaaaaataaaaattagacctcttcactttgttttttctaaaaatcaattgcaaaagtaataaattaaagatgtaaatatgaaaagtcatacagtgaaactcttagaagaaaacatgggaaaatatctttttgctagatatcagtgtaggaaaggtttctttaaaaagactcatgagttaaaggtataagaaaagatcgatgcatttaactactgtaaaacgtacaaatgtctatttgacaaaatctaagtgaaatactaatttacaaagtgagagatgacatttattacccctgtgactgataatagattagaatccaggttcataaagaactcctatatatcaataagaaaacaactcagtagagaagtatacaaggactagggactgccatgtcacagagaaaaccccaaattttcaaaaaacattgaaaaactctaaatcctgttggcaatcagataaatgcaaattaacagcaataaactaccatttcacatttaacagatttcgtgggggaaaatcaaggccaggtgcagtagctcacacctgtaatcccaacactttcaaggcaggaggatcacttgaggccagaagttcaagaccagcctgggcaacatggtgagaccccatctcttaaaaaaaaaaagcagctggtcatagtggcacacacctgtagtcctagcttcttgggaggctgagatgggagtattgcttgagcccaggagattgagacttcaatgagctgtgatcataccactgcactctagcctgggcaacagagcaagaccctgtctcttaaaaaagaaaaattaactcatcttatacattgtatctgtataaacaccttggaaaacaatttagcacctttagtaaaattcaatgtggatgtatcctgtattattctggtcacatggaaaaactcttctcaatggatataagaggacatgaaccagaatgtttattgtaacagtttatagtagtgaatggataaactataatttatttataaaaatgaatgctgaaacgaattaaaattaataatctagatctacttgtgacaatgtgaataatttttaaaataaacatgttgaataacagaagcaaattacaaaagatacatataatatgatacatttgagtaaaattccaaaacacatacttctattctgagaatagtaagagggaaaagggataatattttatttctctaaaaaaaaactaaagcaaatatgacaaaattttaacatttgtttaaacttttgatagatgtataagatatctgatatatttgctttatttgaaatgtttttgttttaaattatcactttttctccacagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggtaaaatataacatggtggtttactgatgaaagaggaatatttttaatagtagtagttttgtttgaaatgtttttccaaaatttattttgtctttatgactgagaaattcctgaatattttcttgatttttgtttcatattgctgctataaattagtgtgtcttattgaaatatcatacttactaaccctttaagcatttatttcttcaactcaaatatcatttcatttaggattatctttatctttttttaaaatggtctattgttatgttttattcttttagtaataaaggtcaccacttttgaccaaggcttttggagctattttaaaacaggataacatggcatattccaatgcatgtgtcataacagaacactggtacattggtatttacagaaatgtacagaggagtttcttttctgatatgaaatatcagaatatccttgacttttagcttacacttgactatgctagaaaagaaaatggaaattatgtgtatcatagaaatactgcatgtgttaccctatacgtcatcaattagacacttaatgagtatctcataaaataagtacacataaactcagtgtaaaattcagaacccctaaacaaaagctgctttgccttttgttatttaaaaaataaatagttctctagatccttgactttgaaaagagctatttcagtcgttcgtattcagtgattgcttcactagtcaattatataatctgctagatgtcaattaattataaatgcctactcaaaaaatcttctacttgttaaattaaggtggttactcttccatcactagtggagtggagtggtgctctccaataataataataataatataggaaatagcaggaaatcaaagtatattgaaaaggagctaggtgaaaacatttacctttttgcccagtttgtttgggatgaacaaacctgaaagtacagtttatcattcctgtgcacattctgttgcacaaaactcagtctaactagaggaaatccaggaaacgtaatctttcatatgtctaggaagaattcttaatcctgcctgcactagggaatagggtagggaaaagggaaaacaaatagcaatggtttttttcttcttagaaccttttccctttaaccggaaagaagctgatctttatgttaagttcttagaggcagggaccttgtcttattgagtctaacatggctgtgtagtagtaacgtgctcaataagtagtaactagattttaaatgtaaatgtttatacacttcctgggtacagtgtacactgcttggtgacaggtgcaccaaaatctcagaaaccaccaataaagaacttatccatgtaaccaaaaaccacctattccccaaaaactattgaaataaaatataaatgtttatatacttcctgtgtagacactggggttacaaacatgtatagagcaggacaccaaggaccttttccttaatgagaaaatagaaactacatgtatcatagaaagatagcatgtgttagcctacacgtcatcaattagacacttaatgagtaggacagagtaaatgttacagaaactaagaggcttgggtagttttcaaggctaggaagtcttaggattctgtgaggtaaaggtagtttagaggtggaaaagaagagaaggccttcaagcaaggaaataccatgaacagagagacatggtcctgaaatatgcatggtgatgtgttcagaactagtttaagaggagccaaagttttatgaagataaataacacaagataggttaattgtatagtcagaggccaagatggaatgagttttgagtgattgacagtagttcgaacttcatcctcttaaggcatggagagcctcaaagggttttgattagtgaggttatatgtacaatgttatgttttaggaagaagaaactgggagaaatagaatgatctataacaaggagagaataaaggcaaggagttgaagggtacataaatatgagcattatactatgtgttacaggcagcagggaaagtttctgcctgcacccaggtaggaagaagaatgctatgatctagaaagaagaagcagaactatggccagtcaaactggattcccagaagatgttcctgataaagcgatataggcccctctgtccatggcataccccagcactgggcctccagcaggctcagctagcctctcttagggtctgatcccccacctgtaattcatcctaatgggacctagaatagtcagtcgctcagggccagttatggagataggctatgatttccatggcccttctactttggaacatagctccatactttcccactaatgccagttacccctttaaccgagaaaaagtcactttttttctttatttaaagcttaaaaaaatcctttttgaggcaaaagtgtatcatgaatatcatttcgtcagtgttagtggccatcttcagtccttttcaatttcaactggaagcaaaagagggattttaaaggacatggaatactgttacctaaaattgtttaaaacaccttcagttagacatcaaggaaagatgcagaaagcaataacaggaatagaaagcacacctaaagagatctgccacctttgcttagaattgaccctgttaaccatgaggagaggaagagattaggcaaaccacagtcaggaaatttggtcatatatttgcaaaggcactcatttcctacctcatgaaactctgcatatttttaaacccagtttgctgagcaaagtgtcaggttattggggcatcctttaatgacatactgttaattctgaactagaatttctatatatgtgaggctatggattacattcagaaattctatatatgtaggtagggctactgattgtattgaaagctccaggaattcatttatcatcttcttttcacagcctctaggttactatgcaatgaaaatatcctcttctaaaatagtttttctaggctgggcatggtcgtgcacgcctgtaatcccaacactttgcaaggccgaggcaggaggattacttgagctgaggaattcaagattagcctaggcaacataatgagaccctgtctctttataacaaataaaaataaataagtaaataaaataaaagtttctctagccaaataaactttttagaagagatttccaaacagtaattgatcaaaataaaagtagtgtccaataactatacagtctttaaatgttttcataccaggaatctttaaaaatataataagcaagcctaatgaaaaggaagaagccattgttttggaaatccagtctgatatattacttatcctatctggcctttgtgagaatcacattcaaaggaaggtatgtatgcctgtgaaagttttgttcaggtctcccagtcacctaacactataaactatttttggaagtctctataattgtatttaattttgtgaaaatttaatatttttgttaataattagagcataattatataaagtaaaaggtacagaatatacaacagtatacacccatttaactcatacccccaattaaaacagagaatatttctatctctataaaatttcctcatcccattagaagccatgcccctactcacttccagacaaactactgttctgttttctattcctataggttggttttccctattctttaagtttatatcaatggaatcgcacaatatttactcttttatgtctggattctgtcacccagcatcatattttagaaatatatccatgttggccgggcatggtggctcaggcctgtaatctcagcactttgggaggctgaggcaggtggattgcctgaggtcaggagtttgagaccagcctggccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctgaaaaaaaaaaaaaaaaaaagatagaaatatatccatgtcattgcatgtatcaataattcatttctttttattgctaaatagtattccattgtgtgactatgccaaaatgtgtttatctgttcccctattgatagataggcacttgggttgtttttatttacagctataatgaataaagcttcagtgaatattcttgtactagtctttactagtgggtataatgctttcatttctctcgggtaagtatctacaattggaattgatgtatcataaagtaggtgtatctttataagaaactgccaaacagttttccagagtgggctgtaccattttaaatgttgtttggggtttgaattgggttcaaacccaaagccaaaatttagaacgagatcttaatccccttttatcttttttagctccatagtgaactctgagtctcagagattgataatttaaatgttaaatagcaagggatggaattggaaagataaaaacaaaaaaatgatggtttcaatagatagattttaagtgaacgcctgtttagctccaagctttgatgcaatttctcatcatattctaccaccctgtgcctgggctcctctggaaaaataatcataatcttgcttactgggaaccagaactgaacagcaaggcaataagaaaggtaattagtaagagaaaaatattaagtggttaaaacttcacaaaaattattaaatgttttaactacatttatatcttatttctctcggggtcattagaaaatcttgcatgatagttcttactatctaagaattgatctgacataatgctagactgcattgattataatattgaagaaaatcaaggtacaaattttatgacttcttttaggagaaagggaataaaacaaaaaatatcaagggatattattaagctggcatgttgattgatgccccctcttaaaatgattaattttataataatttgttttaaattcctgagaacaagtaagtacggttttttaaattgcagtaaaaatagtatttttctaacaatgttgctgtatttctctggtaaaaaagcaatattaggggaccgataaagtaggaaagggaggaattatttatttatttcaagaaataatttaaaacaaatatcttaaacaggaaattttcggaactgaaggagtagatatcgttcttcatgtgatgaaaacagaccccaggaagttacagagtggcttaggctataatgtacttctttttagtacattggacagcatttggtgagtattgctataatcaaattaggtagactcacagcagtcatgcatcactttacaacagtgaggatactttctgagaaatgtttccttaggcaatttcatcttatgcaaacattataggatgtagttacacaaacatagatggtatagcctactacacacttaggctagatggtatagcctaaaggctacaaactgtatgtcatattactgtactgaagattgtaggcaattgtaacacaatagtaagtattgtgtatctaaacatacctaaacattaaaaaaggtacagtaagactacagaataaaagataaaaaaaaattcttaacgcttgtatagggcacttataaatggagcttgcagtaccagttgctgtgagtgagtcagtgagtgaatggggaatgaatgtgaaggctaggaccttattatacattactgtagactttatcaacactctacatttagattacactaaacttacttttaaaatatttttcttttctcaataaattaaccttagattactgtaattttttttttactttataaatgttttcattttctttatgtttttggctcttttgtaataacatttagcttaaaatacaaatacattgtatagccatacaaaaatattttctttctttatatttttattctataagtttcttctgtttttaaaaaaattacattgtttttacttgttaaacattttgttaaaaactgattcaaacacaaattagcctaggcttatgaaaaaatatttgtgtgcatatattttattaaacatcatagatatttctgtccagtatacacctagatgtaaaaatgcccagatctgggcatttttacgtctgttcagctttaggagataatactaaaaaattttccaaagtacttacatcaattacacctttcccagtagtgtggaggtttctcctttttccacacccttaccaacacactgcgttgtatctttcattgcagccatccttatggacttgtgccagtgtctctttgtagttttaattttcatattcctgattgctagtgagttcatttgccatttaaatagcctttttttgtgtgaaatccctactcaagtctcttgctcatttttctactgaattacctattgttttttagagttctttatatgtcctggatatgagcctttttctgttatatgtttgtcaaatatattctgccactctgaggcttacattttcactctcttcactctctttttgttgaacagatagtcttaatttcagtgtggtccaatttaccagtctttttttatggtcagtacttttagtgccctgtttaaacagtctttccttaccccatagtcatgaagatcactgcctatgtttcttctagaagctttattgttttgccctttacatttagacctacaatctacctggaattgatttgtatgtatggtgtaaggtgaggtacaagttttactttttttgtatggttgtaattcaatgctgtttttggataaaccatcctttacccactgctttgcagtaccttctttgtacaaatcaaatgtccgtatatatttggatctatttctaggctttctgtgctgttctactggtcttttgtctatccttctgtaatgtgctattttaataattaggtcttgataagtctagacatctggtagagtaagtctttctacgttttccttccccattaagattgtcttagcttttgctgaccccttgcatttggatattatattagtcaagattccctagagagacagaaccagtaagaaaaaaacatagagaaagagagattgagatttatcataaggaattggctcacacaattataaaggctgaaaagtcccaagaactaccgtcagcaagtggaatacccaggagtaccgatggtgtagttccagtctgagactgaaggcctaaggaccagaaaacccagtgttctgagtgccaatctgaaagctggatgcttgaagcccaagaagagcaaatatttccatttgagtctgaaaacctgagtcccagctcagcagtcaggcagaggagttccctcttactcagcctttgcattctgtttagatcttcagttgcttgcataaggcccacccacattagtaagggcaggctactttattcagtttactgattaaaatgttaattacatccagaaacaccttcacagacacacccagaataatgtttgcccaaatctctggccaccccaggggtaaaacctgggaccacctgaatgggaggagcaaagctgatggcatttcatataccagcctctaccctactcctactttctatgcactatgatgaaacaggcagtagaaacaatgtcttttgaaacaggcagtagaaacaatgtcttttcttttcttttcttttcttttcttttcttttcttttcttttcttttcttttcttttcttttcttttcttttcttttttaaggggagctatgtttagaaaggggacacaggaaagtgaccacagcaggcttgcaatttctgggaggaactgagaatagtatctgttgcaaccaccagtgatagcttgttcagtccacattccctatcaggaagaagagtgcaagtagccccggcagcagctttaaaccttgattccatgtgagctgcacaaaccaaagtaggcactttagcaaattcttataggaaagggttcctgatccagaccgaaagagagggttcttggatcacacacaggaaagaattcaggatgagtccaaaggataaagtgaaagcaagttaattaggaaagtaaaggataaaagaatggctactccataatcagagcagccctgagggctgctggtttcccatttgtatggttatttcttgatgatatgccaaacaaggagtggattatttatgcctcccctttatagaacatataagttaacttcctgatgttgccatggcatttgtaaactgtcgttgcactggtgggagtgtagcagtgaggacaagcagaggttatttgtgtcagcatattggttttgatgagttttacctggcttattcactgcaacctgttttatccccaaggtcttcatgacctgtatcttttgcgacctcctatctcatcctgtgacttagaatgccgtgaccatctgggaatgcagcacagtaggtctcagcttcattttacccaggccctattcaagatggagttgctctggttcaaatgcatctgacattttccccatcccttttataagagaagccttaatccttagggttgcagagggattaagatccgtcttctgtaacatcttcaggctgaagaggggtgatgatattcctgcctatctattagggtctcttgtgttcagggtacaggggagctcagtcagaaagcactggtatgttgagggtcattcataactcttgagttctgacagaaggtgatatctgaaagagtaacaattgaaaattaattattgattaatattgataaaattgaatagaatatcaattctggttttcacattacctagccctcttgtttcttctgagcagcagtcagagatcactggttggttcccaggaatgagcagcgttagcctaaattgcagaaacaaacttgaaaacagctgatgagactagaatctaacaacaggtgtaccatagttcttgaaacatatttctctctccagtttcccatttatcctaaagacaaattataataaggccaatttgctttattatacttggcctgattatttgtataaggtgcagcaagaataattatttgccatatgggctatttgaattggctttgatggaactctgttccataaggaatctcagataagacttttttaaagccaagcccagccatgggtttgtaccctcacatacctaagagtttggtaaatttctcttctcttgaggtcccaagataacttggggctcctgggcctgtcagaaagtgacattctttacttaccacaggccaggaaccctatacagagactgtgtagacaaagtatcaagttttcccaaaggacttttattggctttacacatcaagtctgattcctcaaagcacaccattccagtcaaagccttagtaaaataatcagtttctccaattgtgtcctgttgcaaaagaaaacagattcttattatacttcttgttgcaaatacctatattgccataaattaagaacactcacgaatagttgtcaaattctggagaaattgggtagaaaaaacaaatatgctccaaattttgttcacacgagcatactttacccaattgttaaaagctgtaaatagctccaaagatgagttgtcttgactctgggcggaaaaaaggatcagcaacattttaagcaacaagttaaaaaagatgattttagacttctgttagtttagtccacaaaattaatttctgtttgatattcatgaacatttcagctctctatgagagttctgaaaggttttttcctctattcagagatcacaatctccaaagttatcagaaacctgcatttaagaatacctgttagagttctatagctgactataaacgaccttttgaagaggatcaaaacaaaacaattgtttgtggatgacaaaacatcgcacagtcaaaaacatgattgacaaagcaatttagttatctcagtggcatacaacgattttatgtagcaattataactattagtgacctatactaagtcatatgagaattgtaggcgtttcccatcattttggaacacataccaataacacatttatgcaaatatagcccaaagaaagctaaatactgtttcacatttgacaatgcttcctgtatgatgtttataccaaataagccaaattttacctttacattagtgtactattaattttacactcaattcttaataaaaccttatagacatatctacccaattttaatgtttgaccataaggtaagattctcataaaccttttataaccctttacaatttctgttaaagagcagatcataaacaggattttgctccaagaaaaacctgttgtcatttatgccaatgttcagtttacagaaaaactgaataatacccctttaattttagccaatggccacacacagaatttcttttacaattttttcacaaatctgccccaacttgcttaaaccttcagctttatcttatctaattgtaaaataccctttaatgtaggaaaaaaaaatccacattcccatgacttcttataatcttttgccaaaaacacatttcactttctttatacaccttacatataaaactgtttctttagtagtctcaaatacttgttacgctgttaactcttggcaacttttgcttttggcaaaaagcttggtaagttcagcattctaattatgtactaggcatggagcctaggacccagacagaagtacagataaggtctgactctttccagcatcttattccatgtgtcccaggccttacctagccataaagcaggcaagttacagtaagagtcatagtggcattttatgaagcattaagggggcctaacgaccttcaaattgtacaacatttcttgcacaaactccctttcactaatcctttcacgacttacatagactatgacatgcttagactttctgacttttcctaaacatccctctttttaagcaaccagttgttttactttaggacaagaatctaccatacaagattgttttttatataacatctgttttctttacaaccttctttgcatagctagggggcatggctaatttcacatgtccccagccctatctacaatctaatgctcctaaataaattgaacaattttcaaaagtcaaagaagccatttatgaccgtaaagtatttggaaaacctgatacctgatctgcataatttacaccaaatgttacatttttgaagaatttttgttttaccaataatctttattaaaactgtcttgatttccctaagattactaaagtcacatgaactgaacatcattctactttttacttttctgaaaaaatatttgatttaagttcttcttattaataaactaattagagctctttcatatataaacatcacacacataatacatttaaatatggagacacgcagaagatgaaggactccttccctaagccaggaattgaaccctggaccggggccgccattgtgaaaagagaaagcatggccacaaggttacaaggtcaagctcccaaggacatacaagacgagggaaacctcgtccagttttagttttttgggggacttgcagcaaagtttgtaactgaccagtttgctgggccatcttgaaagcaggcttacaggtgtcctaaccctatgttctctcctaaggtacccctctttatgacagaacaatacagaaagacaaagtacaccagattggctacaggttaagattaggctttcaaatcatttctcccattaatcaaaactttacagaggagacagtgatttttaccattcattcaactggtttgcacagaggggaagggaagggaaaaagggaagggagcattgcttttggcagtgtggggaaggtgaggtgctcagggaggccagagaaagacctgcccattggtgccaacactgaatcaaaagttcagccagttgcttttcagtcgagacgggatcttttccagcattcccatttgctctcaagtttccccttttagggaggaaaaagcttcctctgtcccacaatcctacatgcgcctaatcctctcacccataaccataagcaaaaagtgcaaggcagattattccaaagagaatagcaattaacatcccatagtgccaaacccattcttagccaaaagggactttactgagaggggcctctaacttcctaaatcttagaagggattctaaccctcctaaatttgccttcaaatccagggtcggtcaagtttccttgctttttaataagaggggcttttaacccactttgacttaaggagagaccctaactcccctaagttgacctctaacccaatgccatccttcagccgagtacccaaccactcacccaaggtcggccaaccagtgctgtcgtctctttcctttggtttggggctgagggctttcttcagtatcgtcccttcggggcttgccagaaagatgttaccagaccccaacacttacccaatattagcctttgagtcgggggttttctcactattgtcccttccatggttgccagaaggatgttacaggaaaggggtcccaatccagaccccaagggaaggttcttggatcaggcgcagaaaataattcagggtgagtccacagagtaaagtgaaagcaatttattaggaaagtaaaagaataaaagaatggctactccataatcagagcagccctaaggactgctggttgcccgtttgtatggttatttcttgatgatatgccaaacatggagtggattatttatgcctcccctttataggccatatagggtaacgtcctcatgttgccatggcatttgtaaactgtcattgtgctggtgggagtgtagcagtgaggatgaccggaggtcacttttgtcagcatcttggttttggtgggttttagccgccttctttactgcaacctgttttatccgcaaagccttaataacctgtatctgtgctgaactcctgtctcatccgttgacttcgagcgccttaaccttctggaaatgcagcccagtaggtctcagccttatttcacccagcccctattcaagatggagttgctctcattcaaacacctctaacaaaataatctcaactgcaaagatgagatataatcaataattatccaatgtttaaagtgcaccaacatcttgaaacagcaatgtcgacaaggcctgtaaatattttacagagtttcattctgagcccaatataattgaccaaggcctgaggcacggttttttgttgttattgttgttgttgttgttgtttagacggggtctcattctgtcacccagcccggggtgcagtggcgtgatctcagctcactgcaacctcctcctcctgggttcaagctattctcctgcctcaggctcctgaataactgggattacaggcgcccaccaccatgcccggctgattcttgtatttttagtagagacctcgttttgccatgttgaccaggctggtctcgaactcctgacctcaggtgatccacccccctcagcctcccaaagtgctggtattacaggctgaccaccacacccagcctgaggcacagttttaagaggtcctgagaaaatgtgcccgaggtggttgggctacagcttggttttatacgttttgtggagatataagacatcagtcagtacacataaggtgtgcattggtttgattcggaaaggaaaggcaactcaaagcaggagtttacaggtcagaggtggattcagaaatttcctgattgctatctgttgaaatgggtaagttattatctaaaaactggggatcaatagaaaggagtatctgagttaaaataagggattgttgagaccaagtttcttattatgtggaatagttggtaaatgtctcttatcagaccttaaaaggtgccggacttagttaaatctctcctggatctggaaaatacttggacaggggaggggattcgctacagaatgtagattttccctagaagagacagctttgcaggaccatttaaaaatatgtcaaaggaatatattttggggtaaaatactttgatttctttcagagcctactgtcatgtgatgctataccagagtcaagttggaatttggtatctcattgctgtgaagagtctgttttttcattcttaagatctctgttttaacgttaatactcactggtcagttgtgcctgaattccaaagggaggaagttataatgaggcatgtccaacccctccttcccatcatggcctgaactagtttttcaagtttactttggaatgccttggctgagagaagggttcgttcagttggttggggggcttagaattttatttttggtttacagcaacaataaatggatatatcttgcaaaaaaagttatgagaccagccagagatgatcactaagaataattaatatcatgaaagcaaaggagaatgttttatttgtaggaaagaaataggcagttatggaaaagaatggatattgatttttaaaaacgttgaaactgaacaacgctggtaaagtttcttcaaagttctatttttttaggtaaaaacattagctacttgatttaagaaaatgaagaaaacatattctttgaaaatgctttgataaagataaagctgtacaaattcagtttaacaataaatgtttgtcaaatgaataactttcttttaatttaaggtgctgtattttgggatgttatccctcagaggattattttcttgaaaaggaaggcatttttctccttttggatttgttagcagtaagtatggctataacaatcataagacaaaagacaaatatgtctattaaaggccgtttccaaactgaatgccacagagcacaagtctatgaataaatgtgccccaaatcatgttcaaaggtacggtcttaaacaaaattgctcctagaaattcataatacacagtgttttaaaggctctgaaaattcctctggttggaaagtcattttaccagtgttttttcagtgttttcaaatacacgggaacaaagaatttgtttttctttgtactccatcaacctgttaagaaacagtttgtgaagagcttgaccatatgaaaacccatagtcatttattaataacttctagtttcttcccctgatattaaaagataagggccacgttagacaaggagcaaagataagcatttttaaagaactatgtattatttggaggtaacctgaagaagtctagtgactcatggaccattgttttgcagaatgagcagatgtgagcaagctaggccttccaatagagacagtgccatctagcagctgtgaagaatatagccccttactagcctcaattctaactggaatccatagtcaggatgatatgggaggaaacgtacaattttgtttcaataaaattttgagagagattctcacacagagttctagcccgctccctgtccgtgattctatgattgccactattcttgattttattaacagaataacaaacctactttgatttagcaaaagtgctaaaattatttgtgccccttaacctccctgaaagttagttcatttctctcttttcgatttctttacctgtaaaacagagataacaacattatatatcttattgtattgttggaaggattaaatgagtgattgtatgtctgtgtgtgcatctaagtgtgcatgcatacatatatattatagattaaatatagtgcctaacatgattcctgtatttactgttattatgaatattattgctagaatatatttaatgctgattcaaccaaattaattgcaaattacagatattatttaatgaagattttatatcaatttcaatctttcacatttgcctgtctcctgaagtagagaaataaaaaaactcatttccttgagtgttttgcttaatacaactctgctgaaatataaagtatgtaatgataactgctaataatggttaaatgttaatgagagctgactatgtaccagggagtctcatataactcataataaccctttgcaggtaatattattatcctttcattttataaaaggaaactgatgatgttcgcaattaaaacaaaagcttacatatttcctttgctatattcaaataacagtatactgtaaaagttaatcaacaaaaagtatttcacatagaagaattagattatggaggccattgctctggatggaattttctatacctaaattttggtgtactgaaaactacttgtagcaaaataaaggaaatatgctttataataggagaatttttttgaatccttaaatactcttttatggatgatgattgccacaaaaccaaattacatcttgttttattttcatatgtgattgtcatttgcagttaccatcagttactctcttaataacaaagagattacagttagtatgaatctttacaagccttaataaagcatataaattggaaagatcctgtaattacagtgaactctgtataacactatcgagcttcgccacttaaaatgaacatcttcacttatttgtgcaaatctttttccaactcagccacatcagtcacattttggtcatgatatatgtttataatgacttcagaattatattaaatcttttactttttatccttttaaatttctaatgtttgaaaatatagtcattacaatgggtgtccattttaacaggagattttcctgactctgagtttagaagaaacttaatgataatagaagtgtttctctcttttttttttgaagacaataattcttaatatttattgcaacttttttccttttctgtttccttgctaaagttgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattggtgagtatatttataattgttagtagaagcaattaatgtatatattttaaaagatctttaaatggtattaagaaagcatcaggcctttcacccctttgtctaaagttttttttttttttttacaagggtttgaaaaatttgctatcctaagtgactggaagaaaactaagtaaattagtagtaggttcatatttttagagaatatttttaagaaatggtatttaattatattcttttaactaaaaaaaaaattaaagtagttcctaaagatgcttctttgggttttctgcttttatagatagattcaataatatttcattgagatgtaaatagattgcttcaaaataatattttggtattttatacatttctgttcatttttcctttttctaaatccattaggcaacatgatctgattaatgtttatagagtttactttttatatgaaagaagatattgtttcctaaataaaaatagtccaaatgttcaaaaattttaattactagattctaaattaatgagacttacagtatcataatttttagttcatttacatattccatactgctatattacatttttttcttttttttttcttttttttttgtgagacagggtttcactcaggtcacccagactggggtgtgatggtgcaatcttggctcactgaaacctctgcctcccaggctcaagcgattttcctgccttagcctcccaagtagctgggactacaggcatgcactaccacacccagctaatttttgtattttttgtagagatgaggtttcaccgtgttgcccaggctggtctcaagctcctgggctcaagcgatccactcacctcagcctctgccaagtgttgggattataggcatgagccaccacacctggccaatatattacattttctttttttcttttttttttggagacagagtctcgctctttcgcccaggctggagtgcagtgacatgaactcggctcactgcaacctccgcctcccaggttcaaatgattcttctgcctcagcctcctgagtagctgggtctacaggcacgtgccaccatacccagctaatttttgtatttttttaattagagacagggtttcaccatgttggctaggctggtcttgaactcctgacctcaggggatctgcccaactccacttgccaaagtgctgggattacagacatgagccactgcaccccgcctacatattctaagccttttaagattcttatggtttcatctaaacggttcacttttttttttaaattttattttaggttcaggggtacacatacaggtttgttatatgggtaaactcatgtcacaagggtttgttgtacagattattttgtcacccaggtactaagcctagtacccaatagttattttttctgaccctctccctcctcctactctctaccatctaataggcctcagtgtgtgttgttctcctccatgtgtccatgaattctcatcatttagatcccacttataagtgaagacatgcagtgtttggttttctgttcctgtgttagtttgctaaggataatggcctccacctccatccatgttccctcaaaatacatgatctcactatttttatggctgcatagcattccatggtgtatatggaccacattttctttatccagtctgtcatgatgggcatttaggttgattccatgtctttgctattgtgaatagtgctgcagtgaacattcatgtgtgtgtctttatgatagaatggtttatattcctctgagcatatactcagtcacaggattgctgggtcgaatagtagttctgtttttagctctttgaggaattgccacactgctttccacaatggttgaactaatttacactcccagcaacagtgtataagcatccccttttctccacaaccttgccggtatgttattttttgactttttaataacagccattctgactgatgtgagatactatttcattgtgatttgaatttgaatttttctaataatcagtgatattgagcttttttcatatgcttgttggctgcatgtatgacttcttttgaaaagtgtctgttcatgtcctttgcccacttttgaatggggttgtgttttttcttataaatttgtttaagttcattatagatgctggatattagacctctgtcagatgcatagtttgcacaaattttctcccattctgttggttggcttttcatcctgttgatagtttcttttactgtgcagaagttcttaagtttaattagatcccatttgtcaatttttgcttgtattgtgattccttttgacatctttgtcatgaaatctttgcccattcctaagtccagattgctactgcctaggttgtcttccagggttcttatagttttgggttttacatttaagtctttaatccaacttgagttgatttttgtatatggtataaggaagaggtccagtttcaattttctgcatatggctggctagttatcccagcaccatttattaaatagggagttatttccccattgcttgtttctgtcagctttgttgaagatcaagtagttgtaggtgtgtagccttatttctgggctctctattctgttatattgaactgtgtctgtttttgtaccagtactatgctgttttggttactgtggtcttgtagtttagtttgaacttaggtaacgtgatgcctgtagtgttgctctttgtttaggatttccttggctattggggctctttctggttccatatgattttttgaatagttttctctagttatgtgaagattgttgttgatagctttatagaaatactattgaatctgtaaattgctttgggcagtataaccattttaatgatattgattcttcctatccttgagcatgggatgtttttccatttgtttgtgtcatctctgatttctttaagcagtattttctaattctcatcatagaggtcttttggctccctggttagctgtattcctaggtattttattctttttatggcaattgtgaatgggattgtgtttctgacttggctgttggcttggctgttgttggtgtgtaggaatgctagtcacttttgtacattgatttcgtgtcccgcaactttgctaaagttgtttatcagctaaaggagcttttgggccgagactatggagttttctagatacagactcatgtcatctgcaaacagggatagtttgacttcccctcttcctgtttggatgctttttttttttctttctcttgcttgattgctctggccaagatttccaatactatgtggtgaaagagcgcatgcctgtcttgtgccagtttacaaagggaatgcttccagcttttctccattccatataatgctggctgtgggtttgtcatagatggctcttattatttttagatatgtttccttaagtattgtttatttttaaatgtaaatacttccccttctgatgacttgtatcttcaatccatttttattgtttctgagttttgacctatagcatcataaaatagtttttatatttatagcataatatatagaaaccaaaagtaaacaaggttacatcactgttaaactgacattactcaagttctggatttcaaaattttttaaattatttacatagaagttttacttttaaaaagtaattttgtgaaattttaatattttacataaacaataaaaatgaaggctctaagttttgccacagagtggggaagaaatagctgcttaattattatttcaaaagtgtaaccgtgtaataggcactatttttttgctacaatatttttatatattttatgttatctagactaaaatctcaaaattaagtatttgtttactatggtttttatctgtcccttttctattttcatgctatccaatgattagatacaaaaaaacctctatttactagctttcaagaagagcaaaaaatcatcccactgcctgctaactgcccatctattgcggttatggatgtttctgagaatattagagcaaaaatttatgctatattgggcaaactaggtaagaagttctcttcaaatttgcaagagtctgttttgctaagtatacacactgattttactttggagacagtttttcaaatataatgagcaaaaatctctttatatagagaaattcattttccattgttaccccaattcccaaactgcacccctcaccaattaaatcagaatctctgtgtgtgggatccaggcaatagtattttttaaagctccccaggcaattccaatgtgcagataggattaaggacagttagtttagatgattaagcttaaaatactgacattctgagtcacttgagtttttttttttaagtctttgctgtctattaaggaaaaagtttatcaaacactcttcagcttctgaagtaagatattattgtctgactacaacacagaaagaaatgattcctatatattggatgacctggcagaaatgtgttatagaaagaagcctactcacaagctactcacagaattaactttttcataaatcaagatgaaatcaaaagtaactttgcatttgtttttagataggtagatagatagatagatagatagatagatagatagatagatagattcttagaatcacttgctctgctaaagtaattctgtctttataaactttattttagattttgaaaatttacctggcctatctgctgaagattttgtcaccctttgtatcatacatagatatcttgattttaaagtaagtatctttttaataacctgattattaaaatctagatagcaaaaaattaactggaaaataaaatatctattcatggttgtgagcaatcatctacatactgtatagtttttatttttcattttgcatctgatgctgttgaagaaatacaccatacacccatcccatgattgggtgtttttcatgggataagatttcatccaacttagtttgtgaaagaagatgtacaaaactgatataagccgggcacggtggctcacgcctgtaatcccagcactttgggaggccaaggcaggtggataacgaggtcaggagatcaagaccatcctggctaacatggtgaaaccctgtctctactaaaaatacaaaaattagctggatgtggtggcgggcgcctatagtcccagctactcgggaggctgaggcaggagaatgatgtgaacctggaaggtggagcttgcagtgagccaagattgcgccactgcactccagcctgggcgacagagcgagactccgtctaaaaaaaaaaaaagaaactgatataaaactgttcagaagcctagcaaaaaaaaaaaaaattatttttatgagatggagattttgctcttgtcacccaggctggagtacaatggcatgatcttggctcaatgcaacctctgcctcccaggttcaagtgattctcctgcctcagcctcccaagtagctgggatgacaggcacccgccaccacgcccagctaatttttgtattttttaatttttgtattctcatgcctgcaatcctagcaccttgggaggccgaggtgggtggatcacccaaggtcaggagttcgagaccagcctgaccatacagtttcttctctttggagttgaaattaaataagtttttatttattaaaataaattattaatacttattaaagtattattttatcattactttatattatgatccaatcttgattaaaagatagtaggttacttaccttgctagttatatttgtcagtaaatacttttgaagtctcaagaaagtctttttaagttaacattgtccttctactaatattagtactgtatatttggatgttgtaaatgagtaaacctctattttctttctttccttctttttttttttttttttgaggcagagtctcatcctgtcacctagcctaaagtgcagttgcatgatcacagctcactgcagcctcaacctcccaggctcatttgatcctccagcctcatcttcccaagtagctgggactacaagtgtgtacccccatacccagctttttattgggggggggcggggcggggtagagacaaggtctcactgtgttgctcaggctgccttcaaactcctaggctcaagtgatccacccactccattcagcccaaagatgaattttttccttatcatagatatataatttttttctttaattttatgggtccagcacacttctgctgcacaactctgctcttttttctctaattctaaatacactcaagaacgttaacttctagacagcctagaatatgagatggagccactgacatgatggaaccatggagttaaaagcttgagattccattataatttgccttagctagaaagtgaggggcagggcccctttctcagggtggctgggttctagggtcctagtaatccccatgttcattctcctaaaagttcatcttgacctagccttcaatatagggctttagggaggaaagtaacgatagttcagaaagatcagaataaatcagcagtttctgcagctgtgaaatcaaggtaactataaactagagggcagtgatgatggtgatgatggcagggaactaggcataggagagccttatccatgaataacataccattgaaaaacatttgataaattcctactgagtactcaaatgtagctggtaccctcaatcattcccaatgcacttattcccaggaagtaatttaggaaaagtttaagtgttaacaggagtgactaaccatataaaaaattgtataattgtacaattgcatgatttgtttttggttaatttaactttgttaaactttgttataacagattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaagtaagctacataggtagtgaggagggagaatgaagataggttggttaatgggcacaaaaatacagttagatagaataagttctgttgttcaatagcacagtaggacaactatagtaacaataatttattgtacatttcaaaatacccagaagacttggaatgctcctaacacaaagaaatgataagtgtttaaggggatggatatcccaattaccctgatcattacacattgtatgcacatatcaaaatatcacatgtatgccataaatatgtacaactattatatatcaataagaaagtaagccacagataccattaaggcacaagataataatttcaatgtataaacccagatgaagttatccataagatatatttttcttacttgtgggtgtttcagccttgagttattttgtggttttctcttagagttattttcagtgtctctgtgcagttttaaaagaaactatggagtttgagattgagttactatattcaatgctgtttttttgcattataattttatttctacagtcttaaatttttaaaaggcagagagatacttgagacatgccactggactccagcctgggtgacagagtgaggttctgtctcaaaaaaaaaaaagaaaaaaaagaaactgaaacttaattatctttctcatttcagatacaggccacgcacaagcaaagagagctggctaataaatcatgggaagatttcttggctagaacatcaaacgctaaaacgttaaaggtaggatttttaatgtattatagtatccacaacaaatagccaactcttacagacagactttttcaggaacaaatattcattcattttttcctagtgacctttccgtacaataccagcactattagatgctcatatgcaatttagagtgataagtgaaactgcatttcacagttacagaagatgctgctttgagtttcatttggtttatcagggagaaacaaggctgatgttcttgacctacataaagaagaagatgatagccaggaatgagcaggaaaatgtgttctgctttccattctgaacctgcttattcattgatttcttttctgtgagaggcaaagtaaaggacacaaagagcaactatcttgtattactctgtcccccaagagcttttccctctgtgatcaccaaaagaagcattatgttaaacttaaatgtgaactggggataaatatccctttgtagaaaaatgtggtaagctacttcaactgtaagctagaaactaatctaaaaaatgtatagtgctaatcgttcacttgaaatatgtgagaaacaccatggatttccagaatttcattacttttccccacccttttccattaatatcttggatacactttttaaaaaatctctccttcatttctgatactttggatagactttacctaatgtttcaatacttcctatagatataaaattgctaaatgttaagttagtccacaagacggtggaaccatattaagatagcaaaaccaaatttaagaacaagctcactcaaggtaccaagttatctccctgttcactgaaagttcttcccaattctacttataaaatgtcttcctaactgcctgtatttttagcactagttaatgaaaatcagctcctttcctgcaggtcatttattacttcacatttcacttgtttagtgtagcaaataccttgaaaataacttcaaatagcttaaatataactgcaatgaattacataatttatattattctgaatgcttaaaacatttaagtgtacttaatcagttggtaatttatgcaatatgttttgcaatatgcatcacctgatataaatttaatagcttattaaattatgtgctaaaaattgaacctgatttcttcaggatctgcttgactccttggtcatatatggatttcttggactacttccagaaatctctggaagacttttaggtgactggagtcttcttcaatgtgcaaagtatctaacttactaataactgtctttttagtctaaatgagtaaatgcagatttcagcgctatctaataaacaaccaaagcataagccagacacaattaaatatgtttttcattgtaagtaccatcattactgatttaatagcaattaatattttctttctaatttaaaaatcctcagaaagcaaaaagccttcaagaaaaagctatagaagcctccagataccataaacgaccacaaaatgcaatatttcaccaaacacatattaaaggccttaacacaacggtaagattctttctccataacattttcttaatagacattaaatttagagtgtttgaacaactgtgcaaatatactgaaaaccattgaattttacccattaaatggatggattgtgtggtattgaattatatctcaataaaactgttcaaaaaaaattttaaatttaaaaattagaagttaaaaaaattaataaaaaaaaaacttaggcccccaaaatattatgtcaatgggattttcatctcacattttttctttttgctgttcaaatttcacatcattaaggcatatttatctccaatgtatatccacttttgcccggttctggtttagagtaggcccagccctccaggatttctaagaaactgctataaacactagtcagcttataattgtccttatatctctttaacagaaaagacgcagtgcttccccttttcctggcgagtagatcccaagtgttcctggtatcctctgctagacttaatttgcccccagttacaaagctgataagcaatagaaatagaattcaaacctacttttcctggctccgatgcccttatctttctattataccataactgcctcctagttattcattacatttgtgtcttttcaaaagtaagctgaaggatgaatgagtttttctcttgttgaaaattgtgtaaatggacttttagatatttaccttttgcctttttaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctacttctcttctttaatggggaagggaaaggtgtaatgggggaagtgttttccctcatttggtagtagaggtatcttgtcaaagaataggagataaatgcctttatgctggacatagagcaaatctgtgtccctggatgcccttatgaagtctccctctcctgccttcattcccttcacacccctcctccagcctggaagccacaaaggacatgagttcatgtccaggaatcagagagacaaggacctgtttcttaggaaaataaactggaatttgagtctagattctgggcccatggggcacactcagcagtgtactggtaaatggataactagctttccaggagggaaaagccctgatttacatcatgttctcaccaattcacacagtataaatactgccactattaccaatctcaagctaccaacatgatgccattgaatacatggttgggaaaacatagataggttctttcattattagataagagcaggctctatcacctcaatgtacccacattttcctccttcttctttcctcctcctcctcttcctcctcttcccccaactcacattcctctagggattttccattatcctgtctgtgaagacagtagcatcttcattgagaggtaggggttgcagctcttgtcattgttctaattagaatgagttgccagttcaccttagattggcggcttctcaccctggcccagatgcccatcctcttgtgccccataggagtagataacatgcatcagcttatcagtgagctttgttctctcctgaatccctttctctagtctaccaccttcaagaagatattagaaggcataatttgtttctttccttcacagggaaccctaagcatgggtaggagcatacaacgagatgcccatacaaaaaataccagatacatcttaggtacacttgaattgatgtgaagtgtccatggctaacaatgaatctttgctccattttgtagactataagctctctaagaacaaggtagagaccatatctcattaattattgtacttagtatctccggaaataaattattagataatgtgatggtggcctcagctactggcagtctttcccttgagctctgcaaatgcagcaaagtactgagctcaaagggaagattcagccaacaaaatactacacaagtaatgctcaacacagacaacatgttagtttaaatgtatttacttcataacatgatagattttctccaaaatggtgaggcataaatactactacatgaatataaccaaggtgtggaaatagtattacttgcttgagtatcatttttgtatgtagtacaactaaatgtctcagattgattaggactgtaatctagacaatttctgatgtctgtgaacctttcttcttccatgtattttgcccatcagcaagaagaaaggtaaaacagggcagattattatgtagcagctatttaatagacaaataagtgtaagttgatggaaagcagtaatgttccttaatacagacacttgcacttggtagacagattcacccaagtttgcatattataattccagccaccacacagtgagtgagtgactctttctcacaatatcactaactctaagtctctgtctctcatcacatcctatattctcacaccacccctgagccctaggggacatgatgcctacccgatcctgccggctgagagaaggatggtatattttcttacattagtcaggtgagacaaaatttgaagctttcaaactgaaacttttactaaccaactgaatgaaaaggaagtcaaaagaataaaagtgtggaattcagtgagcacagataaaagtagcttcaacaatctcagtaatgagacttttaccacatgggggagctcattctagcatggttaaactaattgtcagacagtgctgacttacattgagtgaaaaattagtgaataattaggtgaataactttcatccatctggcatcatcagtctgccttatggaacataaagtattttatatacaactatattatccaccttaagtcttttgaggtcagatatccagtttctttcatcattcttctgataatgtagtttctagaatgtatgaatctggtcagctccatctgaagtgctacaatttgttaatactcctctaaactgtgaccaaacagatcaaagatttttcaggtgagcaggatcaatgtagttcctctcatttttacacacattctgccaacacaaccttaacttacattagtttcattagcaaccattttttattgcttatatttagttgcctttcaaggaaaatgtcagggatgctttctgagaaagaatagcagaccctgacatccaggaactgtcctggtactatcaggtcaaaattctatagatagacccaataccccaactttggtttccagtatcattctccaataaaatgagccagggcttcttggagaaatggctaattctaaggctggcgcagaaatatatgagtctggagcatcttactgagctcccagtggccaaagctggaatgatttgaacaaatcaataatgtagtgttggattataaaccaaagtataaacaaatgttcataaatccatactgatataaataaatgatgaaaggaagggaaaaaaggaaggaagggagagagaaagtgggggaagcctccatacaaagaattctaaatgatttatgtagatattccctcctcaagaaggtagaagataactacccattctcaagtatgggttatgcttagtgacttctttccagaggatgtaatatagaaagaaagtggaaagaaactttacaatgaagaaaactggcaaacactacctaagccaaggttaaacaccaccaatggcaagtcacgtcaatgacatgtgcctttgatatgacgtgttgagtatgatactttacctctgtggtcttcatcccaaaaacctataatcccagtcaaacaaagacatcaggcaaacccaaattgaggggcattttgcaatatacctgaccagtactcaaaattgtcaaggtcatcaaaaacatggtctgagacattgtcacaacccacaggaacctcagaagacatgacaactcggtgtaacgtgggatcctggaacaacaataacaaaaaaggagcttagggaaaaactactgaaatctgaataaaataggaagtttagttaatattgtattggtttcagtgtattagttgtgacatatataatgttaagatattaacaataagaataaacatggggccaggcacagtggttcaggcctgtaatcccagcacttgggaggctgactcaggcagatcacttgggtccaggagttggagaccagcttgggcaatggagtgcaatcctgactctacaaaaaaatacaaaaattatttgggagtggtggtgtagaccacaaccgtagttccagctatttgggaggctgagataggaggatcaattgagcccaggaggttgaagttgcagtgagccgtgattgcaccactgacagagcaagaccctgccaaaaaaaaagaaaaagaaaaaaaaatgatgagaggtatataggaactctgtaccatccttgcaacttctctgcaaatttaaaactttttttttttttttacagtttggtattttttattattattatactttaagttttagggtacatgtgcacaatgtgcaggttagttacatatatatacatgtgccatgctggtgcgctgcacccactaactcatcatctagcattaggtatatctcccaatgctatcgctcccccccctgctttaaaactattttaaaatgaaaagtttatcaaatttacaagaagaaaaacattaaaaagtgggcaaaggacatgaacagacacttttcaaaagatgtcatacatggagccaacaagcgtatgaaaaaaaagctcaatatcactgatcattagagaaatgctatgaaaccacaatgagataccatctcacaccagtcagaatgactgttattaaaaagtcaaaaaacaacagatgctggcgaggttgcagagaaaagagaatgcttatacactgttgctgggagtgtaaattagttcaaccattgtggaaagcagtgtggcaattcctcaaagagctaaaaacagaactactattcgacccagccatcccatgactgagtatatgctcaggggaatataaatcattctaccgtaaagacacacgcacatgaatgttcactgcagcactatttacaatagcaaagacatggaatcaacctaaatgaccatcatgacagactggataaagaaaatgtggtccatatacaccatggaatgctatgcagccataaaaagaatgagatcatgtcttttgcaagaacatggatggaggtggaggccattatccctagcaaaccaacacaggaacagaaaaccgaataccgcatgttctcacttaagtgggagctagatgatgagaactcatggacacaaaatgcggaacaacaggcactgaggcctacttgattggtggagagtgggaagagggagaggatcaggaaaaataactattgagtactaggcttagtaccggggtgacaaaataatctgtacaacaaacccccgtgaaatgagtttacctatagaacaaacctgtatgtgtacccctgaacctaaaacaaaagtttaaaaaataaacaaaattaaaagtttatttaaagtttaaaaaagattctggccaggcttggtggcttacgcctgtaatcccagcactttgggaggcagaggcaggtggatcatctgaggtcaggagtttgagaccagactggtgaacctggtgaaaccctgtctctactaaaactacaaaaaattagctgggcatggtggcaggtgcctataatcccacctacttgggaggctgaggcaggagagtcacttgaacccgggaggcggaggctgcagtgagccaagatcacgccattgcactccagcctgagcaacaagagcgaaactccgtctcaaaaaaagaaaaaataaagattcgatagaaacagcagaggaactttagacatagataattattatcccttgtatcatcttatgaagaaatatttgtggggtcaatattagatcctttgccaccttttttctcctcagccttaagctctctgaaaaataatcggttatgagctaagccaaatgagctcagcataaacccaaagctgtgaaactgaatctttaccatggtaccactgcaagaattggtggtttgttttttaaaatgatctctagactgtcaaatgattttgaataggacaaaagagaaatacatattgtcccaattcagcttcattttgaccaccttcttttttatcttctattttgatatcataaaattgcttttgaattagatctttcagtctatccctgcattgtcccacttcagtgtcaactctgtgagtcaaagattacgtctggattgttcactaatataccctaaagcttaatgaatatttgttgaatgaatgaatgatgaacagaaagaaaaagtttttttatatgcagatgacactatttgtgccaaaaacggggaggaatttacggtatgtaatcatcatcaaaaagcttaagatgagttgttttaaaaccagattgcccagtttagcaaatgttcttatttttaacccaatgtagtatgtaaattcaattaaaagaactagaaaaccattttgccattaactggaagactaattttattgatttaagctaaaatgtttatcatcgctgcaataaaattgtcatgacaactatgagtgattgaggacaactggttgaacaattttttagactaaaagtacatggtctcactttacagcattgaacttttgagcttcaatcatttgcccacagactgtaaaagagaactgttttttttgaggaaaactgtaatactgcctctaggtaccacttcggctcctctgcaggaaatgaattctaggtggatagctgtcaggtcatttttttttttttagaccaaaagcagtttaatgataaagaacacagatgttcaatatggagatgagaaaggacaggaaagttcttggcaagattaactcaactttttactcctgtcacataaatgtgactcctctcaaatgaatcatcacttttcgattagagctaaacagtaataaagtgtcaatatgaaaatatgttgaaatttaaaaactcatatcagactaattatttgtcatataaattccacaaatcaaaagcttaatggacataaaatcactcatgtttacacgctgtctggtcatttttatgagaacattaattagccctaccctccaaccagttgattttctgagcttagggatccacccttaattggcaagataagaagttttcaatctaggaaattattagccctacaatcttatattatctgctactcatgcaaaattggttatatgaaataatattgccgaacgctatgaggtcctttaatattgaaaattcctaacctggggtttatgcagccccctgaaattacatgcaaaatgtaattttaagagtgtttatatataaaacccctaataaatggtctatacatcatcagaatttgaaagtggtcaataatgcaaagaacgtccctcctttaattcagcttattcttggatcaagtcaaaccatcaggcagttcgttacttgttcagtattattttagccgattttaaaactttttatatttgagtttgagtgtactggaatcagactgtaaaggagagaatctgtcattgtaaggatacttgaaaccagtgttgtaaaccatggtagccactgtgaaaacctatgggtgagattttcattgattctttgtcctggaaaaggctggacctctgttgaacatatggtttggtttttcttataagcatgtgaatcttgaaactgttcatgtgtccctcttcactaggagaagtgggaaacagaccaaatttataggcaccctttatcaaaggtataggcttttacgacatgcattcaaaaagtattaatctaaaccgtaactccattgtattacttccctgtcttcatgtcccaatgttccaatttcctccactacttcatgttttccttttcttcggtatatttctttaaagcttcacatcctttttgaaataagatgtgagatataaataggcaatataaaaaataactcagctaacacaaaaattctatcaaattgtactttactgaaatgaagtttctgtctttgtttattgttcctttttcaaaacaaagacaataaaaatgagaacataaaaaggttttagtccttaatgcatagaaaaatactttaatatagaagatggcttggtaatgaaatgtacatttcagaaaccacaaaatatactacattaaatattactttttaggataatactgccattagttttggcacagtttaatagtcaatattaatatataagataccttataaaattggttacaattttattccattgactattgtatctaaaaaatatatcacatttgccttttaactgatgttttctttaaaacaaagacactttaaaaagacaccttctaagtaaaaaattgagaaattatctgaaaatattggaataattcaatagcaataaagcaattacaacaaaaaacaacgtttatcagtattaaataatttgtataactatgacaagaaatatttgacctcataaatacaagttttcaggtcgctgtcatcttgcttgaggtattttacatgttttctcttaaatgtaatactctcattttgtaaaatctagtcctgtaagatttaaaagaagaaattgttaatattcattccaatatgactcttaaatttcctgcttttatacaaccctattgaaaaaattaatttcaaaagcctaaatacatgtctgatgtttaaaatttcttcaacaaatgtaatatgaataattacagggttaaatggctttcttatgaactattcatgggcaaacaaggataattttaattatctaccaaagtgtattatattccaagatcatttaaaattgtaagtcagagcttgtgtggtttgtaaataatgtaaaatgagtaaaaatgagaatcaaaacctatcattttagggaaaaaaactaaatatggtaaatttgctaccttgttggataacttgaaaaaaatcagaagaattaaatagtgacttttaaagaaaagtaaactgctattctcttaaatacacatttaaattacctcctgttattttctgtggaaaattatatttggggggcatcacctgtcttctgcccattccatgagatcttgaaagcaagcagtctacatacatgtcccagaaatcctgagctatgtttaagaagacattataatgtccaggccgctgagatttttgcaagaacaacatgaaattccaaaaagcatccacattgtgctctatcttgagttccttgagatctatcaatgtcaaagagcaagctttccagcactggagatcaatgtctttggtgattcctgggctgatgctggcaagcactcctttttgaaactcaaagtcagcattaaccagattgatcagcatcatgcagcccaaatgtagatagaaccatcttcttgtagcaaaacacatattctatacagaaaaaaaaatgagagaggatatatttaacttaaaaaagttattcaatcacttgatctaaaaaactgtaagtacacatatatttgcttttgatcaagccaaatctgcttactaggtattcattttttctaaattactgattatcacatcttcctttaggatattacagttccggtttgatttccaacgttctgatcaagagtctttgaaatgcaacacatttatgaaaatgcaaaggttcatttcatcacagacctttaaaagtggcagaaaccctaaagagcttatgctccaaccttctccctttactgattagatcattagtgatacggttccgcaagtcttcagactcctgactgcctatccaagactcctacctaccacaacacatttcaactaagtggatcaaaatacagtcctttctacatgtaacataggaagtattttgttgttgttaattgagatattattaacccaaatggtactagatctcacaaacaccgtttaagtctcaaagttactgctatttccattttcatgtattgaaaaatacttgttacgcactaatatccggtgtattcttggcttccctctgtttaggagctggttggagaagatgaacgtagacatacatgaagtggcacgaaaacaaaggtgatataaggtaggatgagatagtgcagggcccattacattcagcaaaatcttgacatttttctaatgcctctttgcatgcctccttgccaactgattgttgggtaaaatcggcccaaagcacataagaggaagttaaagactaagttggcattgaattgccacacacctgctattcaaggctgctgttggaaatgtcccttttacaacattgacagccaacggggagggatagggagaggagaacagatccagaacacaggactcacctttccccccgtacacagccgtctgccacctccctaaaaaagttgggctgaagagagaaatcatacgaatcaaatctaaacaggacattcaagtcatttcacatcgtcgaaaattgtgcaaattccccagactgagctgaaagctggcagtttatgatacatgatgtatcagagggaatttcttccccctcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctagaggctgagtgagggggcagatcgtgggtggccgcgctctcgaggcccctccctgacctcgcccaacttcccagcctccagacctcgggggcctctgcgccctgcggccctgctttggccgctgctctcgcctctcctgccctcctccgactttcttgctatgccaaaggctcagggtcttcttcgctctctccttcttactttgttccttcttttttcttagctgagaagatccatctcggcattagtcagtccacatacccaagttatcttctccctccgcccacccatgctccacaccgtattctcctatccagagaaaaattctcttaaggctgtgaactctcttaaaatgctaaacctccttgaacggttctaatctctagctaaacacagtttattattaacgctaacacatacacacgcgcaaacatacccttgcttctacactgggggaaatgtttcctttatcccttcatggatgaagacccgagcaagtaccttgaatttcacatatgtatgttgtccatcaatctcagccccaacacatcacttggactatatatgagtttaagtctacctgctctgcctatagcccagcagcgatgatcagatggggctagggaaatcaaagccagctgccttatccccatttcccctcaggcaggccacccttctcacaggttcttgagctgggatggtgagatcatggggtgagatgagtgccaaaccaaacagcccagttccccagtcattgtccctgctaaagctcacttctcccagcacccaccattattcaaagctccaccctgttctcatcctgttggtggagctaacgtagtcaatcattagttctgccctggcaatgcctttttatgccccttctatctgcaggaccacctcctgcacaaaacagaactgagaaaaggggaagacttgtttactcggattaggtaggatatacacgaatccatctcacaccagatattcttctgctgtagacttccaagtgtttcagtccaccattaatcatggactctcacaattagcagagatgcagagtgacctaatccaacatcccagctgaaacgtgaacaaaccaccctcccaaggaatttgtccacccaccaaagctgttttccaatgtgacttaaccttgggcacatgtccccacccccaaaggaagcaaccccttccatctttgggttaatgttggcttccttctaaaatgaattggctcaatttctctgttgagtaaccacatagttcctgtccgtcttttttgaaagatatactttatttttcataaaacatttttatctgtttacaagtattcaaaacctattgaaaagttgtaaaatacagaaaaatgtaaggagacaggtaatagttgtcattaaaatgcatttttaaagaatattctaatattagaattagagtaatgtactaaataggagtacatatttgggtatgattattataacacacacacaggaatggtattctgaatagagaacttatataaatcaataatagaaaaataagggtaattgacagaagagtagaccttaatattcagtaaacatgagaaaaaatactgaaatattctaaatttagatagacttaataacaaagccatttcaaggaaatgatatattgtcttccccaaatgaagcttaacaaaaattaatttggtaaaatacaatctcagcaattttttgagaaaatgaacacttcatatgcttttgatgagactatcagctggtataatcaccaaggaagaaaactggcattatctgtttaatctgaaagtgatctagaaattttactcttggtgtctacccccaagtcagtgagagaagatattctttatgtgagtgatttttctgaagggtctacttgctacattcaaatagaatctggcaaaatgatgacaaacataatttttaaatcatcattgggtgatcaagaaagtgaaatctccagggaaaaggcggatggaggcaaagcataaagaatcagaatatggaaaagaagaaagaagagaaagagagaaggaagagaggaaagtgagatgtagatagtaagtttaggctttattaaaactggtatctacagtaaaaagtgagatatagatattgaatttagactttgcaaagttgttaaatatgtatggtaaaatttctcaggcaattcctaaatgacggaaatagagaacaaaactcttgaaccagggagaaaaacagattgacaaataaaaaattaattgagaaagcaagaagagagaaaaaagcacagcaaaagtgacaagtagaaagtaaatttataagattcaagtcaacaatcataataatagtctgaacttcttgattaaaggaaggaagatgtggttggattttaaattctgctatgtgcttttacaaaagatacacacacccaaaatgaggacagagaaacttgaaaagaatggaaacaaatataccatgcacatgttaattgtattttaaactgacagctttattaatacaaaaaagcacgatgaaggagaaaggggaacactacataatgataaaagactcaattcaggaagaagataaaaatattctaaatttagatatacctaataacgaagctacagaatacataaaacaaaaactgacagaagtagagggaaattttcacaaactcactatcatagtgggagagttccacaagcctttaggttaagatgataaataatactaaatgtgtagatgatttgaaccgtcaagttataaggaaccatgaaacttgcagttaaagaacacattcctcccattagaaaataaagcaagtctcgggtgcagcacaccaacatggcacatgtatacatatgtaacaaacctgcatgttgtgcacatgtaccctaaaacttaaagtataataataataaaataaaagaaaaaataaagtctcatgaaatttaaagcaagtctcaacaaatttcaaaaactagtatcactcaaacttcgttgcctgaccacaacacagaaagtttaaaagtctaaaaagtgttttaagaaatataaaaacaagaacgtagtttttcatgttttgaaatttaaacaataaatgtacttatttatgcaataactttaaacaatcgattttaaaataaaatacaatggaaattataaaatatttcaaactgtgtgattaaaaaacattgcatatcaaaacttgtgagaagccagtaagaggatcctttaaaggaaattaacagctttaaacacttgtgccaaaagaagagaggctgaaaatctgatagagtgataaatgcaaccaaatttaacagctggtaaaatagcagaaaaaaggctctcaaaagttaagagattttacaaaaacacacattagtgaactaaggcaaaaagagttgattctttgaataaaataaagcaacctctgatgaggctgatcaagaaagaaaatgaaaggtagaaaatgatatatatctatagatagcaaataaagattaaaactagatacacgaatactaacaaccaacatataccatatatttgaaattttaaattaaattaataaattcctagaaaaaatatctataaaacttggccaggcgcagtggctcacgcctataatcctagcactttgggaggctgaggcaggtggatcacctgaggtccaaagttcgagaccagcctggtgaacatggcgaaaacccatctctactaaaaatacaaaaattagccaggcatggtggcgcgtgcctgtaatcccaactgcccagaaggctgcggcaggagaatcggtggaaaccaggagacggaggctgcagtgagccgagatcgcaccactgcactctagcctgggcgacaaagaaagactatggaaaataaaaagaaaaaagaaaaaaatctataacagtcatgtaagaataactacaaagccagaatagtaaatgctgtttaaagaccttgaataagtagtttaaaatcttcccactgggaaaaaaaaaatcaagcccatatgattttgcagggcaactttcaaggatcaagtacttcctgaaaattagaaaagaaggaaatctcccagactcattctaacaaaatgagacaaggacgatctgaaaaagagtaaagtcacaggccatcttactaatgattacagataaaaataaattctaaacaaaatattgacataccaaattcagtaggacttagaaaaaacccagcagtatcaagcttggattatcctagggatgcacgggtagtttaacacaggggggcccaggccgtagattggtaccagtctgtggtctgttaaggacccagccgtacagcagaaggtgagctgtgggccagcaagcattatcacctgagctttgcctcctgtcagatcagcagcagcattattctcataggagcgtgaaccttagtgtgaactgcacatgcaagggatataggttgctgctccttatgagaatctaacgcctgatgatctgaagtgaaaaagtttcatcccaaaacatccctccctgccctccccacccaccccatctgtggaaaacttgtcctccacaaaactggtccccagtgccaaaaaggttagggactattggtttaacatattaaaatcaatgactatatttaccatgtacacaaattaaatgggaggctgggcacggtggctcatgcctgtaatcctagcactttgggaggccaaggagggcaaattgcttgagttcacgagttcgagaccagcctgggcaacatggcaaaaacctgtctctacaaaaaaatacaaaaattagccaggcacagtggcacacgcctatagtcccagctacttgagaggctgaagagggagaatcacttgagtccagaaggtagaggttgcagtgagctaagatcacgccattgcactctagcctaggtgacagagtgagactctgtctcaaaaaaaattttttttaaattaaaagaaaataaattgataaaattcaacacccattcatgattaaaaagcaaaaacaactcttagcaaactaagactagacaaaattttcttaacctcataaatgttatccactagaaccctacagcaaacatctttcttatggtaaaatactaaaataattctcttttaatttaggagcgagaaaagatgtgcatcatctctgctaacatttaaaataatacctgcaaagaaagggttagaaaaaagtggggagtggtataaggaaaagaaagagagaaaaagagaaagagagagggaaggaagggaaaggaggggaggggaatgaaggggaggggaggggagggaaagggaggggaggggaggggagggccgggcagggcagggaaggaaagggaaggatcacaactggatagcctagcagagaggcagcaaagctcttggtgagcatggagcttagaaatcaactgcctgggtttaagtcctcccttctgtgttcagatggtaatttgtggctttgagctaatgatttaatctctttgtggttaatttccttgtgagtaaaatggagatgaaaaatgaccctgcttaaaagggctgttgtgataaatatttagtgttctgaatagtgcctagcacagcatgctatgtggaatcatttgcttagaaataataataacataaattatactgacaaattaacaagttttgttaagtggttgaatataagatcaatctacaaaatctactgcatcaactatatacgagcaaaagaccagaacatataaattagaaaagagatgccatttacaatagcagtaagatgtataaggtaactaggaataaatttaacataggtaaatgaattctaagtggagatttttaaaatttttattgaaagacataaaagacaatctaaataaaaataatgctaatatatgatctataaagatatcatctgcccaaagtaatatatgcattttcaatcaaaatcacaacagggttaatgaaaatgtgatgctaaaagttacatggtaaagcaaaggctcaagacagccaaaattctcctaaagaaggccaggcacagtggcttatgcctgtaatcccagcatgtgaggaggccaaagcaagaggattgcttgagcccaggagttccagaccaacctgggcaacatagtaggacttagttgctacaaaaaattttaaaaattagccaggcatggtggtgtatgcctgtagtcccagctacttgagaggctgaggtgggaggatcacttgagtcagggaggttgaggctacagtgagccatgatcataccactgcatgccagcctgggcaacagagtgaaaccctgtctcaaaaaaaaaaaaaaattatcctgaagaagaacagtaaggagcagggtactcactagttattaaacgggaggttattggctcaggaataaagaaattaaacaatggaccagattacagaccctaaaaataaacctatccatttatagaaatgtgtaaaacaacatgggattttctttttttttttaattatactttaagttctaaggtacgtgtgcaggtttgttacatatgtatacatgtgccatgttggtgtgctgcacccattaactcgtcatttacattaggtatatctcctaatgctatccctctcccctccccccaccccacgacaggccctggtgtgtgatgttccccaccctgtgtccaaatgttctcattagaacagtggattttcaataaataaagctgggaaaactggttacccatatggaaaacgaaattagattcctacgttataccatcataaaaatcaatcccaggtatattattaatttaaatatgaaaagcaaagcatttgtactttaaaaagaacatcagaagaatatctttctgatcttggggttgagaaggacttcttacaccagacacaaatagtgctgaccataaaaggataattaatacatttgactgcattaaaattaatgtcctgttaatcacgagacactataaagataaaaaataattatattctgagagaagatatattcagcacttataatcacaaatgaattaggattaagagccaagatagaagacacttccatcgaatcaagaaaaagataaacacaataatagaaatctgggcaataggcataaagaggcatttcatagattaggaaacataaataatgaataaatacacacacatattcattatttaattgcaggcaggaaagtgcaatagggttaatgaaaatgtgactctagggggttatatggtaaagcaaaggcctaagatagctaaaattctcctaaagaaggccagattcagtgactcatgcctgtaatcccaacatttggggaggctaaggcaagaggattatatgagcccaggagttcaagaacaacctgggcaacatagtggggccatgagatgtgcacttgtacccatcaggtcaaacattaagaagtctgacaatatcaagtgttggagactgggtgtggtggcttatgcccgtaatcctagtgctttgggacacaaaggcaggaagatcacttgaggctaggagttcaagactatccttggaaaggcccctactccacaattttttttaactgggttgagtatggtgccatgtgcctgtagttccagctacttgggaggctgaggtgggcagatcacttgagctcaagagtttgaggttccagtgagctatgatcccaccactgcactccagcctgggtgacgtgagactccgacttaaaaaatatcaagtgtcaagtgttggtgaacatatgaagaatgttagtcagggttctccaaagaaacagaaccaataggatctagctaacatatgtatatattatattttatataaagatatatatatatatatatatatatatatatgaagagatgtattataaaaaattggttcatgtgattatggaggctgagaagccccacaatctgccatctgcaagctagagacttaggaaagtcagtggtatagttccagcctgagtccaaaggccttaaaacgaggaaagctgacagtgtaagttcaagtctaggcctaaaagcttgagaacccggagagccaatggtgttaagttctagtgtgagagcagaagactaatgtctcagctcaatcagtcaggaagaatcagtaaattctcccttcctccacctttttgttctattcacgccttgagtgaactggatgatgcctatacaatgaattggctgatggggagggcaatctgctttattcagcctgccaattcaaatgctagtatcatccagcaacacactcacagacacacccagaaataatatttaaacaaatatctgggtaccccatggccagtcaagttgttacatataactaaccatcacatgaggcagtaggactcttgcatagtgctaggaggagcataaattggtacaatcagtctagaacacaaactggcaccatcttctaagtctgaacaagtatgtaacttgcaataagtttttcaatcccaggaatatatcttgaagaaattcttgcaaataggtgacaagaaacataccctaaaacggaatattcatggtagcattgttcacaaaagcaaaaacatggaaaaaatcaaaatgatcactaacataatagataaattaactgtggtatatccaacattgcaagttgttatttgacagtgaaaaggaatagactacagctatatgagttacagattttaaaaaatggattgctgaatatatcatttttatgaagttcaaagacaagcaaaattaaaccatatattctttctttacaaatacatacatttgataaagcagttttaatagtaaggaagtaattcacacaaattcaggagagtggttatgtttagatatatgaggaaacaagatctggaaagaatttatagagtgtctttacagacagtgatttcactagtcttcttacgcctatggtttctaactatatatgttagaatatttagaatatatataacatgtataggatatatctgttagaatatatatttttctattatcaaataatgcataataaaacatttagaacaatgacagaaatgacatatttcaaagatagaaagataaaacataggtcgggtgcggtggctcacacctgtaatcccagcactttgggaggccgaggcagatggatcacaaggtcaagagatcaagaccatcctggccaacaaggtgaaatcccgtctctactaaaaatacaaaaattagctgggcatggtgggtgcacgcctgtagtcccagctactcaggaggctgaggcaggagaatcgcttgaaccgggaggcgggggttgcagtgagcccagattgcgccactacactccagcatggagacagagcgagactctgtctcaaaaaaaaaaaaaaaaaaaaaaaaaagaaagataaaacatggtgatttatcgcattgatatgagatggagcgagaacaaaaaagaacgagtgctttcagcatacctgcttatggagtgtcattgacaaatatgaaagatcgaaaggaagatgattaggggagaatgaatttgatttaggatgtgttgtattagagttgattctggatcttctggaatatctaaaatttatctagaaatataactagtttgagaggtctctgttttgacagaaaattagtgccgcaggtcgagaccagcctggctaacatggtgaaaccccgtctctactaaaaatacaaaaattacccgtgcgtgatggtgtgcacccgtaatcccatctactcaggagtctgaggcacgagaattgcttgaacctgggaggcagaggttgcagtgagctgagattgtgccactgcactccagcctgggcaacaagagtgcgaccctgtctcaaaaaaaaaaaaaaaaaaaaaaaaaaaaaagagaaagaaaagaaaagaaaaaagaaaattagtgaattagtgccaccatgacagtatacattgataaaagaaagttgagatgaatatggggacctatgcccaaatttcggggctcataaactgcaaatggaatcaatgaaggaagacaggaaagaataatcagcctatgtaagctccagggtgatataatgtcatagaaccaaagagaggacatagttgaagaaccagaagactgctgtagggtcaaacactttagagagcggtaggagaattggatttgagacagatttttcatttggcaaaatggaagagaagcggaaaactcagaagcacacaacacatgttaagacagtcatgataaatttatgtaaatgtttagattttacagttggttatttataaagtcaagtgtattacctaacgaatccacctaatttatcatcatagcccaaacaagccatctaactaagcaagtatgttttccaagccacgcatttttttattagaattgtcttcacgagcagcaatatattcaccatcatcccgttcctagaatatttctgttatccccagacttcatctataagtcatatcatagagcatttctccctttatctctttcacctgacccaactctaaagctctttctacacaactgagctttacctctgcaattgggtatctatattcactatattacttgacatccatttttgaatgactataatacgttgtctttcttccatgaaagcatataatgttctcctacaagcttataaaaatgtctctatttcacatgtttttaatgactggtatatagtacaatggacacaataaatatttttagctgatttctatttcatatccatgctattgccccctctgagggagttttgtcagctttccaccagccacaccccttaattctttcagaactccagtgctgcttgagatttcctggtttaatcaggccagtagcctattcatttgcccacatgcttcctactttccaatcacttagtgcagttttgtcacagttgtgttaatcccatttctcctttattgagcgtgcttctccaggaaatattgccatcatcactccccacaaaatctagaaggtcactccacacaccgtcaggacatgttgactgagtaatgctgctgaatacctacaaaaagaataatttttcaattcattaactttttgactcagtataatgaaagacattaatttgaaacatctacaattgcaattgcctctagtaaactttaataacaatgtatttatcaaagtgcgattcaatcaccttggggagaaagaaagcaggaaatgaagttgaaacaagtaagtacccttcagagaaaacaagcacttgttgacagctgactaattgaagagaaagaaggcattcttttttcaggaacacaggagacaaagatgaacaaaagactgtctcagagacaggaaaaaaatagttcaggagggaagtgaaaaagagatcactagtccttacctcttccaaaagggatgattagtagaaaatattttgttattgtttaagaacaagaaatacaaatttatcttaggacataaagacaaacacaaaggcatataaacattgtgtattttaggatcctcgttttccttttttgcataattttttagtggttgttctaagcattgcaatatatatccttaatatttcagactacttagagttaatattgaatcaattcatttaaaatgtagaaatcttgcaaggtatgagttcatttactcaccttttcatcctttttgctatagttgtcaaatgcattacgttataaatcctatgatgcaatgttatcattttcagtgctctttattttttgccgctgaagacctgattttccatctggttgtatttctcttcaacctgaagaacttctttggtatttcttatagtacgtgttcactggctacatatacttttagttttctttatctggaaatgtattttacttcaccatcattcttttagaattattttcactggatatagaatttaatgtagttttgagttttgttttattctttaaagatgttgttccactgtcttctggtctccattatttttctgatgagaagacatcaatcattcaaatcacaattcccttatatgtaatgtgtcatttttctctgacagctttcaaaatatctttagttttctgcaacttgctgacaatgtgccaggtgtgtgcaatgcaattctgacattacctagagtgaggtcaaatttcacaagttaagggtacagtcttccataagagctcccttattttgttataggtagttaggcatgagtggggcacgtgagggctctcccccagccactaggaatgtcaggtgatggttcagcaattatcacattgactctctaaaagtgacaaattggtagccagtgcaagggagaggccatttcctgatgatccacagctactgcactgaagtgtccactgaatatagatgccagagagaaggaacttactgagcatgcacattaagacacaaaatggcagagtatgaccttccaagggcacagcaccagaaaagggaaaaaagcctcagatgggcatgtgtacaactaaacacaccacgcacgctcacttcccaagcacaaggagtgcactgcacatgcaggcagcccactctaagggaagaatcatgggaaaggggccagcctataaagtcctaggatcaaggtaaagcactgcacttgttcttcaagttgcctgattggatctcttccaagtgtactttcctttctttcctgttctaatgccttcttaataaacttccactcctgctctgaaacttgcctaagtctcttttttttctgctttatgcccctccatcaaattctttattctgaggaggcaagaactgatgttgctgcagacctgtacagattcatcgctggtaactcagatactgagaggtgacagcatgctggcagcccttgcagccctcgctggttcttggcgcctcctcggcctcggcacccactctggccgtgcttgaggagcccttcagccccccgccgcactgtgggagccccttcctgggatgggcgaggccggaggcagctccctcagcctgcggggaggtgtggagggagaggcacgggcgggaaccggggctgcgcgccgcgcttgctggccagctagagttctgggtgggcgtgggcttggcgggcccgcactcggagcagccagccggccccgcaggcccggggcagtgagggtaattaggatccgggccagcagctgcggagggtgcgcggggtcccccaccagtgccggccctgtggcgctacactcgatttctcgccgggccttagccgcctccccacggggcagggctcgggacctgcagcctgggcaccctcccccccacctgtgggctcctgcgcagaccgagcctcccgaccagcgccgccccctgctccacggtgcccagtcccatcaaccgcccaagggctgagaagtgcgggcacacggggcaggactggcaggcggctcccgctgggaccctagtgcgggatccactgggtgaagccagctgggcccctgagtctactggggacttggagaacctttatgtctagctaacggattgtaaatacaccgatcagcactctgtgtctagctcaaggtttgtaaatacaccaatcagcactctgtatctagctaatctagtgaggacatggagaacttttgtgtctagctcagggattgtaaatgcaccaatcagcaccctgtcaaaacagaccaatcaggtctctgtaaaacagaccaatcagctctctgtaaaatgaaccaatcagcaggatgtgggtggggccagataagagaataaaagcaggcttccccagccagcaggggcaataggctcaggttctcttccttgctgtggaagttttgttcttttgctctttgcaaaagctcttgctactgctcattctttgggttcatactgcctttatgagcagtaacactgatcacgaaggtctgtagcttcactgctgaagccagcaagaccacaaacccactgggaggaatgaacaactccagacctgctgccttaggagttctaatgctcaccgtggaggtttgcagcttcactcctgaggccagcaagaccacgaacccaccagaaggaagaaactctgaacacatctgaacatcagaaggaacaaactctgaacacgctgcctttaagaactgtaacactcaccacgagggtccaaggcttcattgttgaagtcagtgagaccaagaacccaccaattccggacacaatatcttccaccagtaacaccttcagaaactagttgcaagcccgggattgctaggtccttgttcttctgactgactggctacaaattcaggcattcccattgccccatcagattctgtaatttgctagaaatgacttgcagaactcaggaaagtatttatacttatagttttattataaaggatatagatcaggaccagaaaatgaagagatccacagaatgcagtctgggaaggttccaaacacaaaagcttctgtgtcctaagagcattacttttttgaatcattaatatataattgccagttacagaagctcacctgtgccttggtgccagaatgtttactggcggtttttttcttttctttctttctttcttttttttttttttgacacagggtctcactctgttacccaggctggagtgcagtggcatgatcttggctcactgcagcatctgcctcctgggttctagcgattctcctacctcagcctcccaggtagctgggattacaggcacgcaccaccatgcccagctaatttttgtatttttagtagataaggggtttcaccatgttggtcaggctggtcttgaactcctgatctcaggcgatccacccacctcggcctcccgaagtgctggggttacaggtgtgagccaccacacccagcttggagttttgttatataggcatgattgattgaactgtaacttgaaatatcaggggtttggtccaggtcctgctgcttgctgcacagaaagccagtcactaagacaatcattattgccaaggaagaagactttaatggggtcctgcagtcaaggagataggagatcagtctcaaatccatctccccgaccaactaaaattaggggtttatttagcaggaaagaaacataattacgtgtggaaaagcaggaactcaggtggggtaagaaaccaatcgtgatgaatgagggcttgaactctcattgtctggtgagtttcagttctttcatactttatttatttatttatttttgagacaaggtctcactctgttgcccaggctacagtgcagtggcacaatcaccactcactgcagcctcaccctcctggactcaagcaatcctcccacttcagcctcccgagtagctaggactatcggtgcatgataccatgcccagctaatttttgtagtttttatagagatgaggtttcaccacgttgcccaggctggtgtcaaactcctgggctctagcaatctgccctaccttggcctcctaaagtgctggggttacatgtgagagctactgtccctggcctctttgatactttttgagaggcctgggggtcctttcctgaggaactcacataaaagataggtaagtttcaagctttaagaccataagggtcaatttctatatttatccaaaaaaaccatctagtggtctgttgcatcagtttcagaatcattggtcacatgattgaactgaatccccagccctccccaccacccaccacccaccacccaccaccctaccaagaggtacagcttatatcacatgcaataacatagttggtcattctgatatggtcagcccccagcctgagtcatctcatttgcataaactcaagtgtgatcccaagggcccatcaaggataaaagataattctatcaccccaaaaaattccaaggatttagaggtcatctcccagggacagaggtcaaattctttacaacagtgtggttttctttgtatttatccaacttcttggggtttgctgagcttctttttatttttttaagacagggtttaccctgttgccaggtgggactgcagtggcataatcagagctcactgtagcctcaaaactcctgggctcaagcaatcctcctgccatagactcccaagtagctgggactacaggcgtgcaccactacacctgactcattatttttaattttttgtagaaacagggtttgctttgttgctcaggcttgtcgcaaacccccattgtatcctggtagtaactaacttcttttgtattttacaggttcataggtggaagagacttgccttgtctcagatgagactttagacttggacttctgagttaatgagagaataagactttgggggactgttgggaaggcatgattgtgttccaaaatgtgagaaggacatgagatttgggaggggccgggggcagaatgcgatttggaaggggctaggggcagaataatatggtttggctctgtgtccccaagtaaacctcatattgaattataatcctcagtgctgaaggaggggcttcatgggagatgaccggatcataggagcagacttctcccttactgttcttgttttgttttgttttgttttgtttttgagatgcagtctcgctctctcgcccaggctggagtgcagtgacgtgatctcggctcactgtaagctccgcttcctgagttcatgccattctcctgcctcagcctctcgagtagctgggactacaggcacccaccaccatgcccggctaatttgttttttttttttttttttttttgtctttcagtagagacgggatttcaccgtgttagccgggatggtctcgatctcctgacctcgtgatccacccgcctcggcctcccaaagtgctgggattacaggcgtgagccactgcgcgcgcgcccggccccttaccgttcttggaatagtgagtgagttctcatgagatctggttgattaaggtgtgtagcacttcctcctttgctggctctctctcctgctccaccatgtgaagatttccctccttacctttaccttccaccatgattaagtttcctgagacctccgtagccatgctttctacacagcctatggaactatgagtcaattaaatctcttttgttcataacttacccagcctcaggtagttccttacagcaatgtgagaatggactaatacaggaaggaaattctggggagcacagctgcagctgaattggaacagtacaaaattgccacagtcctgatctttattttgttttttttttttttttttttttttgagacggagtctcgctgtccccccagctggagtccagtggcgtgatctcggctcactgcaagctccgcctcccgggttcacgccattctcctgcgttagcctccccagtagctgggacttccagatgcctgccaccacgcccggctaattttttgtatttttagcagagacggggtttcactgtgtgttagccaggatggtctcgatctcctgacctcgtgatccgcccgcctcggcctcctaaagtgctgggattacagccataagccaccgtgcccggcccacagtcctgatctttaccaaacataccatgataaaaaagagaatgattaaccctgacgccaccatggacctatttaaaaagatatgaagtgaggtttcaggtatttaagacctacagaatgtaacaggacaaaataattcaataaactcaattttctggttctgaccacttaacaactccacctgaaattctcagacatcatgactagcactagcatggcaattttcattttttggtggggggctactgtttttaataaaatgctgggctgatggctttgactcagtggtaactcctgtgtgactttgtaaataaaatgggcaagattactcaattttatgtcctaattctgctatagccttttatatttacctcatagtaatattctctaagtaatctttgtttgctttcttgttgcaacactttaatatcttagaaggaaggaatataaaattgatgtaattattggtttttctgctgtgtgaactgtaagttaatttccatacattgttttaatgtcactttcttttaacaaaagagttgagcttcaagtcagtgacaagtaaatacagaacataaaattttaaaaaataacaaaaaaatgttcatcagctaataaaacacattttttctttgttaaaagataaaactacatttcatctatgaaagaattttctgtcaaatcttacatggcaagattgacaacagtaatatttttttctaagatgaaaaacattttcaaatgagagatgaactccttaataaagatgtaatcagtcttgtcagggagaggatttacacagtaagtaaagagaagttcaaatttgaaattaatggcacacaagagagcagttctcatagtccaggatcagtcctcagacatttacttgaaggattattatttcctttacattttggaagaaaaaagtatagaagaggtaggaataaatatcagttattataatagaaaagttataaagagaaaaagaattcatactaacatcttctccagctcacctatactaaattattagctaaaaagagaaatgacaagagtttcagatcatgctgagaagcaagaaagaatagaaaataatgtgtcacattcaatttcagcctgtaatttcatatttcccctaaaaggaaatatctcaggatactgaattacaagttctagctaacagatcgagatgaagcagatgctttataccaagtaaggtgccagacacaaactcaaatttttaaaggaaataatcacaaaattcttagacctcttacgttttccactcccaatgagaatggaagagagggtgcctgatctctttcttcatgctcatttggatgggctggggcctccaccaagtgtactgatactgcttattatgttattcctgaagcggtagggcataataactgcattctgattcgtgtccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgagggtgagttcaccttggattcagtccaatagtgctgctgaaagaaatcaagggggccccattcacaaggatgaaatctaggtgtatgccagattgctggaggtagtaagggtggagagattctaaagccatcactcaaatagagacccatccactagggaaccagaagtgagagacttcactgatgagactcaagtgcccacaaaagcactatgagagagttaccctaaatatctgccagttccaggaactcaaatctggcccaccaaagacaagttaaagtaagcatttccatattacctttctcttcttccctccaatgctccaaatctagagtgccctgaagctatggcaagctggcacctaaaatcagcactagctgaagaaaagaaaagacataactttaaattgagaatttcaaatattatacagaaaccaacactctaatttctgaatctaggaagtgttttgggccttaagaggtctttaggactgctcattatctaaatgtgagctgaaaatcttggaactcaaatttaatgatgggtaaaagcttccaccactgaaaagatttaagacataatgagagaacaaaaaaaaaagttgtattaggatttatgcttagggcttcttcaatgtaaaagtaatataaaaatcaccttcacataaaccttctaccaactccatcctatcaggcttcctagagtaaacaacttgttctttactctctctaaataaggacttagcctctcctttgttcatcagaaaccttattaagatttttcttagacctcggtggtgatcgggaggtgatgcttaggtataagcatatgtataggaatatatgcttggtggcttttttccccccaacatttgttacatactgaggttttggtatatattttttcttaccaagaattaaaatttacataaaatcaaaagttacagggattatactatcttttgatatgttcattttttctcctttgttagcatttagggcataccccataactccaattgcctcactagtagacatttcccagtcaaataagatatggcctgaggaaacggcccagtaagtataattttactgaaataagaacagaagcaaagttctaatgggttgatgaatacatgggaaatgaggaaatagatataagaaatgaataccaaaatttctggaagctccacagtaaccaaatgaggaattcggtgctgttgcaagaactagattgaatgaaaaaaaataaagttaaaggccaaatataattattacagacctaatttaaaaaaattatgactcttttaagtgcttatgatgctttaaaaatgttttaaaaatctgtatttttatgttctgtgtaactcgcataaaatgagttctcattaaacttcatttttacttatacaaccatgtcttccaataagtatatgttctataccttctcagagtatactctgttatgtgttgtatgtggaatatacaatgggaacaattgtgctcaattactattctgcccaatgctgtagcttaccatgtatagagtgatagtctataatacatgcataggacaatgactaacatattcttacaatatctcctttgaaggggaatattctgattaatttatgatgtggtagtaataaatacttaaaataacacatgaacacgctaatataagcactgatttcattattttatttatttatttatttaaagacagtctcactctgtcacccagactggagtgcattggcatcatcatggcttactgcagcctcaacctcctgggctcaggtgatcttcccaccacagcctcacaggcagcttagactacaagtgtgtgccatcatgcccagctaatttgttgtgttttttgtagagacagggttttgccatgtcaccaggctggtctcaaactcctggactcaagagaccaacctgccttggcctcccaaagtgctgggattacagctgtgagccactatgcctggcctcttatttttgtttcttattcatattatctaagaattttaatttactgtcagtggttattgctttatgaaatctcagtaacaagaagcaaagaaaatgagatcagtaagtgagaatcctgaatacattacgaacttttctgctcataagtcctcttgtttgaacaaacaggaagcattatcatgaaagtctcttctgataattccactgccattcttacatctatcaatgattgaaataaagtataaaaaatgagactaaccgatgactaataggatagtagaagacccttaaaatagttttattcctctagtacaggtggtcttaaatgggggtcttaaaaaaatgattctaattctcaagatttctagaaatgcttcctaaaaagtaacctttacattatatccttcaaattaaaagcaaagtgccttaacagcgaagtaaaatcatgttccataggaataaatttcctccactcattatgaatacaggtatcagaaagattaaaatttacttctttctgtcattgacacaactactctgcttattcttgcttagttatttcagtacccatgacagtgttccagcacatagctgagtatgtgggacaaattcagaacacagaaattattatattaatgcatgaataaatgaatgaatagttgaagtgtaagttcctaggaagaaaggcaatgagataaatccactttttttccctcacataggccttgtttgaagacaataattacatggcctgaggccctctctttgagaatacttcatttttactcaaagaggtcttacctagtatgtaaacctcatttgtttgatccatttaacttcatcatttgggagatataatggttctcagacttgtaatattttgacggcatgaaacaaataatatttgatttgttacatctgaaggattataaggctaatgagtaagaataactcgatgctccacttcaggtgattcgtatgctataggagttagcaatctagttcttgtctttcgtttgaataaattaacaaatattcctagagtatctactgattacaaggcctgagccagacggaccttgttagggactcttgaacaagcagaactaaaagcatgatagacaaaaggtagaaatctaattaaaagcagttgagatgatgacacaagatcaattgaaataatctgcaaagcccagaatgaagttagacacttttcattttagtctgctgacaaaattaagcaatataacatcacaaaatattagatttgttaattatatatttgtctattttatgcttaagtgtatctacattaaatgttagattaaatgcaatgtggtgttagtattagaccctggagtaaagtcataggtgaaaaaccagtgaaagcaaatagtctgtagtttagttaatattctagcaatattaatttttttagttttgaaaaatggttataaaagatgttaacattcgggcaaactggataaagattacatggaatctcttttggctatttttgtaacttctgtaaattaaaaagtacttcaaaataaaattatttaaaattgtaattagaacaactctatattaaattttttcataaccctcattattgtgtgtgtgtgtgtatatatgtatatatgtatatatgtgtatatatgtatatatgtatatatgtgtatatatgtatatatgtatatatgtgtatatatgcatatatatgtatatatgtgtatatatgtatatatgtatatatgtatatgtatgtatatatgtatgtgtgtatatatatggttttgttttgttttttttttttttttttttgagacagagtctctctctgtcgcccaggctgaagtgtagtggcgctatctcggctcactgcaagctccgcctcccaggttcacgccattctcctgcctcagcctcctgagtagctgggactacaggcgcccactatcacgcccggctaattttttgtatttttagtagagacgaggtttcaccgtgttagccaggatggtctccatctcctgacctcgtgatccacccgcctcggcctcccaaaatgctgggattacaggcgtgagccactgcgcctggcctgttttaaaatatttttaaaaccaaattgtgagtcatgtcgatggcttatttgggactttattcaagactctttagtgccactgactttaatggtttgcccatacatcaaactgagcaaccctaaggaggcattctttcctcttcatggcagaagtagtagtattttccaacaatgacttctgccttaggtctgaatagtgtcctaaacattttgcctcatgttcattttagctgcacattttaaaggggacagtttccagttacacaatgtttcttttactatctggtaatgagagttataataaatacttcaggccctgaccacattttgtcagaggtaaatattatgctttcttttttgtttacagtacacaatgatcctcatcattttgagatatttctatatcaatctcccatttttttttttttagttgctgtgatcatttccccatgtatatgttatgtgaaagaaaagtatttgagattgtgttcactaacaagaaataggcattggaaaataagtacattgggctcaacactattctgacacaataggaaaacctagtaagatagtaatcttaatggcagcaaatgtcattaaattaaaaacatctacacagcaacaacctaatgttcatattaatgagaggtaggaacactgatagtaatcaacatctgttgctggtgttaatattcaacattaaagtaatccacagagggaaaatacaactactgcaggttaaatgacaactacagcttttctgattggtggttgtaagcagaaggtccagtagcagcaaagtaatcaagacggggttttcacatcatgtctttccaaataatcactgtcctaagtgaggagtagaagacactgtcacattgaggtattagtcagttttcacagtgccataaagaactgcgcagactgggtaatttataaaggaaagaggcttaattgattcacagttctacatggctggggaggccttagaaaacttataatcatggcaaaaggggaagcggaaacaagcaccttcttcacatggcaagcaggagagagaagaaagaaggaggaacttccaaacacttataaaaccgtcagctcttgtgggaactccctatcaggagagcggcaggagagaaacagccctgcatgatccaatcacttccctacttccacaatggggattacaaatgaagatgagatttgggtggcgacacagagccatatcgtatcaaagtatgaaaggtttctaggatttattagtttgggttgttaagagttatacggctggcaacgctgtgcagggccgtttacttcagctgcatacattttttcgctgcatgaggggttggggagagctactctcttctggtcctgaaaagtaatcaagagagagagggatttttcacatcgtgtcttaattctcacaaaggcacgcttcaaatgacggataaaaacccgtcttcccgactccaagaagctactttctgacagttgtaaacaagcttctttctcttactgcacaggagagtcctcttacagatctcagatcctgacattattttcaataaaactttgtgcggccgctagttttaaattcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgttgttcagaaaggtccgtgcgggtcccctcagcctggtccccttagcgctgacagctctggttcttctttgctcccctgtctctccactactgtcttcgtggcggccttttccttgcttggttttcccatagacttctccgcccctcctgtagtggcgctttgtcagtaagcggtgacagtggtgtgtgtacctggcgtggtttggacggttgtttgggggcaggggcagggtttgaagttctttagagacatagtgtgcacgtggtatgaggaactgggatacctgcctgctgtggcccaaatgttgtggtggttttttttcctttaatgtccacagcctgtttttatatatttctccttgagtgcgctgtttaaggtttttctaatggatttttatgaagacacgaaagcgtgtaattgatgtgccttcctgcagaacatttaggtcgatttttgtgtggtgtcggtcttaagaatcgtttccgtaaaaatttacaactgctttgaatttttattttttaaatcttatcctatcagtaatgctttttgaaacgttgcctgcgtcatatttggccattactttatttctaacgaccagagtaaaatactccttttaagtaaggctcctaaacccctgaatctgattaatctagagcaggaaaaaagtgttacatatttaatggaactgtagaaactctcctcgagtatatcagaatggtcaatatttcaactttcttgaaaaaaaaatcccatttgttttttataatagctatcctaaatgactagagatgtggattatgaatttaagaaattactccttaagttattttgattttaatagcctaagaggttaatacgtaagtcctttacctacaagaagttcttgatttagtgaaggaaacaggtaaacactaaatgcagcgtgagatttataaaggtgtaataatagagatataatcaaattgctgggagagccagcaaagtcagagaattgattagaggaatttggaaagacgttagaaaatatgacgtttaggtggatttatgataggaaaaacaaatgacattctaagtagaggaaaagcatgagcagaatggcatgtagaaatggcggtatttcatgtagtacagagcaaagaggaagagaggaagggttgagcaagtgaaaaggatacaggaaggaactaggcatggtaggtgagcctattgttcttgctacttgggaggctgaggtgggaggatcccttaaggccaggagttcaagaccagtctgggcaacatagcaagaccccatctttaaaacagtcggggtggtgtggtgcctgtagtcccagccatttgggaggctgaagtgggagaattgcttgagcccaggagtttgaggctgcagcaatgatagtgctatgatagtgccacggcactcgagcccaggcaccagaaccagaccctgtttcaaaaaaaagaaaataaaagataccagaagggtattttagtagctttggatatacagttgacccttcaagaacatgggggttagagatgcccccgccacagctgaaaatcttcatgtaactttcaactccccccacaaaacaactactaataatctgttggctggaagcctcactgataacataagccgtcagttgacacatataaaatatatatatagtatatactgtattcttaaattaagctagagaaaagaaacagttactaagaaagtcagaaagaagggaaaatatatttactgttcattaaatggaagtgaattgtaaaggtcttcatccttatagtcttcatgttgaatagactgaggaggaagaggaggagttggtcttgctctcttgggtggcagaggcagaaggggtgggggtggaggaggtggaaggggaggcaagagaggcagacacactatgtgtaactttatggaagtacatcataatttctgtcatgcttttgcttttctctttcccccaaaaaaatgtttctatagggtaccaatacctcttccaccatttgctttggtttcagtgcctcttcacagaagggtccatgtcataaaagaagtcaaaagcagtcctgaacaataggagctcttctgccagattatctaatgttcgtttttctggtagtttattctgtgttttcttccttgttatctggcactggatctgaagcactcatcaagctgtcttctgttaattcctctggtttggtggctgttagctcttgagtttcttcaagatccatatcttgaagtcctttacccactttcccgccgtttttggcatattcacagcctctttcatgatttccttgattggctcttttgtaaatcctgtgaaattataacacaacacaacacctggacaaagttttctccagcacgaacttactgtttggggcttatggctttcatggctttttcaataataatggcatcttcaattatgtaaacttcagattttcctgaagttttctctattagtgttcttttccatggttgacaatccttttcgtagaaaatcatgtttaatgagccttaaaggtccttgcgaccccgtgatctagaggctgatttacagacattgtgtttgggggcaaggacaccacttcagtgcctttgatgttgaactcatggggttctgggtagcggggaggtggggcactgtccattagcagaggaactttacaagtcagtctcgtattgggaaggtacttcctgacttcagggagaaagcatccatggaaccaatccagagaaaaggtttttgttctctaggccttcttatccaacaaagactggcagctgatgtttatctttccctttcaagattgaggggttagcagctttatagataaggacagtcctgattacaaacacaactgcatttgcacaatacagtagggttagcctatcccttcctggcttaaatcctggtgctcccttctcttccttactaatgtcttttgtagcatgttttccagaatagggtactttcatcagcattaacaacctgatttgggagatattctttcgtctcagtgattttcttaatggcatctgggaactcatctgctgcctcttagttggcagaacctgcttcacctgttatcttgatatttctaaagccaaagccaaacctatttcttcttttttttttttaaattatactttaagttctagggtacatgtacacagcgtgcaggtttgttacataggtatacatgtgccatgttggtttgctgcacccattaacttgtcatttacattgggtatttctcctaatgttatctctcacccagcccccaaccccatgacaggtcccagtgtgtgatgttccccccgtgtcccaagtgttctcattgttcagttcccacctatgagtgagaacatgtggtgtttggttttctgtccttgtgatagtttggtcagaatgatggtttccagctgcatccatgtcactcatcctttttatggctgcatagtattccatcgtgtatatgtgccacattttcttaatccagtctatcattgatggacatttgggttggttccaagtctttgctgttgtgaatagtgccacaataaacatacgtgtgcatgtgtctttatagtggcatgatttttaatcctttgggtatatatccagtaatgggatggctgggtcaaatggtatttctagttctagattcttgaggaatctagaactgtcttccacagtcaaacctccttctaaaattatcaaatcatcctttgctggcaattaattctttagctttagatccttcacattccttttgcttttaagttgtcatatggtaaccttactttttcttttattgtattagtctatgtttttaaaataggaatcctgcatctacataaaagttgcctttttaatacaagataaaaagttaattcacaaaaagtgcaaggttttcacaccttttggcatagctgctgcagtggcttcatgaatttttgtctttttttacactgattcttattctggattcatttatcttgagatagcaggccatcgcagctacagattttaatctgtggtagatatcaagcaattcatctttttatcgtagtgtcatgactttacttcttgggagcactgccagcatcactagtggcactttgtatgggttccatggtggtgttcaaggtttacagtgtagcgctgaacatgatgaaaaatgcaagagaactgtgagagattactttttactgacttataaaatgtactggcaagatgaactgctcatggggagacgattagcatcacatggccttttaagtggcaacttgggacacttgagatcccgggatagttacaggaggtaactacgaaattattacagtattccacgatgtactacagttaattttatgcagttatgatttaatactgcatttttacatttgcttacatttctcttgactgcaaatgctgccatgtaagatctgtaagtgtgtgtgtaagttttgataaattttaagtttttataatagatgtgtggccaggtgcagtagctcatgcctgtaattccagcactttgggaggccaaggcaagaggattgtttgtggccaggagtttgagaccagcctgggcaacatagcaaaaccccatctctagtttttaaaaattaagatagatatgtgtatattttatggaagtaaatgacaaaatagattagcatctatatattttttgcactcataacacacagcttttcttaattttttcaatatttccaatctatttgctttgtaagttttttcaaattgttgcaaagctcaaaaaatttttctaatatatttattgaaaaatatctgtatataagtggacacacgcagctcaaaccagtgttgttcaagggtcaactgtagtactaagaattttttactttatttcataagcatttttttttttgagacggagtctcgctctgtcgcccaggctagagtgcagtggcttgatctcggcccactgcaagctctgcctcccaggttcatgccattctcctgcctcagcctgcagagtagctgggactacaggcgcccgccaccacgcctggctagtttttttgtatttttagtagagacagggtttctccatgttagccaggatggtctcgatctcctgaactcgtgatccgcccaccttggcctcccagagtgctgggattacaggcatgagccactgcacttggctcataagcatttttttaatgcatggtttttgagtaaaggagaaacatgattagagatcagatcaatttcagaaaaatagttcaggcaacaagttggagaatgcaataaggaaaaaatgcctaaacactgaaaggagctcatgtggtgcaggtactagggcagtggtactggagagaagagagtagggctttgggaaaagaagcaggtgtagtctgaaagacttccatttgtgtagtctcaatgaatatgtaaaccatggttctgttactttagagaacattggaggaacagattttacctggggaagagtttggttttgttatgttaacatttatttttgaggtggctattattcaactgatatgtaagaacaagtttcatattggggaatttcaaatataagttaaatacacattctgctcacatttgctttatactattaaaagctttcatcctggtggaaatgtctgacagattggacatagaaaatatctcacctaggtgatggttattggtacaagcagaaattacccaggggagaaagtctagaatgaaaacagggccaagtcagaaaccctcaggataggtgggacaataattgataactgaaaaaactaaaagggacttaagagagataatcaaatgggaaagggggtcagatcggagatgtggaggtgagctaagaaaatgttatagaattggcatgtgaaaagctattaacgacttttttagaagaagttttagtggaagaaagaactagaaaaaggttctaaggtgatacacttttggtatacaaatattctttctcttttttttttaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaagtaagtaattactgaatgacttaaattttagaaaatcaaacccttctggaaattttttttttagttacaaaataaaaacttaattgttaatttgaagtaaattatttcctgtatttataaccaagcaaaagcctaaaatgtctcaactcataaaagactgatactaaagaatatttcagagttttaaaactttctgtccgtttcttttcccaatgtctatctgtattctttttgcacttcccctgtagaaaccgataattatctgaattcccactgttttcttctaaaattatctttgacaaccttttagaaaactttcagtcttaaccatgctactctaccccaccaccattagaaggcaagataaccactattaaccttttcttgacttttctaagacttttctgtgtgtttacacaaatgcaattatgtgcctaaaagtttagaatacaaaaatgagagtacagtattttacaatctgctatttttactttttttcacatgtcaaaattattcagaatacctgcataataaataactattttgtcatttgtctatttaggttattgttgatttttttttccgattataaccacagtgcagcattctgtgtagatactattttacatgtttgttcaattattattttgataaattcccagaagtagaattactaaaacatttgtactaattttttcttttatgagcagtttaagagtagccagatttgccttctataatgtaagtactctcatttgaggttagttttttaaaagctttgctatttggtggattttctttttttttttatagattcattttttcttttttttttgagacagagtctcattctgttgcctaggttgagtgtagtgggcactatcatagctcactgcagcctctacctttcaggctgaagtgatcctcccacctctgcctcccaagtagctgagactacgggtatgtgccaccatgcccagctaatttttaaatttttctttttttgtagaaatggggtcgtgctatggtgttcaggcttgtcttgaactcctggactcaagagatcctcctgcctccgcctcccaaagtgctgagattacaggcgtgagccaccacgcctggctttttctaccctatttgtattgtagcaataatctcttcatttcatggttgcaatattttagtttcgggttaaaatgacctttggtggttagcttagtaacttaaatcattacttaatgccattttagtgggatataatagtctaaaatgcaaagaaataattagggataattttagtttttttaaaccccgtgtttgaccatttaacatctgcgttaaccagagaattgattgctactcttctttgtaaaccattttgtgtgtatgtgtgtgtgtgtatatatacacacacacatacatacatatatatactttttttttggtagaattagtgcactgaaaggctccaaaggaaaagactgtgaaatccctgtgcctgtgggtatttcagtaactgatgaaaatggtaaaattataggtgagtgtactataactccaaaagttgtaaaaatgtgcacgttttctaaaatgaaacaatggaatagcttctcttgagtttcagaagattttttaactaacaattttagctactattctataagagagcatttttaaaacttataaaagttaaattgactgctagatttaagattgttttaaagatgttacagttcttacttggtcttaaaatatataactaggctcttttcaattgtttactgaagtgtttttctggggtcaaacttttaatagatttgtaaattggaatttcctggactgtttttctgaaagaacaatattacattaatgattctacttattaattatagatttgtaattgagaatttcctggcatgtatttttgaaagtaaaatattacattaatgatttcacttactaatctatagatttgtaattttgcatttctttgcctgtatttctgaaagaaatatattgcattagtgatttcacttattaatctttgctgtaagtatttctctccctctttttaaggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtagggtaagtatcgttcatatttttattattatactttcagagagagagttcttgaatagaaaataaatgtaaatggtaatttggggccataattatttctaatttatggaatttgtgtgttgtgtatgtacttggaaaatatgctgctaaatattattttcaaattgccaacacagagtttcatagttattgcttatttataaaattaagaccagagcaattgaatagatcagtgggaatgttagagaatgcataaagaaagaaaaatcaatcaaatgcaatattacaagatggttaaataatgttaccagatattaataataaatccaaacaaaccgtattattattaaaaatatatagaaggaaataaacagggaaaaatggttgacataactcttttgggtcttaatagagacattaaagtatcgttaatcaaatggctaaagaccagtacagacaatctcaatcctcagacttacgcactgttgccgccaaattgaatcctgctatgactgtatatccttcttgcctctgcttaggatctatctagtctcagcaatgtaggcctcacaagagtgtcctcttccaccagcctccattctttcattaaataatgctgtttagctgtggggtttgcagtgcagctgcccactggaaggggatagatagtaagatacagaatacataaaggaagagaaaacttcaatttgcatttgctctctctcccccatcccccctccctcctatcctctccctctggccctatcacagtattacacagttattcagatggaaagcttaaggacaagataaggaaaactgccttattactgtcctactccaaattcctagttctattttttgcttccccatagcttctttctaagttcttttcatgttcctcttcagtcatctcactgcttctttaccagactcttaagtctgtatccctcgtcttttgccctgcctgaccagccactagagcttaccaccattggtttagggttcacagaggccccattcctgctaaaattataacaaggaaagatgtgatcctggcttgccatttacatttatttttttcaataaagcacagttacaagagttattagatgtaagttctataatcctctatatttttaggaacattatgggcttaatagggtcttatggacaagactggcagtccagccaatcacagttgcattttgcataaacatgtgtttcaagttctgaagagacaactttacagtctaagaggagcctagcacggcttagtcataaaagtggagtggcatggaggactcaggttagactatttaggttaggatctcaaatcctctggaggctggccagctggtcttgggtaaattacacagcctctctaagcctttgttttctcttctttttttcttttcttttctctcattcttccttcactatagttttttgcttttcaccacgtcatttgttttctcatctttaatagtgtatggagataagtctttccttaaaatgttggtgggtaagataatgcatttacagcagaatacatgctttgcatttttgtacgttcaatgaattgtagctgctatcttcatcatcattatattgccaacttactggaaaactgcatataatgaaatactaggcttttcagaagtaggtttgaaatttgtctgtaattaaagcatcaagattcttaagcatatcaaacaagaatgggggaaaaagatttttaagtggaatgtttaacatattttctagtgtttttaaattaggcaactattcttgaagagttactactatgaatactagcataagtagatatccttttagctggttttggaaatggactgaatcacagaagaaagttattgtacaactaacagatttgtgctgctgttgtcagatctgatctttgcataggttggattttagcctgtaaaattttcactgggtacttttcaagaaaaatttcaaatatctgttattcagtcattagcatcatctttctattcatactttgatcttcttggaaatagttgcttgcattatgtgctcaatcattatgaaaatatgaggatgttggaaacaagcaagtccagctagtgataattatggataaaaacagctgcaatttgcttttcaaaagctataagaacctggatgaaacagggtatgaaaaaactatatgttccaggagaaacaagtcattaagaaacctcacataattttattttaaattcatgacagaaagatttttttaatgagggaaattgttgaaatacctccagctaatacgcttttataaaattccaaattaatatttgcagaatattccaccattattccaaatgaaagtttggcagagtttttgaagtaccgtcttcaaatttgaataagaactctgtgaaggcgggaatcattttgtctcattgctcagtatgttgcctgatacgaagtcagtgctcaataaatatttgttggataaatttaatgaaaatatatgaatgagatttagcaatgaatgttttaagtaacccccattcctagtactgtctttcatacatggtgggcctttcttgagggaaatttagcagtataatcaaagcctttaaaatgagcatgtattttatctggtatttcttcatgtagacatttattccaagaaagaaatcaaagatgtgtgcaaagagaagtcttagccagaacaatcaggcaagagaaaaaaagggcattcaaattggaaagaaggaagtcaaactatctgtttgcccaccatatgatcttataccttgaaaaccctagagactccttcaaaagactcctagatttgataaatgaattcagtatactctcaggttacaaaatcagtatacacaaatcaatagcactgctatacaccaacaacaaccaagctgagaattaaatcaagaactcaatcccttttacaatagctacaaaaaataaaataccaaagaatatacgtaaccaaggtcgagaaagatctctacaaggagaactacagaacactgctgaaagaaatcatagatgacacaaacaaatggaaatacatccaaagcaatcctaagcaaaatgaacaaatctagaggaatcatattacctgacttcaaattatattacaaggttatagtaaccaaaacagcatggtattgacagagaagtaggtacttagaccaatggaacagaatagagaacccagaaataaaaccaaatacttaagaccaactgatcgtcaacaaagcacacaaaaacataaactggggaaaggataccctattcaaaaaatgatgctgagaaaattggatatccaaatgtagaataatgaaactgcattcatatctctcattatatacgaaaattaagatagattaaagattttaatctaagacctgaaattataaaaattctacaacacttaggaaaaacccttctggacattggcctagacaaagaatctgtgactaagatctcaaaccaaatgcaacaaaaatacataagtgggacctaattaaagtaaaagtcttgtgcacagcaaaagaaagaatcaacagagtaaacagcctacagaatgggagaaagtatttgcaaactacgcatctaacagaggactaatatactgagtctgcaaggaactcagatcagcaaggaaaaaacaattccgttaaaaagtggacaaatgacatggacatttctcaaaagaagatatgcatacaaatggccaatacgcatataagaaaatgttcaacatcactaatactcagggaaatgcatattaaaaccacaatgatttaccaacttagctagaatggtcattatggaaaagtcaaaaaacaatacgtgctgacatagatgtggggaaaagagaactcatactttttttttttctttaacttaaaaaaattttttttattatgctttaagttctagggtatgcacaacatgcagctttcttacataggtatacatgcgccatgtcggtttgctgcacccatcaactcgtcatttacattaggcatatctcctaatgctatccctcccccagacccccaccccctgacaggccctggtgtgatgttccccaccatgtgtccatgtgttccttgttcagctcccacttaagagtgagaacatgcaatgtttggttttctttccttatggtagtttgctgagaatgatggtttccagcttcatccatgtccctgcaaaggacatgaactcatctttttttatggctgcataccattccatgatgtatatgtgccacgttttcttaattcagtctatcattgatggacatttgggttggttccaagtctttgctattgtgaatagtgccacaataaacatacgtgtgcatctgtctttatagcagcatgatttataatcgttcgggtatgtacccagtaatgggatggctgggtcaaatggtatttctagttctagatccttgaggaatcgccacgctgtcttccacaatggttgaactagtttacagtcccaccaacaatgtagaagtgttaactatttctccacatcctctccagcacctgttgtttcctgactttttaaggatcgccattctaactggtgtgagatggtatctccttgtggttttgatttgcatttgacggccagtgatgatgagcattttttcatatgtttgttggatgcataaatgtcttcttttgagaagtgtctgttcatatccttcgcccactttttgatggggttgtttgtttttttcttgtaaatttgcttgagtactttgtagattctggatattagccctttatcagatgagtagattgcaaacattttctcccattctgtaggttgcctgttcactccgatggtagtttcttttgctgtgcagaagctctttagtttaattagatcccatttgtcaattttgtcttttgttgccattgcttttggtgttttagacatgaagtccttgcccatgcctatgtcctgaatggtgttgcctgggtttccttctagggtttttatggttttacgactatcatttaagtctttaatccatcttgaattaatttttatgtaaggtgtaaggaagggatccagtttcagctttctacatatggctagccagttttcccagcaccatttattatatagagaatcctatccccatttcttgtttttgtcaggtttgtcaaagatcagatggttgaagatgtgtgttattatttctgagggctctggtctgtcctattggtctatatctctgttttggtaccagtaccatgctgttttggttactgtagccttgtagtatagtttgaagtcaggtagcatgatgtctccagctttgctttttggcttaggattgacttggcaatgggggctcttttttgtttccatacgaactttaaagtagttttttccaattctgtaaagaaagtcattggtagcttgatggggctggcattgaatctataaattaccttgggcagtatggccattttcatgatactgattcttcctatcgatgagcatggaatgttcttccatttgtttgtgtcctcttttatttcgttgagcagtggtttgtggttcttgaagaggtccttcacatcccttgtaagttggattcctagctattttattctctttgaagcaattgtgaatgggcgttcactcatgatttggctctctgtttatctgttattggtgtataagaatgcttgtgatttttggacattgattttgtatcctgagactttgctgaagttgcttatcagcttgagattctgggctgagacgatggtgttttctaaatatacaatcttgtcatcttcaaacagggacaatttgacttcctcttttcctaattgaataccctttatttctttctccttcctgattgccctggccagaacttccaatactatgttgaatagaagtggcgagagagggcatccctgtgttgtgctggttttcaaagggagtgcttccagtttttgtccattcagtaatgatattggctgtgggtttgtcataaatagctctcattattttgagatacgttccatcaatgctgaatttattgagtttttagcatgaagagctgttgaattttgtcaaaggccttttctgcatctattgagataatcatgtggtttttgtcattggttctgtttatatgctggattacatttattgctttgcgtatgttgaaccagccttgcatcccagggatgaagcccacttgatcatggtggataagctttttgatgtgctgctggattcagtttgccagtattttattgaggatttttgcatcaatgttcatcagggatattggtctaaaattctcttttttgttgtgtctcacaggctctggtatcaggatgatgctggcctcataaaatgagttagggaggattccctctttttctattgattggaatggtttcagaaggaatggtaccagctcctccttgtacctctggtagaatttggctgtgaatccgtctggtcctggactttttttggttggtaggctattaattattgcctcaatttcagagcctgttattggtctattcaggaatgcaacttcttcctggtttagtcttgggagggtatatgtgtcgaggaatttatccgtttcttctagattttctagtttatttgcatagaggtgtttatagtattgtctgatggtagtttgtatttctgtgggatcagtggtgatatcccctttataactttttattgcgtctatttgattcttctctcttttcctctttattagtcttgctagcggtctatcaattttgttgatcttttcaaaaaaccagctcctggattcattgattttttttgaagggttttttgtgtctctatttccttcatttctgctctgatcttagttatttcttgctttctgctagcttttgaatgtgtttgttcttgcttctctagttcttttaactgtgatgttagggtgtcaattttagatctttcctgctttctcttgtgggcatttagtgctataaatttccctctacacactgcttgaaatgtgtccctgagatactggtatgttgtatgtttgttctcattggtttcaaagaacatctttatttctgccttcatttcgttatgtacccagtagtcattcaggagcaggttattcagtttccatgtagttgagtgattttgagtgagtttctgaatcctgagttccaatttgattgcactgtggtctgagagacagttccttgtaatttctgttcttttacatttgctaaggagtgctttacttccaactatgtggtcaattttggattaagtgcggtgtggtgctgagaagaatgtatattctgttgatttggggtggagagttctgtagatgtctattaggtcctcatggtgcagagctgagttcaattcctggatatcctggttaactttctgtcttgttgatctgtctaatgttgacagtggggtgttaaagtctcccattattattgttttggagtctaagtctctttgtaggtctctaaggacttgctttatgaatctggttgctcctgtattgtgtgcatatgtatttaggatagttagctcttcttgttgaattgatccctttaccattatgtaatggccttctttgtctcttttgatctttgttggtttaaagtctgttttatcacagactagggttgcaacccctgccttttttttgttttccatttgcttgataaatcttcctctatccctttattttgagcctatgtgtgtctctgcatgtgagatgggtctcctaaatacagcacactcttgggtcttgactctttatccaatttgccagtctgtgtcttttagttggagcatttagcccatttacatttaaggttaatattgttatgtgtgaatttggtcctgtcattatgatgttagctggttattttgctcgttagttgatgcggtttgttcctagcgttggtggtctttacaatttggcatgtttttacagtggctggtaccggttgttcctttccatgtttagtgcttccttcaggagctcttgtagggcagggctggtgttgacaaaatctctcagcatttgcttgtctataaaggattttatttctccttcacttatgaatcttagtttggctggatatgaaattctgggttgaaaattcttttctttaagaatgttgaatattggcccccactctcttctggcttttagagtttctgccgagagatcagctgttagtgtgatgagcttccctttgtgggtaacccgacctttctctctggctgcccttaacattttttccttcatttcaactttggtgaatctgacaattatgtgtctttgagttgctctttttgaagaatacctttgtggtggtctctgtatttcctgaatttgaatgttggcctgccttgctaggttgaggaagttctcctggataatatcctgcagagtgttttctgacttggttccattctccccatcactttcaggtacaccaatcagacgtagatttggtcttttcacatagtcccatatttcttggaggctttgttcatttcgttttactcttttttctctaaaattctcttcttgcttcatttcattcatttaatcttcagtcactgataccctttcttccagttgatcaaatcagctactgaagcttgtgcattcgtcacatagttctcatgccatggtttgcagctccatcaggtcatttaagaacttctctgcattggctattctagttagccattcgtctaatcttttgtcaaggtttttagcttctttgtgatgggttccaacttcctcctttagctcggagaattctgatcatctgaagccttcttctctcaactcatcaaagtcattctctgtccagctttgttccattgctggggaggagctgcattcctttggagggggagaggtgctctgatttttagaattttcagcttttctgctctgtttttttccccatctttgtggttttatctacctttggtctttgatgatggtgacgtacagatgggtttttggtgtggatgtcctttctgtttgttagttttccttctaacagtcaggaccctcagctgcaggtctgtaggagtttgctggaggtccactccagaccgtttgcctgggtatcagcagcagaggctgcagaacagtgaatattgctgaacagcaaatgttgctgcctgatcgttcctctggaagcttcatctcaggggtacctggctatgtaaggtgtcagcctgcccttactgggggttgcctcccagttaggctactcggggatcagggacccacttgaggaggcagtctgtccgttctcagttctcaaactccgtgctgggagaactgctactgtcttcaaagctatcagacagggacatttaagtctgcagagatttctgctgccttttgtttggctatgccctgcccccggaggtggattctagaggcaagcagtccttgagctgtggtggactccacctagtttgagcttccaggtggctttgttacctactcaagcctcagcaatggcgggcacccctcccccgccagcctcactgccgccttgcagttcgatctcagactgctgtgctagcaatgagtgaagctccgtgagcgtgggaccctccaagccaggtgcggaatataatctcatgttgtgccatttgctaaggccattggaaaagtgcagtattagggtgggagtgacccgattttccaggtgctgtttgtcacagattcccttggctaggaaagggaattccctgaccccttgcatttcccaagtgaggcaatgccttgccctgctttggctcacactcagtgggctgcacccactgtcctgcacccactatccaacaagccccagtgagatgaacccagtacctcagttggaaatgcagaaatcacccatcttctgcatcgctcgcactgggagctgtagactggagccatttctatttggccatcttggaaccccacccctgatttttgctcattgattttgtgtcctgagactttgctgaagttgcttatcagcttaaggagattttggactgagactttggggttttctttttttttttttttttttttttttgagacggagtctcgctctgtcacccaggctggagtgcagtggcgggatctcggctcactgcaagctccgcctcccaggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccacctcggcctcccaaagtgctgggattacaggcgtgagccaccgcgcccggccggggttttctaaatatacaatcatgtcatctgccaacaggacaatttgactttctcttttcctaattgaataccctttatttctctctcttgcctgacggccctggccaaaacttccaacactgtgttgaataggagtggtaagagagggcatccctgtcttgtgccagttttcaaagggaatgcttccagtttttcttattccgtatgagattggctgtgggtttgtcataaatagcccttaatattttgagatacattctgttgatacctagtgttttgagagtttttagcatgaagcgctgttgaattttctcgaaggccttttctgcatctattgagataatcatgtggtttttgtcgttgcttctgtttatgtgatggattaggtttattgatttgtgtacattgaaccagccttgcatcccaaggatgaagccaacttgatcatggtggataagctttttgatgtgctgctgggttcggtttgccagtattttattgaggattttcgcattgatgttcgtcagggatattggcctagaattctctttttgttgttgttgttgttgttgtatctctgccaggctttggtatcaggatgatgctagcatcatggaatgagttagagaggattccctctttttctattgaatggaattgtttcagaaggaatggtaccagctcctctttgtacctctggtagaattgagctgtgaatccacctcgtcctggactttttttggttggtaagcaattaattattgcctcattttcaggacctgttactggtctattcagagattcaaattcttcctgttttagtcttgggagcatgtatgtgtccaggaatttatccatttcttctagattttctagtttatttgcatagaattgtttatagtattgtctgatggtaatttgtatttctgtgggatcagtagtgatatcccctttagcatttttttattgcgtctatttgattcttccctcatttcttctttattggttttgctagcggtctatttatattgtagattctttcaaaaaaaaaaaaaccagctcctggattcattgatttttttgaagggtattttgtgtctctatctctgtcatttctgctctgatcttagttatttcttgccttgtgctagctcttgaatgtgtttgctcctggttctctagttctttttattgtgatgttagggtgtccattttagatccttcctgctttctcttgtgggcatttagtgctataaatttccctctccacactgttttaagtgtgtcccagagattctgatacattatgtctgtgttctcattggtttcaaagaacatctttatttctgccttcatttcgttatgtacccagtagtcattcaggagcaggtttttcagtttccatgtagttgtgtggttttgagcgagtttcttaatcctgaattctaatttgattgcactgtggtctgagagacagtttcttgtgttttctgttcttttgcatttgctgaggagtgttttacttctcattatatggtcaattttagaataagtacgatatgctgagaagaatatatattctgtcgatttggggtggagagttctgttgatgtctattaggtctggttggtccagagctgagttcaagtccttgatatccttgttaaccttctgtctcgttgatctaatattgacagtggggtgttaaagtctcccattattattgtgtgggagtctaagtctctttgtagctctctaaggacttgctttatgaatctgggtgcttttgtattgggtgcatacctatttaggatagttagctcttcttgttgaattgatccctttaccattatgtaatggccttctttgtctcttttgatctttgttggtttaaagtctattttatcagagactaggattgcaacccctgcctttttttgttttccatttgcttggtagatcttcctctatccctttattttgagcctgtgtgtgtctttgcacatgagatgggtctcctgagtacagtacaccaatgggtcttgactctttatccagtttggcaatctgtgtcttttaattggggcatttagcccatttacatttaaggttgatattgttatgtgtaaatttgatcctgccattatgacgttagctggttattttgcccgttaattgatgcagtttcttcatagcgtcaatggtgtttacaatttggtatgtttttgcagtgtctggtgctagttgttcctttccatgtttagtgcttcctttagaagctcttgtaaggcaggcctggtgttgacaaaatctctcagcatttgcttgtctataaaggattttatttctccttcacttacgaatcttaatttggctggatatgaaattctggattgaaaattcttttctttaggaatgttgaatattggcccccactctcttctggcttgtagggtttctgccaagagatccactgttagtctgatgggcttccctttgtgggtaaccgtacctttctctctggctgcccttaatatttttttcttcatttcaactttggtgaatctgacaattatgtgtcttgcggttgctcttctcgaggagtatctttgtggtgttctccgtatttcctgaatttgaatgttggccgtctttgctaggttggggaagttctcctcaataatatcctgaagagtgttttctaacttggatccattctcccagtcactttcaggtacagtacactaatcagacatagatttggtcttttcacatagtcccatatttcttggaggctttgttcatttcttttcagttttttttcctctaattttgtcttctcgctttatttcattaatttaatcttcaatcactgatatccttcctttcttccacttgatccagtcggctattgaagcttgtgcgtgcgtcacgaagttctcgtgctgtggttttgaactccatgaggtcatttaaggacttctctacactgtttattctaattagccattcgtctaaccttttttgaaggtttttagcttctttgcaatggattagaacattctccttagctcagtgaagttttttattaccaaccttctgaagtctacttctgttaatttgtcaaactcattctccatccagttttgttccattgctggcgaggagctgcagtcctttggaggagaataggcactctggtttttggaattttcagcttttctgctctggtttctccccatctttgtggttttatctacctttggtctttgatgttggtgacctacgatgaggttttggtgtgcatgtgctttttgttgatgttgatgctattcctttctgtttgttagttttccttctaacagtcgggcttcttcgctgcaggtcttttggaggttgctggaggtccacttcagaccctgtttgcctaggaatcaccagcggaggctgcagaacagcaaatattgctgcctgatttttgctctggaagctttgtcctaaaggggcaaccccctgtatgaggtgtctcttggcccctactgggaggtgtctcccagttaggctactcgggggtcagggacccacttgaggaggcagtctgtcccttctcagagcttgaacaccatgctgggagaacgactctctcttcagagctgtcagacagggacgttaaggtctgccaaagctgtctgctgccattttttctgatatgccctgcccagagaggttggatctagagaggcagtaggccttgctgagatgtggtggactccacccatttcgagcttccaggcctctttgtttacactgtcagcacaaaaccgcctcctcaagcctcagcaattgcggatacccctccacctgccaagctgcagctcatggcaggtcaatctcagactgctgcgctagcagtgagcaaggctccgttggcttgggacctgctcagccaggcacgggaggatatttcctggtctgccgattgcaaagacttggggaaaagcgcagtatttaggcaggagtgtaccactcctccaggtacagactgtcacgacttcccttggctaggaaaggaaaatcccccgatcccttgtgcttcccgggtgaagcaacgccccaccctgctttggtttgccctccatgcactgcacccactgcccaacccgccacattgagatgaaccaggtacctcagttggaaatgcagaaatcacccatcttctgtgtcgatcttgctgggagctgtagaccagagctgttcctatttggccatcttggaacttaactcttacaaagacgtacagagtgttataatgggcattggagactcagagggaggaaggataggagggcagtgagggatgcaaaactacctattgggtacaatgtacactgcttgggtgatgggtacactaaaattcactgttgagtgagaatgcaaattagtacaacctatatggaaacagtatggagatttctcaaagaactgaaagtagaaatatcatttcatccagcaatcccactacaggatatctacccaaaggaaaagaagtcattatattaaaaagatacctgcacacatgtttatcacagtatcattcagaattgcaaagacatggaatcaaccttagtgcccatcaaccaatgaatgaagaaaattgagtgtgtgtgtgtgtgtgtgtgtgtatctatatatacacacacaccatagaatactactcagccataaaaaagaatgaggacatcttcctaagtgaagtaactcaggaacggaaatccaagtgccacatattgtcacttataagtgggagctaagctgtgcgtacacagaggcatgcagagtggtataatggacattggagactcggagggaggacaggaggatggggagggatgaaaaactatctgttgggtacaatgtacactacttgggtgatgggtacactaaaatcctggacttcaccattacacaatgtatccatgtaacaacaacaacaaaaaaatcacttgtacccctaaagctattgaaataaaaacattaaaagaaataggtcggacatggtggctcacacctgtaatcccagcactctgggaggccaaggtgggcagatcacgaggtcaggagattgagaccatcctggctaatatggtgaaaccccatctctactgaaaatacaaaaaaaattagccaggcattgtggcgggcgcctgtagtcccatctacttgggaggctgaggcaggagaatggcgtgaaccgggaggtggagcttgcagtgagccaagatcacgccactgcactccagcctgggcaacagagcgagactccatctcaatagataaataaataaataaataaataaataaataaataaatagatatgagctattaagctatgaaaagatgaaaaaagttgcaaaagtttaaagatagtcattgcattgtttaaagttattttaaaaaaacaaataatacacacttgtttgcataaagaaaaagttgtctatgaattccaccacccagagatgactattaacagtgtctgtctacctgtatacacattttttacaatgttgtttagagtgaaaaattgtagacaacctgaaagtctgtcaataggaaattagttaagtaaattacacttcaccattgaaaagtgttcaccttatatgattcagtttaaagagtaggccaagcaactataaagtagttttcccctacttccttcaaaaaaatatgaaaacttgaacattaagactctataaaaactgccaattttttgcagacaatagagggaaaaagagcatgttaagtgtccatgtaggtgctagtagaaaaatgaagactttggaaaagaaactctgtaggacaactgacccagtttctttaaaaataaaattgcagataggaaacaagatggtagggggagcttgaaaatagatttgagacacaccgggtatttgtaacgtacagaccttacttggatttctattcaaaccaaattttaagaagtatattgccaatgtattaatatttgttgaagctaggtgatagctaaatggaattcattacacctctctacttttgtatatgtttgaaactgtctataaaatttttttttaaagcagtttacaaaacaaggtaatgttttgtcagtgtatagctggagttagaaagttacaggtgtttttcttttttttctttaatttctgttttttctatgacttccaatgggtttttatttttaaatcataattggaataattattatacactttaaatattgaaacatcttcagtgtccagcatgaatttatctttaccttttatgtaagtgtatgttctcaagtttttcaagattatttataatacatttatattctacttttaatcccaaatatattcatgaagtctacttgaattgttaggaattcagagataataatattgacatttgtgtataattttatattcttgtttcagattcccaaatgctggaaaatcctctttgctaagttgtgtttctcatgcaaaacctgcaattgcagattacgcatgtaagtgtaatttgattgtacattttaatgagtggaggtaaacttttaaagactaatatttctctgagaatgaataaaatgataactcggagggtatccttaactgaaaaatttttggcagatagactactgttgcacaggccaaagtgcagttgcatgatcatggctcactgcagcccaggctcaagccatccccctgcatcagcctcccatgtagatgggactacaggtatgtgccaccatgcttggctaactttttttttttttttgtggggacaggggtttcgccatgttgcccaggctggtcttgaactcctaggctcaagtgatctcccaccttggccttctaaattgctgggttataggtgtgagccaccctccccagccatattttccattaatctttgaaacctctatacccctcagcaaagttgcttaaacaggttagacacttactttattgcatttatttttctgtcacagaatcgtttatttggtttagttaggattttatgaaccacttaccttttatcaggcactgtgataagtaccaggaaggtacttatcattcatttagcagatacttatttttggagccacattaggttctgggattacaaagactgataaacagaaacagctcctgttttgacttgtattgagtttgtagactagtggagtaaggcgtacatatcactaataaatataagggaatatgaaagggtactatgaaagagtatagatgactgctctaggcttccttaaggatgtgtgatttttggactgggatatgaggaataattatgaggtaattagtaaaatagagtggagggtgaagggtctttaatcagaggaaatagtatgtacacaaagccttagtggtggcagggagtagatttgtgtgtctagagaacatgaaataagggaaagaatcgagatgagcctggagatgtaagagagcatgtcacatagaccatttaggctgtatttgatttttatatcttaagagcaattggaagcatttaagcaagggataaaatgcttaggtttgctcctcacagagatctcggcctgtaatgtagaaaatggattggtgtgggacatgaagggtctgagacaaccagttagtaggctcttgtggtagctagatgagatataaaagaagctttggttaaaagtagtgagtatgataagatctctgccatcattaaaaggacacagaatgccattaacttggaaaataaaatcaagccattctaaaattagactgtgacgaagtagagtgaagtttggactaagtgctataaatcacaaggccaatatttgttataatatatgtaggacttgagaaggaagagcaaaaagtcataggaaagaggctagcgtaggattgatgaggcttaaggataacaatgagaaggaactagaggataactgaatgagaaggaactagaaaaatttcagccacagatccagtgatagaaacttaatatctgaccctcctgaacatctatcactcaccttaaagtgcaatagaagaacgttgaggttcagtaattacattaggcctatacagattataaaaatctgtgtttgtctttttccaaatactatttattcatttattttagagacagggtctagctatgtcacccaggcaggagtacagtggcatgatcatacctcactgtaactttgaactcctgggctcaagcaatcctcccacctcagcctctggagtagctaggactacaggtgcactgccatgtctgcctagttttacattttttgtagaaacagggtctcactatgctgcccaggctcatcttgaactcctagcttcaaatgatcctcctgccttggcttcccaaagcattgggattacagacatgagccacaacatttggccctccaagtacatattaaatagcaaagataataatagtttccattttagcaaattagaacaaaatctgaattgaaatattgtttatgcataataccaagacagttttgagagtaccagccctaaaataaattctagccttaatttattgctgtgtttccttttagttacaacattaaagcctgaacttggaaagataatgtacagtgatttcaaacaggtaggtatttttaaagtaaaacactatattagaagtcaaaagtacttggttttggtacgtacttggatattatagtttttgcctgtttctgtggtgttaggggagaaaaagtaacaagattttgtttatgctaagtgaaactggtcaaattaattctgagcactatcataatatatttaatttcttcttccaaagattaggtccagtttatccctacaacattatgtcttcttcttagccttagtttcttcttattgcaagtctttcttttactactatattggattatttatcttcattttttaaaaatgctctctaaagttcatggtaatgattttattccaacttttctttttttgagaaagaaaatgttttaatggagttttggtctcaaccagctattaaaattcattttttccttcacaagtaacaacagtggatcttctgtataattagaaaaaaactaaaaaaaggaaagtaacaatatttaaaatataatgtacaatctagtagttgtgctccttagcatttacccatgtacattgaaaagttatgcacacacagaagtctgcacatggatgcttatagcagctttatttgtaattaccaaaccttggccaagatatctttcagtaggtgaatgggtaaataaactgtgatatatatttagacagtggattattattcagctctaaaaagaactgggctatcaagcctcaaaaagacctaggggaaccttaaatgcgtaatactaagtgagagaagccaatctgaaaagactgtgtgatactgtatgattctaactatatgacattctggataaggcaaagctgtggagacagtaaaaaaaaaaaatgaatgatttccagggttagggaggaaggagagatgaataagcagagtacagagaacttttagggtacactataaagtacaatacatatagtaaagtatgatactatataatattacagcaacattgtgttgctgtaatggtagacacagtatacatttgttaaaatccatagaatgtacagcaccaagaatgcaacaatgtaaagtatagactttgggtgctaacgatgcatcaatatgggttcatacagttttatgacataatttaaagaaacataaaaaagtatttggttataatagtgataataacagtaaaagataaaaccagttataatatagaatgttaactgtaagtaaaattgtattaaatataggataatatgaatatatagaacaatatttagaggaaaagagaacatcatttataccgaatttttaagggaaatcagtagaggaaatttcaggacatgagacttctgttgtgcatgctgctttgtcagcttcctttaagaccctgaattatttatctacactgggcaagggatgtcgagtactgcctctcattctttattgcacttcagaattatctgggtggtctaagaacagcaatgatgagtgatgcttaggccccagagatttgaaactaaatctcttgggggtagggcctgggcatttgtagcttctaagagttccctacgtgattatgatgcacagtgaggtttgaaaagcacaagtggccgggtgtggtggcttacacctgtaatcccagcactttgggaggccaaggcaggcagatcacgaggttaggagatcgagaccatcctggctaacatggtgaaaccctgtctctactaaaaatacaaaaaaaaaaaaaaattagatgggtgtggtggtgggtgcctgtagtcccagctactccagaggctgaggcgggagaatggcgtgaacctgggaggtggagcttgcagtaagccaagattgccccactccactccaggctgggcgacagagcgagactctctcaaaaaaagaaaagaaaagcacaagtgtaaaatgatggttaataatgattattccctctaaaaggagtctaggaaactgtattcttttattatgttggtacaaaagtaactgtggttttggccattaaaagtaatggccaaaagtaggagaaagtaggagagccacaactacaacttgggtttgtcgagtgctgtttcacctgactgatcttacttgaatactggcacaaaatgagatgatgacaaggtgacaaggaagcatgctcaggtgaatgaacttctagatgatagaactctgctcctcatgtaatgccatgagatttgcttaagtataaacaataatgacctacaaaaatgtgaagcattaacaaacatggcactgcaaagaacaggtgaggagaatcacacctctattaatgtagtaaagtctcttaaaagtaatgccaaaaccacagttacttttataccaacctaatactttgtaagaatggtcgataatcctgctagtataatatgaacagaaaaggaacaattggtgccaaataaataattacaaattgaatttaaaatacagagctgtacctggtaaatgtctgctgaattaataacctcatagatttttacgaatttggagtataaaggttgaaattctgtgaaaagttcatattggacaataccatttaggaaattataaataaattttaaactagggattagtgtggtggctcacgcctgtaatcccagcactttgggaggctaaggtgagaggatcacttgaggataggagtttgagagcagcctgtgcaagatagcgagaccctgtctctactaaaatttttttagttaactgggcatggcggtacgcacctggagtcttagctacttgggagactgaggtgggaacatagcttgagcccaggagtttgaggctacagtgatctatggtcacaccactgcactccagcctgggtgacagagcaagatcctgtctctaaaataataataataaataaataaacaaatgttaaactaatctgtaaaattcctagattattagattaatagtaaatatgggactctaatatctgataacaaaattttaattcttaatactgtacattaattttactcttatacttggcttttcaaagatgtagtggtaatcataagttaggaactgtttatatttgaaatatcttaaaaattttgggatgtaattgaacttgcggttttcatacattttcctttttcattaaccatttaactttgtattagatatcagtagctgatcttccgggtttaatagaaggagcacatatgaacaaaggaatgggccacaaattcctcaagcatatagaaagaactagacaactactttttgttgtaagtcatatgtatactaatgtgatattcaaataaattgaaaaccagtgaatttagtttttctagaatttttttataaataagaaagtggtagcatatgttactccactaagtcttttataatatggggatggaagtgacattgtttactatatcatatgtaagtttggccatacttgccaacatgtatttccttaagatttccagcatactaccatattatatagtatcatagtatctctttcattcttcactgatgatgctagagttatatatgagattgtcttcatacaaattgtcttatcctagttttttattttattaataactgtaattttatcagaataattaaagttatcttaacacctcgatttctgttacttattttgaattactaagtaacaagtagagtatagagaaattgtttttagcttgagagagtaaaacattttaaaacatagaaatgtatagctattcttcgtatgttaaaggctgtctctttccttctcttttttttaggttgatatttctggatttcagctttcttctcacactcaatacaggacagcttttgaaaccataatactgcttacaaaagtaggttttctgttttactgtgttctgtatttggtctaatacataggaatgtaagactatatgaaataacataattacagtctatacatactccacctttaaagctttgatgtcagttaaagaattacttaaacttgttgtctccatttcctctacattcatttgctcctcaaactactgcagtggataaaacactcctgggcttccaaatccccattacatacttcccaggtttttatcttgcttcagctttggcacattgtttaattcctcttgtttctcattcttagttttgtgaccggtaatcttctggttctatttctactcttacactatttctccgtctactttttaggctcttttttctcatcctttaagtaacattattcagagttctgtcctaaccttattttctatcttactcactcccgttgctttagttacaattaataatattgatgactgccagatctgtagctgatacctaaatcttttcattgttctttctttttttttgagacagagtcttgctctgtctgccaggctgtagtgcagtggcatgatctcggctctctctgtctcccgggctcaagtgattctcctgcctcagcctcccgagtagctgggattacaagcgtgtgccaccacgcccggctaatttttgtatttttagtagagacagggtttcaccatgttggccaggctggtctcaaacacctgaccacaggtaatccacccaccttggcctcccagagtgttgggattacaggtgtgggccattgcacctggcctttgttgttctttagaccagatgcccatcggacatcttctttgactagatgtcccattagtcacttaaacttaatatggataaaagtaaacttttaaaaaacttttcggccatccccataacttagtgaatgtgtaagctatgatatactgattcttctcaccacctacacaagccctgtcagttttttatcctaaatctctctgaaatccatcctcttgtctttatctacgctgttataatcatcagcccttcttattggaatattgaatctggtcctttccattctccctgtgtcctgccttgcttctctccagtccattttttatatggcagctagagtgatctttgtaaaagcaccaagctgatgctgatgttccctgcctaaaacactttgatagacccccatagctgttaggttaaagtctaacctgagcatgatttatgaaatctgcaagtttaggcccctacctagcagtcctcctctgtaaccctctcccctagatgctatatttcagccatgtgatttctctctaagacaacatggtattgccttacctccaggattttatagatcctatttcatttgccactttttgtctataatgaataatactgctgtgaacatttgtatgcaggtttttgtatagacatgttttcatttctcttggatgtatacttaggagtggaattgctggatcagataataatgctttgtttaacattttgaggaactgccaaactattctgaattggtagcaccattgtgccattttacagtcccaccatcaatgtatgttccaatttttccacatgaatgtcaacacttgttattgtctgtcgtttttactttagtcatcctagtgggagtgcagtggtattttgttatagttcttatttgcatttctcttaagactaatgatgctaagaatctttttatgtgcttattaggcatttctgtgtctttggagaaaagtctgttcagattctgtgtgcattactatttgtattatttgtcttttaattgttgagttataagcatgttttgtatttttggaaataagtcccttctcttttttttttttttttttttttgagatggagtctcactctgtcgcctgggctggagtgcggtggcacagtctcggcttaatgcaacccccacctcccaagttcaagtgattctccagcctcagcctccccagtagctgggattacaggcatgtgccaccacgcccatctaatttttgtatttttagtagaaacagggtttcaccatgttggccaggctggtcttgaactcctgacctcaggtgatccgcccacctggcttcccagagtgctgggattacagacgtgagccaccatgcccagctggaaattaagtcccttctaagatacataatttgaaaatattttctccccttctgtgacttgtcttttcactttttcagtgtattttttctgtattctttgtggcacaaaactattatttatttatttaattttccagttttattaaagtgtaattgacataaaaattgtgtgtacttaaagtgtacaagtgatatttggatatatgtttaccttgtgaaatgattgaatcaagctaattaacatgatccatcatcttacatactattttatgtgtgttgagaatatttaaaatctgttttagcaattttcaaatatataatacattaactatagtcatcatactgtaaaatagatcttcagggcttattcatcctatttaattgaatctttgttccatttgaccaacacccctccatcttcctcccccaagcaccctggcaaccaccattttctctgctactatgaattcaaccttttaagattccacatataagtgggattatgcagtatttttttttctgtgcttggcttatttcacttagcatagtgttctccaggttcatccatgttgttataaacgacaagattttctttttttaaggctgaataatattcagttgtgtgtgtgtataccacattttcgttattcatccattgatggacactgaggttgattccatgtctcggctattgtgaataatgtttcagtaaaaatgggaatgcagagatctctttgacatactgattttatttcctttggatatatacccagaagtgggattgccggatcatatggtagttctatttttaattttttgagaaatctttatactgctttttacaatggctgtactaatttacattcccactcaacggtgttcaagagttcctctttctccatatccttgacaacacttgttatcttttgtctttttgataatagccatccttccaagtgtgaggagctatctcattgtggtttttcttttcatttccctaatgatcagtgatgttgaacattttttcatacatatattggtcatttgtttgttgttgagaaatgtcaattcaggttctttatccatttttaaatcaggtttatattacccaaagtgatctacggattcagcacaatccatatcaaaattctaatggcatttttcacagaaatagaaaacaaatcttaaaatttgtatggaacatcaaaagaccctgaatagccaaagcaatcttatcttgagcaaaaggaacaaagctggaagcttcacactacctaatttcaaaacctactacaaagctatcataatcaaaacagcgtggtactggcataacagtagacacataaaccaatggaacagaatccagagctcagaattaaatccatgcatttacagttaattttcgacaaaggtacctagaacacacagtaaggaaaggacagttttcttcgtcaataagtgatactgagaaaactgaatatccacatgcagagaaatgaaattagatccttacttcacaccatataaaaaatcagttcaaagttgattaaagacttaaagcctgaaaccataaaaccactagaagaaaacagagaagttccatgacatttgtctgagcaatgatttttttttaatgtgaccccaaagcacaggcaacaaaaagaaaaatagacaagtaggattgcatcaaactaaaaagcttctgcacagcaaaaggaacagtcagcagagtgaagaggcaaccaagggaatgggagaaaatatttgtaaatcatatatctgataagtggttgatatccaaaacataaggaagcaaaacaactctcaatagcaagaaaacaactcaaaatttttaattttcatgaaattccatttgtttcattcttttctttccttttttaaaattaaactaaaattttgtatagagatggggtctcgttatgttgtcaaggcttgtcttgaactcctgggcccaagcaatgctcctacctcagcctcctaaagtgctgagattacaggcatgagccaccatgcccagtcttacatatttatttatttttattacaaacagggcttcgctctgtcatgtaggctagagtgcagacatgatcctagctcattgtagcctcaaactcctggtggccttaagcagtcttctgccttttatctattattttacttgtgcttttcatgttatatctaagaaacagttgtttaatccaaggtaacaaagatttattcctaagtgcatttactttttccaagaatactacaggtataacattcagtgatcattactgacttctgaattttatctgtgtgaagtccagatacccatatttgactctagacgcaaaattacaactgtctctaggatatcatttaagctaaaacatactaacacatgacttaaccagagtcattttctgaaattcttccttttgttttctgttgttgggatttattgcatttcggtgatgtgaatgggttttagatcacctgggtcattaattaccaaataagtagtttatacagaaaccagtactaaaattattgggttttctcttttgatttaaaggagttggaattgtacaaagaggaacttcagacaaaacctgcactcttggcagttaataaaatggacttgccagatgcccaagataagttccatgaattgatgagccagctccagaatcctaaaggtaaacctatttattcatttaattctaatttaaagaataattacaatgtacagagaatgctgttataatcagtggaaaactgacagtttctgctcttaaaagtcaagtttgaagaaagaatatacaaaacatgtaaataacattgtaacataataattaccaaattctagaatgtttgatatggacagtaaattaaaggagacaaaagaaagattaatttgaactaaaaaggtcaggctacatgaagaataaaacttaaattgggcccataaggcatatgtgggatttgaataaaaggaggaaaaagtcagcatctacctgtgaagtctttcactttcattaacatacttcacaagctcttcattcgtctagtactgtacatcataaaattaaagacagaactaagaagttctaaagaagtatgtttcttggcaaaagtaactctataggtttctgaagaggatgagtcttctgaaaagaacttcatttttcctgtgtatgtgtgacacaataatagaagctgtgactccaaaatgatttatttgtctggaatttacttcctggactatatgtaaagtaacttaaagggattctccacagttttgaatattgacatttgcagaacaccttctatcctatggcaatggtggtttcattcagagtctagtagagaacctcatgcacaaatgaggaaaagtagggtgtatggtatgtggctaacatgtttttcaatatgtctctgtttttattcttggtaacaattgttggaaaatagattataggtactaagactgtcaaacagcaccagaaggtcctttcctctcaaaaatctttcccctgtgtaatctacatgttggagctgtccttgagttaataaattactcatgggatataaatattctctgatactaaatagccttcattcctaatgacatttgctttgtatggtcattagttctttttgctagttgatcttgcagagaagggaattttcagaggaaataccgaaagtgagggtgactcaggagtctgtagctgttctgacctatcgtgaaataaaatataggccctttagtgataatcctgagttatcctctctggactttcttcggggcttttgaatctcagaaagtaagctccatgttgtcttctccaccaatctgtttcagtccagcctttctagttcatatcagttaatccatctaatcagtatgccatctccccagccaatcagtatgccatggtgacagggaagaggtaaaagtaatataacaattgttagcccttgtggggtgatagattggactcatctgaaattatcttcccttgaattctctataatccctcttcagtttttgtatggatcctagcatcattgatgataaacctatactttggggaagttaaaggtctccagtgtactgaggccaagtagaatgtctcaaatcataaatgatgttattatttttacagaaagtatctttcagagaatcaatgctgccttgccttatttaaccccccccacacacacaaaatttattacttccttaagtaagtcatttttgtgattcatcttctactcatacttagtttggtttaaaatatatttatctaacaagtatgttatgtgccaagaaccttaccataatcaatggtaaaatccaaaggctctgagaacttattagaaaaggtgaaaaaaggcatgaaaaatgctggtgttggttccctgcttcacaaatcaaaccattaacatggttttaactaactttcgaaaacaatggaaatcagctttgtttgtgctctttcttttagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctcaaaaaacaaaatattgtacttcaaaaaattattcttcaatgctatttttaaattactagaaattattttggaatttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtacctttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatggtctgtgctagtaatcatatctaaagtggtaatgttaccatatgctgggtactgggctgagtaaatcacatattttaacttatttaaacactgcactgtattgcctgctagcgatgtcatttttttaaagttggatggtgaatacatgagttgttttttaaactcttttgggagcctaaaaaatttgaatttttttttttccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctaggactacaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtctccctctcgaaatatctttactgattatatgagatgataaaatgcctacatgataagatcatgtgaggtgaatgacgtaggcattgtaacgtacctggtgttaggctactgctgaccttctgtcaatacctcaggagaatattttgctttgatgatcctggatcattgagccatgttgttaggagcaggtgatatctatccatggtgaatgggagggtagcatatacaacgtggatacgccagataaagagttgagtcacctcctggcaggatggaatgagatttcctcatgttatttagaatagtgtgtatttctgaacttttccatttaatatttttggaccacagttgattgtaaataacaaactgaggatgggggaacggaggactgcagtaaatccaagtttataatacctcatcaaaaactcaacataaaagtttctatttaaaactgcgaaaaaaattagtggtgatggtaggagcgggtagtaggcatgaaaagagaaaaaaacaccttaatgcagttacaggcaaaagcctttacttatcctattaattggccaattcttttgtaaatcctcttcactctcttcttccttccccctcttcactaagtagctttattcaagaatcttagaagcaaatgtgctatcaaatttgatggtgcactacaaatttctaacagtttgtaaagtgacatctcactgtttaatttactcagaactttccttcctttattactttgctagggctgctgtaacaaagtacaacacactaggtggcttaaacaacagaaatttattatctcacattttcttgagcctggaaatccaagatcaaggtgttggcagggctgattgcatctgagggccatgagagagaatccggttcatgcctctagcctagcttctggtgatttgggaccagtttttggcatatcttgtcttgtagaagcatcatcccaatctctgccttcatctgtacatggtgttctctttgtgtgtgtggttgtcaccaaatttaccctttttataaggacaccagtcagattagggcccaccctaatgacattttaacttgattacctctataaagacattatctccaaataaggttggattctgaggtaatgttgattaggacttcaacatacagtttttgagggatacataaaacttaacacttccctatttgatgtggtttgaatgctccctccaaatctcatgttgaaatgtgattcccaatgtcggaggtgggctctggtgggaggtgattggatcatgggggcaaatccttcatgaatggcttagcactatccccttggtgatgaatgagttcttgctcagtttacatgagatccggttgtttaaaagaatctggaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggtgcctttagtcccagctacttgggaggctgaggcaggagaatggcgtgaacccgggaggcggagcttgcagtgagccgagatcccgccactgcactccagcctgggcgacagagcgagactccgtctcaaagaaaaaaaaaaaaaaaaaaaaaaagaatctggaacgtccccttctctctcttgttccctctctcaccatgtgacacgatggctccctgtcagcttccagcatgattgtaagcttcccgaggcctcaccagaagcagatgccagcactgtgcttcgtataaagcctgcagaagcccagcctcagatttttttaatagtaattcaagaacagactcactatttttccccttttcacttctcaactaatagtgataatatactttgcaattacattttccaattttgcaattaatagatgttatttttttatttcgcaggttttttctaaaaaagtatatggtgagtaatttttattaatctgtatttattgaatttcagtcatggacttggaaatactctggtgagatatgactaacaaaaagggaacagtatctgcaagttagtttacattttggagtttatgaattgtaaaaagcttagagaagacacaaatattcagagaagggtgaatgtatataagatttgggttaaaagaatagtgtaaggccattccaagttcaggaataccggacatgagcatttagagtaagtcttagagacagaaatctaaattaaggagattggcctgagtttatagagttctgagcaatgacagcaaccttttaagaaggtccaccacttaatacttcttgacgtggggcacattaattactctgtatctcagtttctctgctggtaatgtggagttactggaattaaataattgtgaaaaagagcccactgcttagtatgtaataaggttttctgttttaaatttaaaataataggctgggcgccatggctcacacctgtaaccacagcactttgggaggccaaggtgggcagatcactcgaagtcaggagtttgagaccagcctggccaacatggtaaaatcttatctctactaaaaatacaaaaattaaccaggcatggtggcacacacctgtaatcccagctactcagtagactgaggcaggagaatcgcttgaacccagaggcggaggttgctgtgagccaagattgcgccactgaactcctgcctgggtgacagagcaagactctgtctcaacaaaacaaaacaaaacaaaaatgttaaataataataaattattgggttttctagtattttaaattcaccattacttatggaaatttttgcacctatcttgatctaaggaggtgaggccttgaataaaattacgataattatttgtagtgaataaagggcaagtgggtatttcaaaggaagaatcaaaagaatgtttcctcagtaactgaccctaatgagttggagatacgtgagctctctaaccaagaattaaaagtagtagttttgaagaaactcagggatctccgagataacacagaaaaacaattcagaaacttatcaaatgtaacaaagatttaaatgttaaacaaatcttggaactgagaaatacattggctaaactgaaaaattcagcagagtggatcaagcagaagaatcagtgaactctggctatttgaaaatacacagaggagaaaaaagaaaacagtgaaaagccatgaagatcaccttttgggagtaaaatatgaggggaaaaaatcacctagaagatatagaaaattacctccaaagaccaaatctaagaattattggtgttcaagagtgagttgagcaagagcagggatagaaaacttattcaaagaaataataacaaaactagagaaagagataaatacccaggtaccggaaggttagggaacaccaaacagattcaatacaaagattaccacaaggcattaataatcaaactctccaaggtcaaggacaaagagaatcctaaaagcagcaaaataaaacaagcaaataacataaaggagttccagttcatctggcaacagacttctcaacaaaccatataggccaggagggagtgcaatgacattttcaaagtgctgaaagaaaaaaagcctgccatccaagtatactggaaccagaagtaatccttcaaatatgaaggagatatatgtcccttcccacactaccaccaaatccatcttacaagaaatgctgccgggcgcggtggctcacgcctgtaatcccagcactttgggaggccgaggccggtggatcacgaggtcaggagatcgagaccatcctggctaacatggtgaaaccccgtctctactaaaaatacaaaaaattagccgggcatggtggcgggcacctgtagtcccagctactcgggaggctgaggtaggagaatggcgtgaacccgggaggcggagcttgcagtgagccaagatcgtgccactgcactccagtctgggctacagagtgagactccgtctcaaaaaaaaaaaaaaaaaaaaaaagaaatgctgaaggaagttctgcaaaaaacactaaccatgcagaaaaaaaatccaacacatttgaagatataaaatccgctggtaaaattaagtacacagataaatccagaatatgctagtattgtaattatggtgtgcaatttatttataactctagtataaagcgcaaaagtcaactctatcaaaaacaataatagctacagcaacctgttaagaggtaggtaatataaaaataggtaaattgagataactaaaagtcaaaatatgtgggacatggagttaaagtgtacaagttttttttcactttttttgcaatctaagttgtcatctccttaaaataacattttttgtaagcctcatggtaatctcacacaacaatctatgatagatttattaaaaatgaaaaacaactaattaaaacatacaatgagagaaaatcatttaaccataaaggaagacaggaagaaagaaagagaggacttacaaaacaaccagaaaacaagcaaaaaaaaatggcagtacttatcaaataataactctgaatgtaaatagattcaattttccaatgaaaaggcatagaggggctgaatggatatgaaacaaagtatatgctgccacttcacctatgaggatacacatggtgaaagtgatggggtggaaaaagatattccatgtagctggaaaccaaaaaagaacaggagtagctattcttaaatcagataaaattgactacaaataaaagactgaaaagagacaaagaaggtcactatataatgataaagagatcaattcagcaagaggatataacattacaaatatctgcacccaacaccggaggtcccaaatatataaagcaaacattaatagatctaaagggagaaatggacaacaatacaataatagtaggggactgtaactccccactctcagtaatgaacagatcatccagacagaaaatcatcgaagcaacactggagtgaaactgcaaattaggccgaaaaatgtatctgatgaagccatattggctgccctggagcctccagaactgaaaaagagctgcaagtgtgtgctgctatgaacatctttccagagcctttcctgcacagctggtattggcatcataccaaaagcagtgtttatcaaactagagattaaaaatcaaaattcatttttgcgataatgacaaatgccctggacttacacacatgcactcgtgtgagacaaggcccataagtatccccaccttccctctcccagtactagttaattttgagtaattgtgtattgtcagaaaagtgatcagtattagtttttgttttgttgttccaaaaaaaattttattttttaatttaattttttgtttaaaagcaaggcatgctgtgttgactctgtaacagactaatttgaattgttaaaactgctccctggttctattctggagagtaatctgggacattttagtgagtttttccccctcttttttgggagggggagtatgggtggggtttgatttttagtcttgtttattttaattaaccaatggacagcccttaaggggaggaggacagattgattccacattccactttttagatctcatttagaaaacatgttctcaatctggtgctcttaggaagaagtatagtaaatgcttcatttaataatgtgctactttttgaaagttgccttttctctttacccttgaatagatccagtatctgatgatactcatgaaagtgcgtggaacctgtcttgtccctcctcttttctagtatgcactatatatgtgactgtgactttcaaagacatttatttgccatttcctgatttgggggaaaattaattcctaacttctttcactaatgaagaaaagtattgcacattggaaatacactaactggattgaatatgtaatttttttttttttgatatggagtctcgctctgttgccaggctggagtgcagtggcacaatcttggctcactgcaacctccacctcccgggttcaagcaattttcctgcctcagcctccccagtagctgagactacaggtgcatgccaccatgcccggctaatttttgtatttttagtagagatggggtttcaccatgttggccaggatggtctcgatctcttgacctcatgatccgcctgcctcggcctcccagaatatgtattttaaaataaatttttccctgtcagtcattgtcttatatccttagcatagatttgcaactcagtagtatattttatccctagaatgaagctggagacctggtatgtacaggaaatatgagaggtggtgctagaagacagacatctatggaatgatccatatcctttcaagttatgggaatgaagacctacttcattaagaagctgggggtgaagtgagggtgaggagaacacttaacaacattgggaccagtcagggaatccccttatttctgtttcacatatgaggaaccctagagcagctagatgaggctctctagtttaataaaatcatggaaagagtcttatgaaggctcttcataagtgttaacagggatttatcagcttatttttgttgcagttcccaatttctaaaaatgtttaggtaatcttttcctttccccaatcctaattcttatagattcactagtgttgaaccaatgctttctcatgtctcaactctatatatgcattcttttcagatgtattacattaaaaaagccctacacacacacacacacacacacacacacacacacacacacacacgactgaaccatgaagaaatagcctcaataaaccaataatgagtaaaaaaaaaagtctcccatcaataaataaaaaataagcccaggacctgatggcttcactgctgaattctactcaacatttcaagaactaacaccaattctactaaaactcttcaaaaagattgaagacgagagaaaacatccaaacccattttatgaagccagaattaccatgataccaaaaccagacaaggacagaatgaaacaagaaaactataggccgatatcactaatgaacatacatgtaaaaattctcaacaaattttgagatactagcaagccaaattcaacaatatgttaaagactgtgtgcagtggctcacgcctgtaatcccagcactttgggaggctgaggcaggaagaccgcttgaggtcaggagttcaagactagcctggccaacatggcgaaaacccatctctactaaaatacaaaaatcagatgtgcatggtggcgcatgcctgtaatcccagctactcaggaggctaaggcaggagaaccgcttgaaccagggaggtggaggttgcaatgagccaagatcatgccactgcactccagcctggatgacagagcaagactctttctcaaacaaaacattataaagatcattcaccataatcaagtgagattcattacagggatgcaaggatggttcaacatatgcaaatcaataaatgtgatatatcacattaacagaaccaagaacaaaaacaatatgattatttaaatagatgctaaacaagcacttgataaaatccacatcgctttttgataaaaaaaaaaccctcatcaaattgggtatagaaggaacatacctcaaaataataaaggccatctatgacaaacccatagctaacattatactgaacagggaaatactgaaggccttttctctaagatctagaacatgacaaggattcccactttcaccacttttattcaatatagtactggaagtcctagccagagcaattacgtaaaagaaagaaagagcatctaaattggaaaggaagaagtcgaattagccttgtttacagatgacatgatgttttacttagaaaaatccaccaaaaaactattagaactgataaacaaatttagtaaagatgcaagatacaaaattaacatacaaaaatcagtagcatgtatatatgccaaaagcaaacaattgaaaaataaatcaagaatgaaattttatttataatagctccaaagaatataaaacacctagcaattaatttaaccaaagatgtgaaagatccacacaaggaagactataaaacactgatgaaagaaattgaagaggacacacaaaaaatggaaagatattccatgttcatggattgaaaaattaatattgtgagcatgacactaaccttggctattgacagattcagtgcaatccctttcaaaatactaatgacatttttcacagaaattttaaaaaattctaaaatatatatgaaaccacgaaagaccctaaatagccaaagcaatcctgagcaaaaagaccgcagctggagatatcacactacctgacttcaaaatttactataaaggcatagtaatcaacacagcatggtactggcttaaaaaacagacacagaggccaatggaacagaataaagaatgcagatataaacccatgcatttacagccagttcatctttgacaaaggcaccaagaacatacaatggggaaaggacagtctcttcaataaatgatgccagaaaattggatatccatatgttgaagaatgaaactagacctctatctctcacaatacacaaaaatcaaatataaatggattaaagacttaaacctaaaacctgaaactatgaaactactagaagaaaacattggagaaaccctccaggacattgtctgggcaaggattttttgtgtaagaccttaaaagcacaagcaatgaaagcaaaaataaataggattatatcaagctaaaaagctctgcacaggaaaagaaacaatcaacaaagtgaagagacaacacacagaatgggaaaaaatatttgtgatctacctatctgacaagggattaataacgagaacatataaggagctcaaacaatagcaaacacacatacacacacacaaataacctgattaaaatatgggcaaaagatctgaatagacatttctcaaaagaagacatgcaaatggccaacaggtatatgaaaaaatgctcaacatcactactcattagagaaatgcaaatcaaaactacaatatccctccccagttaaaatgacttttatctaaaaggcaataatagatgctggcaaggatgaggcaaaagggaaactcttgtacactgttgatggggatgcaaattagtacagccattgtggagaatagtatagaggtttccaaaaaacctaaaaatagtactaccatataatccagcagtttcactactgggtgtatatccaaaagaaaggaaatcaatatattggaaaaacaatacacttatgtatattgtagcactattcacaatggtcaaaatatgaaatcaacctaaatgcccatcagtggatgaatggataaagaaaatgtgctatatttacacgatggaacattattcaactattacaaaagaatgaaatcctgtcttttgcagcaacatggatggaactagaagtcattatgttacgtgaaataagccaagcacagaaagacaaataacacatgttttcactcatgtgggacataaaaaagtgaatctcatgaaaatagagagtaggctggtggtcatcagagaccgggaagggtagggtggaagaggggtttgaaaagaagttgattgatgggtacaaatatatggtttgatagaagaactgagaactaatgttatattagtatggtgactatagtttacagtaatgtgttgtatatctcaaaatagctagaagagaattcaaatggttttagcataaagcaaagacaaatatttaaggtgatgaatatcccaagtacactgatttgatctttacaaattatatgaatgtattatatgatcatatctacttctaaacactatgaacatctatcacacattagtaaaaaaggggaaaaacccctgctgacatcctgattttagcacagtgagacctgtgtcagatttttgacctccagaattgtaagataataaatttattgtgttttaagcctttgaatttgtggtaatttgtcacagcagcaatagaaatctaacacagtgaccaaatgggaatctctgtagaattttggtggtgaatggtacactgcagtgaatttaagatttgactttctccttgaagaatctctaatgagaaaaagaggaaagacaggattgttaattgcagatctaaattcttatctaaagtatttttgagaattatattccaattatctaactattgaactccaacagggtatttaagtattctgttccatctttgctatgccagaggcaggcattttagaccccagcttgaacagtaagtctaggaatagggttgtctttccttcctttttgtgctgtgattttttaaaattattgtaatcaattgcaagtacctcccagctaaagtcctctaatcaggcagtattcatcagtgattgggaaataagttataagatgattttgtacatagttatttgattcaattcagctttatagatgagagaactgaagttcagaggaaataagtgattatcgtttgtcacattgctattatccatctgctattgccagagctggcctggagcccagaaatcttttcaccacccaatgctatctttcttcctcattattacatttcccagtctggctttgggatcggattgcttctggccttagataaccttatccatcctctaaagcagtatcacacataagaaggaggtagcagtggactgatagtagcctctctaccctccctttttaaaaagtctctgacaaatagtctcattgttactagagcaacgcaaaatggaaaatgctaatagcaaacatatagtccttattatgcgtcagatactgttgtaactgtctctgtagtaattcatttaatcctcatcacaattttctgatgtagatatactgttacagatgagaccttgaggcacaaaggggttaccttacttgccaaggttatacttacttgggatgggtgccatccttttgtataaactatgatactttttcttctttttattttgaaaaatttctaagatacagagaatttgaaagaatagtacaagagacacccacaaacatattcttcatgaatccaacaattatacactttgccacactttatatccatttgtgtgtgtgtatgtgtgtgtgtatgtgtgatcatttcgaagtagtaggcatcacaacacttcagcatcctttattttttaaaaaatcagatcattgctatttaggactttggaatcttttagtttaattcagatattcattcactaatgcaggacttcacattggagagaagccaacagagaaagggacaggacagtagaaattgtgtgggagagtaaaattagttcaaatatctaatagctagctatactgtactttagctatattaggtccctcagttttcaagacaacagtatgatgtgggtgatcttatccccatttttccagataacctccagatgtagagataactttcccagggccacccaatcaatacacagcaaagccccatacaaatctgggctgtttggttctagactttgagctctttttctactttttgcctagataaacactttgaggggaaaaaaaatccagatttaagaatttttgctaaccttcctacgggcaagtcaccttcaagtcacctgggtacttaggtatccaactcaaaactacttttagttttgtttcgttttgccttttttttttctttaaccgataacccaattctagacggaacataaggtgcaagagaaatccggggaggtggaggcagagaaagggaagggcaggaggtggtcgcaggatgttgcctgcggctggcggcccagtggattctgggaattgtagtcccagccatccagggcattgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggtaggtgtggtcaagatgttccgatttctgggtcttttgcataagtaactgaggattttatgtaaaatggctaaatccaggagaatcaggagcgttggaaaacgctgaccacatctgtggatgtgaaaattgagtaggtatttggtaaggctttaaaaaattattttgtacacaggagtatggaaatgtcgaggtgtgttgccggagccgccaaggactgggagctttgctggcgcgggtttgtgggggagcccaagctgctatttttgaataaccagctgatgctggttgcgtaatgatgacctgcttgcggttcaaacccactcagtgttgcagggatgggctagctctgagagcgttaacagtcactgttgcggtctctctccattggctctaactagtagggcgttttcttccttctgccaggtctgggtctaccacacacagggctcttcgaaaagagggaggaggagaggaggcggaggggggaggaggggggcggagggggatgcggattgctctggaagcttggtttgctttcctgtaagttctgtgcacccggccttgtaaggggcccatagccacgttagggaaaggtcagacttggtgacctcacttaaaatgattgctcaaggattctattgtgcgttattaattgtaaaacgatttcctctgactttggagtgtgcaattatgattgataccaacccaagaaacacatttggggcgggggaggggttgggggggacttgactgaaatctccgagcagccagttgcagagagcattctacataatgatcgtaatagggctagtgatgaacgcctcaatccaggaaactctcaggcgcacataataatgagtttccattctcatcctacctgtttgagataaatggtatttgaagaggaagtggctaatgtttaaagtagatatatagaagcatctttaagtatcaggttgagccattggtggaactattttttttttaagcattctggttgcaaatttcaggatgcagaattcagatcaactttgtctggtcttgttgtcagtgtccttttttaaaaatgtaaaagaaaatttcttttacttccaagacaactgcacagtctttcaccaccttccttatcctttcaccgtagtcatgaaaatgatctaaaacattcattaaatatcaatcatatattcccaagacagcaaagtgtttttcatcctcatttctcctatattctcaagtcacaagatgagttaatttttttcttctatttctacgtatttttctatattctatatatttctcatatataatgcatgaattaaggaataaacagcctttttatttttttttttttattatttgagacagatcattgctatgtcatccaggctggagtgcagtggcatgatcatgactcactgtgtcctcaaactcctgggctcaagtgatccttccatgtcagcctcccaagaaactgggacaacacgtgtgcaccatcacacctggctaattattattattattattttttgagccagaatctctctctgtcaccaacactggagtgcagtggtgcaatctcagctcacggtaacctccacctcccaggttcaagcggttcttgtgccttaacctcccacatggctgggactataggcatgagccaccatgcccagctaatttttgtatttttaggagagatggggttttgccatgttggccaggctggtcttgaactcgggctcaagtgatcatcccgcctcagcttcccaaagtgttgggattacaggtgtaagccactgtgcccctgctaaactgcctttttaaaaaacttactgtctgccctttttagtataacatttcattggttttaggtgattactaatcatttcttctaatccatgggaattcaagcagggtttttagagaagtactatgttaatttggagtatttttcctatttctttaggctcagattattgctactctgtattcagatcttcatgtgtctcttctaagctgaataaagctgttttggaactgtcaggtacctcaaagcgtaagtacgtcctttaattatatcttatttccctccctcctgctaccacatctgccaacaatgactctttttttttctcttgttcaacaaaatagaggtataggacagacctctcttgtgagtacaatgactgatgacttacagtttctaagaaaacccaaattataggtagaaggaactctcaatgttaccatcaagaattaagttagggctgggcatggtggctcagccctgtaaccctagcgctttgagaggctgaggtggaaggatcccttgagcccaggagtttgagaccatcctgggcaacatagcgagatcctgactgtatgagaaaattttaaaaaattagccagttgtggtggtacatgcctatagtcccagctactctggaagctgaggtgggaggattgcttgagcctcggaggtcgaggctgcagtgagccatgattgcaccactgtgctccagcctgggtgagaaagcgagaccctgtctcaaaaaaatagaagctagctgctattagacatatgtactctcgtaactcttgtaactataactcagaattgtgcctggaaaaaatagtacagggtctattggatacatgacttcctaaagctcttagccactgttcctgctccagccttctttaaattctattcaaaaccacagaaaatatataatttgaaaatatttttattcgtaattatgtctctgataacatttaattgtgtatcaaattttatctacttttctgagtcacggtggaacagagagtcaaatgacaaatgtgaagtggttatttgaaatagagtctctatttgatttggtcagtatctccaaagagaatgttctgtccttcttgttatatgactataaccatctgtagtcatttgctgagggtccagaagaaaagtatgtttctagctgaaaaaagtaaataagcctgctaataatcattactgacttacatttctgaccatattctggtttacaaaggactttgctattcatgattttactactttgtgggacactttacagatgaaaaattggaggttcagaggacataagtgacttgtccagtttgtaaatgataggttatgaatgttattcaggtctttggtctcctggacaacaataccaagcagcctcctggatggaaacaacaaaccacttatgtgtatgtatgacctagctcaaagctctcatccagctagtactcatgactgcttgacagatttgttaaagtgttcttagccttgcacgttttccacagtccctaattagggattttcacatggcaaaaagatgtttttttttctccattaaaaaaactatatattgtttagctttaataaatattaatttgatatattaaccactcttaagagaagtatgtctaattcatgacatacctgttaagttgaaaacagaaaaatcaataccggaacagtggactttttgtttttgaaatggagtctcggggtttcaccatattggccaggctagtctcaaactcctgacctcgtgatccacccacctcggcctcccaaagtgctgggattacaggcatgagccaccacgccgcgccaggaataattgactttcaaaccatttgttgaagttagacagtgttgctaaacctagatatatatttctagaatcatagtctgcatgtaggtacctaaggatggccttgtctttgctaatcacaggtttctggggtaagaaaatgaatgttgttttgtaaaatgggagtcttttggccaaaaaggagaaagcaggggcacagtctagaaacagtctggatgtatcagaacacagggtggtgtgaattctctcaaatgaagtgaatggaactgagactaaatttctgtctgtattctgaccagagttatacagaacctccatttgtttgttcattcattcagcaaataatcgagtgccttttatgtgccagtatagggaacagtgaacaaaacaaagggatctctgtccctggaattcacagtctgatgggaaagaaaactacactgaacaaggagttataagaatgatcactgctacagaagaaaaagtgcaaaagtgctaccacagcatataaccagggacagggggaggtttaggacaagcctccctggacactagaagaatgagtaaatattagccaagcaaagaataggttggaattaagaaagttctaggagaaagaccatgagggaaggcccttaaccaaatcagaaagtggaaaatttgggaagtcaaaagaaatgtggtttggctgcatagactgtagtgtgtggggtgggagagtggcacatacgaaggttgagaatttggtaggaatcaggtggtgtaagctatggggaggagttgaaactttagagattttattctgtgggaaatgggaacttattgaatggtaagaaatggaatggcggatgaggtttgcatttgaaaaaaattattgtggattaaaactaattgacacagcacaagagtagaggtctttttacccttgcaagtatgaacaaatcctaatcgggaagtcagcattatctttgttttaaaacatcaaacatattctttccccaaactatcctataaaattttacttcaggcatggtggcttacttttgtaatcccagccctttgaaaggtggaggtggggggattgcttgagcccaagagttcaagaccagcctgggcaacacagcaagaccccatctctagggaaaacttaaaaattagtctggcatggtggcatgcacctgttatcccagctactcaggaggctgaggcaggaggattacttgagcccaggatctcagctcactgaaatctagtgagctgtgatcatgccctgcactccagcttgggtgatagagtaagaccctgtcttaaaagaaattactttatctctctggtgggatatatgacttatcaaatcataggcatttgaaattaagaacagggcatacaaggtgaagtagccaaaagaagctagacattaattccagtatcaggccaaaatttagcttaagaattaaggttaatagtacttcccttctgaaaaagtgccgtggtatccttgttgactctgtatagataggcctctgtccatccctgagatctgagctaagaatgcttcatcaaaggcaatttcagagaaccaatataatatttgtattgatttgatgcagaatatagttaaaagcacttactactgaaatatatattgtcgtacctctcttcattaatgtcatttgatagtctataggctaagaattataggaatttatttatttttcttaataattaatttttcttttttttgtagagatggggtctcgctatgttgcccaatctggtctcaaactcctgggctcaagctatcctcccaccgcagcctccccaagtgctggaattacaggcatgagccacagcacctggcctggaatttattaataatggagttatacatcctgatcttgtttctcactccatttacatttcaggaatcagtgttacagggcagtttgattggagaaatctcaattacattgaaattccaattatttctatactacttttgttttttgttcctgtttgtttgtttgtttgtttgttttgagacagagtctcgtgctctgtcacccagactggagtgcagtggtgtgatctggctcactgcaacctccacctcctgggttcaagcgattctcctgcctcagcctcttgagtagcagggattacaggcacgtgccaccatgcctggctagtttttgtatttttagtagagatggggtttcaccatgttgaccaggctggtctgaaactcctgacctcaagtgatctaccagccttggcctcccaaagtgctgggatttcaggcatgagccaattcgcccagccagtatattacttctgaaagcaagaaggaattgtgattgcattaggactttgagtgggttatctgaagacttctgaagcttgaaagaaacgagggaacctttttcctatgtcttcacaactttaatcaaatccttattctccttcatttctcagtctttaactcctgcctgataaatttttatgaacaggtaccttattcactttgcttaacacctaacaataatcacttgatacgtagtaattatacagttgattcaccaccaacactttgagtttacataagacagccgtttctttccacaagtctctataaacacattgggagcaaggtccagttatcagtggtcttggtgtctttccagggcctaacagagtgttttgcatatgctagacactcagcatgatgtaagtacttgctgaatgaatgattgcttcttagtaatagctacttccttgtacagttcttcattaccagtggcccacctttgtgagttactggggtctttgtacagagcccaatactcgtttattcaaataatcctagaatcacttgtgtgccaggcacacaagttgtatgggggagatagacagatgaataagcaaagaccaccagagagctgtatcctagagcttggcatttctagtagctttttccagtgcaaacattctcaaatctgtactagtttccattgctgtactgaggtgtttggttgccacaattaagcaagacagctttttcccaatttgcttgaaaaaaatactgtaattagtctctccctttcataaaattttcttaagaaattgctacttctgataatactgacagaaggtaacataataaatactaaactaatactaatggaaaaacttagaactaaccatgtttaacttgagggctttaaaaatggttacttgtgcttaaactctgatttttatattgtacatttatatatgctatttgtgtatatttgaatatatgtatgtacacataggcatttttttggttagtaaaattattctggctgggcgcagttgctcatgactataatcccagcttgtaatttcagcacttttggaggccaaggcagcaagattgcttgaggccaggagttcgagaccagcctggccaacatggtgaaaccatgtctctaaaagaaagaaaagaagaaagggaataagaattgtgggggtggaaggaggagggctggttcacacctgtaatctcagtactttgggaggctgacgctggtggattgcttgagcccaggagttcgagaccagcctaggcaacatgagaaaaccccgtctctacaaaaaatacaaaaattagctgaacatagtgacgtgtgcttatggtcccagctactcaggaggctgaggtgggaggatcgcttgagcctggaaggtcaaggctgcagtgagccatgattgtgtcattgcactctagcctgggcaacagagtaagacttgtttcaaaaaaaaaagaaagaaaaagaaaaaattattcctatattatatgactagattaaatatacaaataacattgttttctaaagaacattgtgccctcccactggaattcatgcaacaatcacattctaagccagcttcctagcattttggtcataattgtctttctgatcctgaaagcttggaaacacaacttcaccatcccagcagatgtttgattctgcaaaggttgatggaactgtattcagaaataaaaattattctcaaccttgccccttcatcatgctctgaacaaaaaagtaaaccttactgaagtagtctgctctattgcctcatagtaggcattatagaaggcagagaaaatacatttgagtcctgctttgagagtgaatatcagacccttgaggaaattaaagctgaataagatgcaagctttttatagtttgccatatacagaaaaagaacatggccttttaatttggaatgaaaggcctggcgactgtttttcttataatagcattaatagaaataggttgtcgttacttgaaaaatgtttgcattcgtcttatatgaacagtagtagtaataaccaacaagtgctgtagatttccctgaaaatctacatcttgaatcaacaaggaagtaattgggtcatgttgaatcaacaaggaagtaattaagcagaataatttcagggaccattgttctcatcttttcatttgactgactcattggagatgagctcatttactttttataatttcctagtgtgcctagtacataggaatgagatcagtttgttttttcttatttaacattcattcaatgaatgttctttgaactcctgtgatgtgccaagcagtgagctgggtcactgaatgctaagaagtagttaacacttggcatagcatttgttgtgttctagacatgttttaagcacttgacattatattatctcattgaacccatagaacaaccctgcaaggttggcactgttattttttccatttcacagatgaagaaaacgaggcacagggaagttctgaatctggcccaaggtcagtgagctagtaagtgaggagatggggattagaattcaagcaaccttgctaagagttgactctcaaccattcccctgtcctgtactgcttctttccctacacctttgctttttatgagccaccttcacccctgctgcatgagcatttgaggctgaatttgtggtgtttgtagctaactgatgattgatgagtgggcccttgctgtgtgagtgcctgacacatacagagtgcttgatgtatatgtgttgaaagaacgattattgacaaaaagaagattgaaggtgtgattgtaagagactttaacattatcttggttgtttttttaattgtgaagaaaaataccgatggctaaagattttagttgctctatgacccagtcagtaataaccaaatgtgtgtgcacctgtgctctgaggtcacacacacctgcatgtatatacatttgtactgtacagagaggaaacaagggagagactttccctctttgcattgacatttcatcattagatgtgttgccagttggcaccacccttcctgctctgttctgctattgtcccctcatgatttgtcctcttgtgtgtcaccccctagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaagtttctgcttctgtttttttcctcagtgttttaaggtgaaatattttgagaaatgtttctcagatatatgtaaattgaaaaagacagttccatttaaagctctaaaacgtgtgaactggaaggctgggtgcagtggctcacgcctgtaatcccagcactttggggggccaaggcaggcggatcacttgaggtcaggcccttgagatcatcctggccaacgtggtgaaaccctgtctctactaaaaatacaaaaaattagccaggcatggtggtgtgcacctgtaatcccagctactcgagtggctgaggcacgagaattgcttgaacatgggaggtgaaggttgcagtgagctgagatcatgccactgcattccagcctgggtgacagagactttgtctcagaaaaaggaactagaaaggaattggaaaacatggaacttttattccacaagtgccaagacgttttatccatttctaagagtagtccaagtagtcctgtggtcctaacagttcactgggcttttttttttctccttttcttttttttttaaacagtctgcaaagagacaagttgtgggccagatttgcctcatcaatggagttttctcagcctgtgatcttagagactgggagttcagttctcaaacagttaagtagagggaactttccgtactcttcaaagctcgaggttaccaggagaagtggtcctgacaggcatgtcacctcaacatttctgaaacctgtgatgaatgtatagttttggattacacctgtgttggggcagttcttacatacacttctcactgaaacctgtggctctgataggttagatagctgagccatatgttgcactggaaatcagaagctacttcaaactgggttacactaacgaacaacagtccgttctggactgttgtgcaggttcactgagggtgaataaatggtagagaaaccattcgggctaaccaggttcaccagagactggtttaccaaccagaagtgagaaatacatgttacttagaaccatcagacacaaccagttttatccaaggcccagcacatcttattctgccaaaaagtgaggaaacgctcaaagaatcatgggagcttatcaaatttcacaggcgccagattgaaggtgctcccattggccaaatctgggacaatctgaacatcaaaataaatgatagtaatgggttataactcattgaataaaatacaaatccatatgtccatgctgatataaataggggaagaaagaaaagctctttcttatagtaaaataccaaataaaaagtagagaaaaaaatgagaaaaacatcaatggggttaaaactagttgaattttttatgagaggcaggatatttgcttagtctcaaagtacaaaatggcttattaatttcagagaggaaaataactttatagtggataaacttggcaaccttagctgagtgatcaagtttgtcaccaataataagaaaaagcaacatcatgcactttctgatatgatgcaaggagaaggccacaatatttctgaggtattgcctgagtctaatcttgaaacatgcagctcattggtcccatttatgctttttgtttccttctctatcctgatctcatatctcttcatttttataaaaaatgcataaaaatatagtcctatctccaaaatattttataaaataaactcttttaggagagattttaaaagaatttgtgtcagatcttctgtcctgaaaaactaaaaagtccctgcagaagagttgtaaatcaaagtcacagaaacacaggactggatggtaacttaattagctgttccatttctgttggttagcagtgtcttcaatctgaaagcgtactcacgttaccccacacatactagaggaccctttccaggagaggttcattccccctgtacctgctgggtggctcattaccctccagcccagccagcttctatgtcagtgccatagcatgcaagagagccctttgaacctcactgcaggactgtaggacttggggagaaaaagcacatctatatcctgcctggtgttcatatccaagtctgctattacagggagatttgggttggtttgttgtattttgtttcaaaatatgccaacttttcaggttgttctatagaaaattgtattcagcaaaatttggggaagatagcgaaatggttgatgagaagaaaaagaacctttttcttattttatatgaaaaacccagtgtgactggacctcttagcaaaagtctagtaatcatgattttggggtggtcttattaaccaaaatcctctttagaaagatggaatatatgcttatatctccaggattttgctttataggaaaaaaggcacagcttctcattaagagaaaagacattattgatactttacattgtataatacctagtggccttgtttccaaggttcactctcaaattgttgaaagtgaatctagtaaataaatctagataactcacttacatttttaagtaacttttgtctttttctccatgccccctttcttgacctcactttcaaaagataatcttgtggtgtggaagatccaggtggcagtttagcaccaggaggctgctgcagggaaaccccaggccctggtagcccttctctggggtgagcccatcttcacctttgctggccatgtggatgagggccgagactcagctagtcccttgtgttccagaactgctaacctgcttctctggctgcttctgctttaagagctcaaaggtagcagtggagtgctggagccaagtggtactggcccacaagaaccagtgtgtacatctcctcccaactgcccaacctgtgacatcatattggttgcttggaattggccagggtgaaagtacttatgctctagaaattgttaaatgctgcaagttagggctttgctttgccttttcctgagagctgattattaaacatttactggcacaccgctgcttaggcaagacacgtttgctgagattcaggttagctaatgaggaaatgaaaaataatagcaatgctgagagttgtaaaatgttatctgtgataaaggggctatctgaaatagcctcttaacaggtctctctgtctccaatattgctctcctaccctaccacaaatttatctatacacagggctgcagaatgatcctaataaaatgcaactgaggctgggcacggtggctcatgcctgtaatcctagcactttgggaggctgagtgaggcaggtggatcacctgaggtcaggagttcgagaccaacctggccaacgtggcaaaaccccgtctctactaaaaatacaaaaattaaccgggtgtgatggcatgtgcctgtagtcccagctactcaggaggcagaggacaggagaatcatctgaacccgggagtcagaggttgcagtgagccgagatcgtgccactgcactccagcctgagtgacagagcgagactccatctcaaaaaacaaagaaaaaatgcaactgatacctagtttctcccatacttaaaataaaatttggcagctacatcttagaacagtctaagcacaaagacatgagttgtctagaagaattttttcactgtgcccagagatgataagactgttggtgattattgacacaatatctcacaagatgaatgtgtaaaaaaaagtgaatttaataataaataacggggaatattccttttctgtgactgactggtcacagtccttattcaaggaatatctgtttcctctattactcattattatagaaaaagtggcatgatgaatgtggtagctagcctccaagatggacccagtgatcttgcttcctgatattcataccctgtgtattttcttctcccattgagcaggctgtgttaccagtaggattttgcagaaattatgatgtgtgacttctgaggttataggtcataaaagacatagcttctgttttgttctgtcttggatcacttactctggggtaagccggccacaatgttgtgaggacacatacagctgtaggattaacacaggaagagctgaggccttctgccaacaatctgtaccaatttgccacccatgtaagagagccattttggaagtgaatccccctaaccccaaccaaacctttagatgactgcaaccctggccagtgtcttgaatgcaaccagagtgggaaactgaaaaccagcatcactcagctaagccctaccaccttcttgacccacacaaattggatgaaacaatgcttattgttgttttaagctgctaaattttgggggggttgttttgcagcagtagataactaatgcaaagagcagttgcaggggatcaatcctgaggagtatttgtgctataagtattgtgagctttccttgctccatatcagaaaagctctttctcatgatctcagattcccttggaaggtgctgactatcgctataatgtggtgaaacaacttaatctgaaggtagggagaaggaagatctgagcttagattgggagcagagttcttcctaattttggttaggtatgaatagctgctgttgttaccaaagcaataaattgaacactggtcatacatgaggtttggaatagaagataaacacatttgcaatcaaataaatctgatacacatagtagttatgttgtcatatggttagcaggagcaaataaaccaatcctataaaaaatacatcatctgttagtttttatccaactagccaattgtatctagggccaacccttttaagaagatacaactgatagtttctcaggtgggaaaggaaatagctgattccaagacattaggcagttgaactgaagtgatgcctccctctagtagcagtagaacactacagcttattcctcccactatagcactgcagggtaaccagagttaacaataattttattgtatattttcaaatagtgaagagaggattttgaatcttcccaacccaaagaaatgataaatgaggtgatgtgtatgctaattgcccttatttgatcatgacacattgtacacatgttcaaaatatcacactgtaccccataaatatgtaaaattatatgtcaattaaaaataataataaatagacaaaagcctgtagcagtggttgtgagataagggttgggagaaggaagctgaattgtactgacatttcagtatagtgaatttaatctgttttcccaacattggctgaatctgatggctttagacttttcaagggaagcagcctaaggacattgagctccttggttgggaataaaagaggttcattgaagaaaatgtgaccgaagtgaaggaatggaaggctcttgcccttctactgttttcagacttcttctctcccctctcagcctgtacaacttgtcaggcactaaggttgagaaagccataaaatgctagtgaaataaggagagactgttaagattccccccacaatgccaatggacttaagctagctttggcagggaacagagcaggaattaaggaagtcccaacaccttgtggcaaatgagaattacctagttcagctccaaatgaaattctgtgcccttaggagcgatattgtgaaagaatgatgaacaaaaaatcaatttattcacagaacaaaagcatatcagtgttaaagaaataaaggaattaaaattttaaagatgtttcagaaagaaaaaatggcaaaaaagaaaattgtcttatcctgattttttacttaaaatccctgtcattgtcagtcacgtatcaagagactggcagcctgtctttctatgtttattaatttgttttgtttccacggatgcttctgaaatctttgttagaggcaaaggcactcagactgccaagagaaattagcagtgtttccactgtggcatagacacagatcacaccaagaacaaatagaagcattccgctgcatactgccccaactcctgcaggatctgtgcttttggctggtatggtgacatgagggcagggtcggcttcatgggcatgaggcctgtgcagtcacagagaaccgggcactcagaagggccctgctcttgttttaatattctgtggtgggtgtcttgaaattcgtaatttttgaacaagggatcctgcattttcatttttcagtgggctccacaaattacgtagctcatcctgtgtgagggtgctctggggaaggcaacacaccagctttggaggtaggcaggcttggaattccatctaagctgcctcttactacacaatgggaaaattatcctctgaacttcagattttcatctgcaatgaggacaatgccttctacctcttggtgttattgtgaggattagacactgttgtgaaggaatgcaggtaaagtgtctagaacagcacacctggcttcaccgtgattattcataaaaggcaagtctctatattggatcccagttgatgttagtgctggtcataaaaacaagaaaaatatgttttctttagaaaagcagctctctctttcacatcttacaggaagctgtggacttacattgccacggctatcgcttttgccaggattctcatggcttcttattgcagttgcagccaaaatagagactacgaaaattaacaatcctcttaaatattagctgcttcttgtaaggtagttgtttttcatgattccacaccagaaacaaggaagtcaatgaattttcccaattcttttaagaagatattaatgtgagtaaaatacacaatttaaaatacctgatgccctttctgatagcctggagcaaaggatgtttccactgttcccactgtcaaagcagcaggtctattccagcccccaaatagctgtggtcagagaaacttacttccttgtttattacttctaaaggtagagtgatattggagcaccaatttaccaaacccaaaccaaactgtaagtactaccttgatgggctgaagtagtccctattgtggggagaggatatggagctgagacaggccctgacattacacagggttgagatgatgtacctcaaaaccaatgcccatgacactgtctaaatacagcctattcttgttattcattgtacttattttctgtaaagtagccacgcatactgaataagtgagcactgaaccattgttcttagaggagatacagggttaagtcacaatctttggtcacattttcgtcagttggccagtacataatcttgttttatgagtgtttctgtttaaagacactttatttaatgtatattcttgagtcattattgttgaactcataaccaatagcactataactcatgcctaaaggaagcttatgtaatgcacacattttccctatgatgcacatcacagtcttctcctgcttgggaacgctaagacagcacttccaaactgcacttgggggccattttaaacaaaatcaccaataaaaattacaaaaacatgaaaaatgtggcacttgtttttggtatgagagcttgtgggaagtcaggaacccccgaatggagagaccagctgaagccatggcagaagaacataaattgtgaagatttcgtggacatttattagttccccaaattaatacttttataatttcttatgcctgtctttactgcaatctctgaacatcaattgtgaagatttcatggacacttatcacttccccaatcaatacccttgtgatttcctatgcctgtctttactttaatctcttaatcccatcatcttcataagctgaggaggatgtatgtcccctcaggaccctgtgatgattgcgttaactgcacaaattgtttgtagagcatgtgtgtttgaacaatatgaaatctgggtaccttgaaaaaagaacaggataacagcaatgttcagggaacaagagagataaccttaaactctgactgctggtgaaccaggtggaacagagccatatttctcttctttcaaaacaaatgggagaaatatcactgaattctttttctcgacaaggaacatccctgagaaagagaatgcgtccctgagggtaggcctctaaaatggccacttcaggggtggccgtcttttatggtcgaagcttagggatgaaataagccccagtctcccgtagcgctcccaggcttattaggaccaggaaattcccacctaataaattttggtcagactggttgtctgctctcaaaccctgtctcctgataagatgttatcaatgacaatgcatgcccaaaacttcattagcaattttaatttcgccccggtcctgtggtcctgtgatctcaccctgcctccatttgccttgtgatattctattaccttgtgaagcacgtgatctctgtgacccacaccctattcttacactccctccccttttgaaaatcactaataaaaacttgctggttttgccgcttgtggggcatcacgaaacctgccaacatgtgatgtctcccatggacactcagctttaaaatttctctcttttttattctatccctttatttctcaaaccagctgacacatagggaaaatagaaaagaacgtacgtgaaatatcaggggtgaatttcgcctgatatctggctgaatttcccccgataagacctgaaatgaagacagagtattgccatcttagacctcaactgggaacatgcacatcaggccattcaagtttctatggctctgtgcatgtccaagagtggccatgaaagtacagtgagtattgatttgggagctacgaatacattttagtgagtaggcaaatttgcacatgtggaatccacaaatagtgaagatcaattgtacatagaagtgtacatggtacatgtacttgtacatgtacaagtgtacgtggtagaggaagtgattccactaccttagtggacttgaagagaaaacacatccagattgttggttgagagatgcacgtacatgtgacattgggcagtatctctcacatcatttacaagtaggatgcagcagagataccatgaagtcagaagaattgagatttctgtggtttcaggtctttgtcttactagctgggcaactttgagtaggtgtctgaaaacttcgtttctcagtttccacatgtgttagttgagaacaataatcatctttcaaagtgagattgtgagggtgcagtgggtttttctttaagttctggcttactgttacttaatttaggggctaggattgaagacggtgaatcaggtgtcatattgtgttttagaatattcctttgtatatggtttgtctccccagaaagaaaagcagatgccaagtccatactaatatttggattagggtaatgagtatgttttcattcaaaatgcattatgaatccaagggaatagaatataaccataagcattttctggttaaactggccatcctaattaagataaagtaattgaatcaatagttttaaggcctacactaacttataccaggattttaagagcaaaataggaacgagaaataacaacttctgatatgttagcctcaaaggaagagcccaacaaaaagttggctccactgtgttggacagcagttggggtaggtggaggagacacattaaaaagacccaaccctcagcccagactggaactactgcgctgttcttctatcatgttgaagacacaccctaacctttcaattctgggacaggaaatatgaaatgtacacatgtgagtcatgggccaggaagaaccttttatatttcatcagttagcctccatgtccaccctttggagatgtatgccagagctgtaagtgttctgctcccaggctagggatgggggagagggtactgggcatttatgccattctatctttttagataaaaatttgttcaaaactcaatactcagacttactttcctcatcttgaaatgcctaaggctaaagaatatgtaatttagttcatttagatagactagaaaaaaattgtatatcaaaacaaaaaataattcttcatgaaaaaataaaataacatgtaaacctgcttttaaaaattgtagaatgctccgtggacagaaaatattaggaattgattggtgtctataaataacatacatatatacataatggaatactattccaccataaaaaggatgaagtgtcttttgcagcaatgtggatggaactggaggtcattatcttaagtgaaacaagtcagacacagaaagtcaaatcccacatgttctcacttataagtgggagctaaataatgtgtacacatggatatatagtgtggaatagtagacaatagagactcaggaaggtgagggagtggaagggggttgaatggtgagaaattacttaatgggtacaatatacatcatttgggtggtggataccctaaaagccctgactttaccactgcaacatctatctgtgtaacgaaattacacttgtacctcataaatacatacaagtaaaaaaaaccactcttatacatgttactctgttcatacaatttctttcaaatggaagatatctaaaaaacagctgtgtcttcaagtttggtattccacatcttcatttgccaagatgaggccttttctactctgttcattgtcattattttattttatctcgatataaaactaagttaaggcgcgactattgctaaatgttatcacctaacactattgattcactttcctgtttaatctctatcacctactcttttctttaaaaaaattattttaggtcaggcgcggtggctcacgcctgtaatcccagcactttgggaggccgaggcgggtggatcacgagctcaggagatggagaccatcccggctaacacggtgaaaccctgtctctactaaaaatacaaaaaaaaattagccgggcgtggtggcgggcgcctgtagtcccagctactcaggaggctgaggcaggagaatgacgtgaacctgggaggcggagcttgcagtgagcgagatcgcgccactgcactccagcctgggtgacagagcaagactccatctcaaaaaaaaaaaaaaaaaaaaagattattattttatggccaaatacttatttagccctacgtctacatgcaattcttatatttggaacttcttaatcagaaactaaatgtggatttggtttgaatgcttgttttaatgattagtttattatgagtacaggaacaaataagtgatatctgtttcctcatctgtttgtgatgatttattttacattagcataaagtatgcagctctatgtgagagcatcaggaagcatctgtgatgatatggattttgataagctaaatgttatctagggccttaggttttctcatgttttcacatttctcagtagtaaggtcacactgagttgtgtcatatttagcttaagggacaccagagtgaacataagagcccaggctaaagccacctcttcctagtgcactgtcacccaccctgtcccttttcctgggcatctgtcttatattttattcaccgtgggcctcgttcttgtttaaaacccaaagaatctttaaaacgattcagcaatagtacttgagggggtcactccacgcagagatattttacagtttaaaatgccactcctatagggttggctgaagccaaaggttttttaaaactatatagaaaaataaaaaataaatgccacttctaaagattggaaactttaacctccccacaatgaatcttcagtggtgagatttcaggtgacaaacatgttagaggtgagattctctgaagcctgagttcccccgaaagcccccagatcacaccatatgaacctacccaattttagcgtttttaagagactaaagcctcatgaaagcatatgaaaactcactgagatttctttagatatctaaaaggcattttgaagatcattttgttatgtggcaaactgtccttgttttagagttgtgctgggtggcatgtataagaactacttattttaaagtgaaggactacataacaaaagtattcccaatttgatttatacacctggctatagctttatttctgtggaacaatcatgacatctagtggctaacctaagtaatgccaagaaatggtttcatacgctattttccttagctaaatccacttaaatgagaacttgctattcaaatactgtaataaatatccttgtacattttatatacttaactatatgagataaagatggagaagtagaatttctgagtgaaaggatatgtgtacttagaatgctgatgttgccaattcaccctcccaagaagtttgtaccaattcgaacttccatatttcttctcatcatcccaacaatgagtattatcaaatatgttaatttttgttttagtctttattttttattttttattttttttggagacggagtctcgctctgtcacccaggctggagtgcaatggtgcgatctcggctcactgcaagctccgcttcccgggttcacgccattctcctgccttagcctcccaagtagctgggactacaggcacccgccaccatgcccagctaatttttttgtatttttagtagaaacggggtttcaccgtgttcggcaggatggtctcgaactcctgaccttgtgattcgcccgtctcggcctcccaaagtgctgggattacaggcgtgagccaccgcgcttggccagtctttatttcttaatgaatgagagagcttatctttttatggctcccccaccccccgcctctgccccaccatttttctcctttctttctttgttttttattttctttggccattggtatttatttatcagtgaagcgccaacatacatattcatcccattttttaaagatttactggttcataagcatcttgtttgtaaaaggtttttgcatattgaagaaatgtactgtcatttgcattgaaaatatttttcttagtttgctttgtgactattttttgctttgtaaagtttttaatgtttatatagtcaggtatatcaggattttccttttttgttgttgttgagacagagcctcactcagctgtccaggctggagtacagtggcatgataatagcttactgcagcctcaatctcccaggcttaatcaaacctcccaccccagcctcccaagtagctgggactacaggcgtgtgccaccacaccctgctattttttttctatttttagtagagataagatctcactatgatatccaggctggtctcgaattcctgggtgcaagtaatcctcctgcctccaaattgctggaattacaggtgtgagctactgtgtccactactagtattttcctttatagttttagtttcatgtcatatttaaaatgtccatctcctctgatatggtttgactgtgtcctcacccaaaactcaccttgaattgtcatctccacatgtctgggacagaaccagatggagataactgaatcatgggggtggtttctcccatactgttctcatggtagtgaataagtctcatgaaatctgatggttttataaatggaagttcccctgcacaagctgtcttgcctgctgccatgtaagacgtgactttgctcttccttcaccttctgccatgattgtgaggcctccccagccatgtgaactgtgagtccattaaacttctttcctttataaattacccagtcttgagtatgtctttattagtagcatgagaagggactaatacatcctctcccagaggacaaaaattaaaaatattgtatgtttatttatgtaacataatcatgtatgttatttagttttagtttttacatttaagtctttcatctatctattaatagcattttagtgaaacagggtaggcagggatttgactttattcttaccctagcaatgtagaggagattggtaaatttaagtatagctattaaaaacattgagtgtaggtatctgtactaatgagaaaagatgtcaaaaatatgcaaaggataagaagacattaggaaaatggcagataagagacagaactaacatgcagctaccacttggatggacaaaacagtgcgtggagactcatattgtgaacttttgctccaagacccactgcaggaacataccaggaaaacaaataattcacagaccctttgaaagaagcggctttggccgggcgcggtggctcacacctgtaatcccagcactttgggaggctgaggtgagcggatcacgaggtcaggagtttgagaccagcctggccaacatagtgaaaccctgtctctactaaagatataaaaaattagccgagtgtggtggtgcatgcctgtaatcccagctactagggatgctgaggcaggagaatcgcttgaacctgggaggaagaggtagcactgagctgagatcgcgtcattgcactccagcctggatgacagggcgagactctgtctcaaaaaaacaaaaaagaaagaaagaagaggcttgccactgcaaactctgtaagataactgaacaaatggtgaattcccaaaatgtgagaggggaaaactctgcctctgaatatatatccctactggggaacctgaatatccagatcatgggtgaaggatttaaccttacctagagctgaaacagctttagggagctgagtgaaatataaaagtagaagaagcaacgagaagagccctgtaggtactcctggtccccagctttatctcacaggggtccttggggaaggcagctagcagaattgggaaggggtcacagggtgaaggaagcttctagctgaactttgtaataatttcgaatgagcacaaattttcctgagcagaatccaggggtatgaacaggaagtgcagatacaagcacaggaggcacaaccaaaggaataggcaggcagggagggcaaggcctaagagccctacttgctttctcagcagggaggcttgtagcctggggcaagatctcagccctgcttgctaactgcctggatataaattcagtgctgttggccgggcacgatgggagtgggactggccttgctggttgtgtggaagttgggtgaggtctgtcactaccggctttttcccacttccttggctacctgtatgacacagcagaggcaaccataatctctatgagaacataactccattggcctgagaaccacccttccatcccctacagtggccatagcaagtctcgcccaagaagagccggagctcagacctggctaactctgccccaacctgatggtatttctttactgaccctgctagctgaagacaaaagacataaactgttgggagctctatggccttgctcatggcctgagaaacctgagaacttatcctgggcaatgtaggggaagcttgtatccccctcctactactgcagctggtgctgtcttgaaagaggcatctcctggctggaagccaaccaactcaagccattacagcaactcataacagagcaaccccactccaaagaaggagaaaacaacagctaattccaccacctgcaacaccttggctaaccagaagtcctgagtctgtccacatgacaacttcactgctagcataaccagcatttgagaaagccagcacactacacatatctacaaccaaggactctcacagaatctactttactcccctgccacctccactggagcaggtatccatggctgggagacctgaagacagatcacatcacaggactctttgctgacaaccctagcacaaacctggagcctggtagctctgctgggggttagacccagaagagcaataacaatcactgcagtccgctcttcagaagccccattcctaggggactggggagagcttcatatcaagggatcaccctctaggacaaaagaatctgaacagaagcccttgagctctagatctttctactgaaactgtctacccaaataagaaggaatcagaaaagtaattctggtagtatgacaaaacaagttctatcacacccccaaaagatcacactagctctccagcaatggattcaaggcaagaagaaatctctgaattaccagataaggaattcagaaggtttattattaagctactcaaggaggtaccagagaaaggtgaaaaacaacttaaagaaatttaaaaaataatacagaatatgcatgagaaagtctccagagaaatagatatcataaagaaaagacaatcacaacttttagaaatgaaagacacacttagagaaattcaaaataccctggaaagtttcaacaatagcatcaaacaagtacaagaaagaacttcagcacttaaagacaaggcatttgaattaacccaatctgacaaagacaaagaacaaatttaaaaaatgaacaaagcctccaagaaatttgggattatgttaaatgacctaacctaagaataattggtgttcctgaggaagaagagaaatctaaaagtttggaaaacatatttaagggaataattgagaataatagaaatctagacatccatatacaagaagctcaaagaacacctgggaaattatcatgaaaagatcatcacttaggcacagagtcaccaggttatctaaagtcaagacaaaggaaagaatcttaagagttataaggcaaaaatatcaggtaaactataaaggaaaacctatcagataaacggcagatttctcagcagaaaccctacaattcagaaggaattggggtcctatctttagcctccttaaacaaaataattgtcagccaagaattttgtattgagtaaaagtaagcttcataaatgaaggagagataagtctttttcagacaaatgctgggggaattcaccactaccaagccagcattaaaggaaatgctaaaaggagttctaaatcttgaaacaaaacctcaaaatacaccataatagaacggtcacaggatccttaggggtgtcacttcaccagccagaaacctctgtggctggtggtgtttctgcttgagttttgttcatgcctcctgggctcagcaggctgcactcagctcaagctactggctcggatcccatgcctgccaagggcgagccaggcatgcggcagggaggagtgtgtgagtgaatgagcacaggttcccgccactgcacacagccaggtgcactggctgctgtggcggggcgggcagcttcaggtgccggcacagtcactggctccatgcgaggctgtggctggaccagatgtactgcaagtggcctctgctctgggcaccagtgtctagacaaggggaatgcagtgggacctgaaagctcggagacaccaaaaaccacagagctccaaagagggtgttacagcatgtcacagccctggcttgaggagccctgaggtctgggttcccagaagggctgcatttcttctctccttcttgttactcacagcacagtgagcagggagatgtgttttgtgggggcatgtttcagcctgtttgtgttacagctctttcagtcctgccatctcactccagcccatgactcctgggctggcctagccccaccactgcttcccattgtgtggggcgccacctggcattggcagagagcaggagagctatagtgttacagcagctctggctcagggaatccagaagggttgccactcttcactccataattcaggagcatgtcaccacctgcagctcattgagccaggcaggaacgtgttacagctcctttcacttccactgttcggcaggtcctgagttcttgtctcatgtccaggaagaatgaggttacatggacaactggaaggtgagcaacacagagaggagctttattgagcaacacaacagcttttaggagacccaaagttggtagctcctattcacaggcaggttgtctcaaccagtgtttgagtctggctgagtctggggtttttatgtgctcagaatggaggaagtgcatgctgattggtccatgtgcagccatgggcaggccatcttattggccgaagggcatcaatgaagttctcactctgggtcatgaactccacccagaactggcagcccaacccccaggcttcaggctgtccctaacttaagggtggggtttcaccagggacctgccccttctcacctaggaaactgtctacctcttgccaccatcaacataccatccacagcacccaggctgtctatgcccggggtgcctgcaggcctgcaccaaggtgccctcagccccctgaccttcctcctgtgctcattagcacccaaagtctggacagggccaaggtagcaggaggctggcatgtcagcactaccgagtgcacacacacgtggcggggttgcaacagcacccaggtttgtctgcaactttgctccacaccagggttggcaccagcaatggggagaggctagggagtgggatcaggcacttctgagcctgcagaggcaggggcttcccaggcccctgggaatgcagggatgcctaggtctggagccatggctggatggatacagctgcacccaggagcatgggctcccaccttgccaacttggtagggtgcagggctcccgctgggatcacctgttcctgatccccaccagctctgcagagtgcgcaaccctgaccatacctcccccattgcagctgttgtcctcacagtagccactccagatgggctgccaccaccatcagaactcccttaaagcataaatctcacaaggcctataaaacaataacacaatgataaaaaacaaacaaacaaggcattcaggcaacagctagcatgatgaatagaatgttacctcacatcttaatactaacatttaaggtaaatggcctaaatgctccacttaaaagattcagaatggcagaatggataaaaattcaccaaccaagcatctggcttcttcaagagacctgcctaacagatgaggactcacataaacttaaggtaaaaaaggtagaaaaagatattccatgcaaatggtagccaatagtgatcaggagaagctatttttatatcagacaaaacagactttaaagcaacaacaattaaaaaagacaaagagggacattatataaagataaaaggatcagtcccacaggaaaatatcacaatcctaaatatatatgcacgtaacactggagcccccaaatttataaaacaattaccattagacttaagaaataagatagacagcaacataataatagtgggggtcttcaatactccactgaccacactagacagtcatcaagacagaaagccaacaaagaaacaatgaacttaaactacgaatggacttaacagatatttacagaacattctacccaacaactgcagaatatacattcttttcatcagcacatggaacattctccaagattgtccatgtgataggccacaaaacaagtctcattaaatttaagaaaatcaaaattatgtcaactactctctgagaccacagtggaataaaataaattaactccaaaagggaccctcaaaactatgtaaatacatggaaattaaataatatgctcctgaataatctttgggtcaacaatgaaatcaaaagggaaatttaaaaattctttgaactgaacgataatagtgacacaacttatcaatacccctgggatatggcaaaagtggtgctaagaggaaagttcatagcattaaatgcctccatcaaaaagtctgaaagagtacaaatatacaatctaagctcacacctcaaggaactagagaaacacaaacaaaccaaacccaaacccagcagaagaaaggaaataataagatcagagcagaactaaatgaatttgatacaaacaaacaaaaaacaaaagataaatgaaacaaaaagctagttctttgaaaagataaacaaaatagggccgggcgtggtggctcacacctgtaatcccagcgctttgggaggcagaggcagacggatcatgaggtcaggagattgagaccatcctggctaacacggtgaaaccccgtctctactaaaaatgcaaagaattagccgggcgtggtggcaggcacctgtagtcccagctactcgggaggctgaggcaggagaatggcatgaatccgggcggtggagcttgcagtgagccaagatcgagccactgcaactccagcccggctgacagagcaagactcctcaaaacaaacaaacaaacaaacaaaaaaagataaacaaaataaatcaaccattagcaagattagccaagaaaagaatagacaagataaacataagctcaattagaaatgaaatgggggatattactaccaataccacagaaatacaaaagatcattcaaagctatgaacacctttatgtgcacaaactggaaaacccagagaagatggataaatttctggaaatatacagcctttctagatgaaatgaggaagaaatagaaagtctgaatagactataacatttagcaagactgaaacagtaataaaaaattgccaacaaaaaaagtttgggacttgatggattcacagctgaattctattagacgttcaaagaagaattggtaccaattttactgaaagtattggaaaagatagagaaacagagaatcctccctaaatcgttctatgaagccaatatctccctaataccaaaaccaggaaagaacttgatgaacatgatgcaaaatcctcaataaaatactagctaactgaatccacagaatatcaaaaagataatacaccatgatcaagtgggtttcatacaagggaagcagggttggtttaacatatgcaagtcaataaatgtgatacaccacattaacagaattaacaacaaaaatcgtataatcatctcaatagatgcagaaaaagcatttgacaaaatccagcatcgctttatgattaaaattcagcaaaattggcatagaagagacatacattaaggtaataagggccatctatgacaaacccacagctaaccttatgctgaataaggaaaggttgaaagcattccccctgaaaactggaacaagacaaggatgcccaccttcacacttctattcaacatagtactggaagtcctagccagagcaatcagaaaagagaaagaagggcatccagatcagtagggaggaagtcatactcttgctgtttgccaatgatatgatcatattactagaaaaccctaaagactcatccaaaaagctcctaaatatgataaattaattcaggaaagtttcaggatacaaaatcaatgtacacaaatcagtagcactgctatacaccaatagcaaccaagctgaggatcaatcaagaacacaatcccttttataaccgctgagaaaaaaatgtaaaatacttaggaatctacctaaccaaggagttgaaagccctctacaaggaaaactacaaaacactgctgaaagaagtcattgacaaaacaaacaaatagaaacacacaccatgctcatggatggatagaatcaatactgccaaaagcaatccataaattcaatgcaattcccatcaaaatacaatcatcattcttcacagaactagaaaaaaatcctaaaatttagatgcaaccaacaaaagagcccacatagccaaagcaagaataagcaaaaataaaaaatctggagggatcccattacccaatttcaaactatactacaaggctataatcaccaaaccagcatggtactggtataaaaataagcatgtagaccaatagaacagagtaaagaactcagaagtaaagctgaatacttacagccaactgatctttgacaaagcaaacaaaaccataaagtgggaaaaggacaccctattcaacaaatggtgctgggataattggcaagccacatgtagaagaatgaaatgatcctcatttctcaccttatacaaaaatcaactcaagatggatcaaagacttaaatctaagacccaaaactgtaaaaattctagaagataacattggaaaaactcttctagacattggctaacacttctgcacagcaaaagaaataatcagccaagcaaacagacaacccacagagtggaaaacaaccttcacgaactttgcatttcaccaagggctaatatccagaatctataaggaactcaaacaaatcggcaagaaaaaaacaaataatcccaacaaaaagtgggctaaggacataaatatacaattctcaaaagaagatacacaaatggccaacaaacatgaaaaaatgctcaacatcactaatcatcagggaaatgcaaatcaaaaccacaatgcaatacccccttattcctgcaagaatggccataattaaaaaatcaaaaaataatagatgttggcgtggatgcggtgaaaagggaaaatttttacactgctggtgggaatgtaaactaatacaactgctatggaaaacagcatgaagattcctaaaagaactaaaagtagaacgaccatttgatccagcaatccccctgctgggtatctacccagaggaaaagaagtcattataagaaaaagactcttgtactcacatttatagcagcacaactcacaactgcaaaaatacggaaccagcctaaatgcccatcaatcaatgagtggataaagaaaatgtggtatgtatataccatggaatactactcggccataaaaaagaatgaaataatggcattcacagcaaccttgatggagttggagaccattattctaagtaaattcaggaatggaaaactaaacatcatatgttctcccttataagtgggagctaagctgtgaagacacaaagccataagaatgatataatggactctggggacttgagggaaagggtgaaattggggtgagggataaaagaatacacactgggtacagtatacactgcttgggtaatgggtgcatcaaaatctcagaaatcaccactaatgaacttatccatgtaaccaaacaccacctgttcccaaaaactattgaaatggttttaaaaaatagaaaaataagcttagatgaaaaaatattcaaaaagtagaacaatattgacaatataattacatgtatgtagaaaaactatttccctgcaaaggcacagaaaatatctgaaaggacacacacacacacgcttgtgcacatacaattattaacagtggatactttcagggaattcatataggatattggcaagataagcagaattttacttttacctctatacagatacagttctctactacttgaatgtattatcatgaacacacatttcttctgttataaaaattatttttaaaataatatttaatatcatgggaagatatttaatatctatagtaaactgaaagagcaagttataaaatggtaagtaaaatatgatcttcctttggaaaataatatttttttttgagatggagtttcactcttgtcacccaggctggagtgcagtggcatgatcttggctcactgcaacctctgcctcccgggttcaagcgattctcctgcctcagcctcccgagtagctggaattatggatgcccgccaccacatctgactaattttttgtatttttagtagagatggggttttgccatgttaaagcaggctggtcttgaactcctaacctcagatgatctgcccacctttgcctcccaaagtgctaggattacaggcgtgagccaccacgcttggcatagaaaataatatttatgcaaagaagaaagattggatgggtatacaccaagatgtgaacaatgatctcagagtgtgtattagtctgttctcatgctgctaatagagatatactcaagactgggtaatttataaaggaaagaggtttaatggactcacagctctacatggctggggaggcctcacaatcatggcagaagatgaaggaagagcagagggacatcttacgtgacagcaggcaagagagcttgtgcaggggaactcccatttataaaaccgtcagatctcgtgagacttattcactaccatgagaacagtatgggggaaccacccccatgattaaattatctccacctgggcccacccttgacacatggggattattacaattcaaggtgagatatgggtgaggacacagccaaaccatatcaaagtggatgaatttggatgatttttattgttttcttttgcacgaatcttgattttctaaacactttttatcctttaagagtttgattcatcaggcatttcttaaaaaatgatatacttcattagtactcttaaaaagatagatctctgattcatggagccagaagataactggatacaaaactatctgatgtgaaagttatttcttccaccaaatttcagtcatgtaagagctcttaatttttggatttatcttctatacatggctgacttcatctatattttatgtggaataagtagcaaatacttctgagcttcttcaaaatgaagtggaaagtaaaatataaaatgagtgaagaaatcagaacaaagaaaatatgacagaaggagagagaaaatgaaatcacaagatgaactctaccccgtaagggccagcactttttttgagggtgatctagtcatgcatcacttaatggcagggatatgttctgagaaatgcatccttaagcaattttgtcattgtgcgaacatcatggagtgtacctacgcaaacctagctggtatagcctactacacacctaggctagatggtatagcctattgctcctagactagaaacctgtacagcatgttacaatactgaatgccacaggcaattgtaatatgacagtaagtatttgtgtatctaaatatatctaaacatagaaaaggtacagaaaaaatataaaagataaaaaatggtacacctttataggacacttatgaatggagcctgcaggactggaagttgctctgggtgagtcagtgagtgagtggtgattgtgagggcctcacacattatcatacactaccgtagactttataaatgctgtacacttaagctacactaaattcataagaataaattttatttcttcaataataaattaatcttagcttactgtaacttttttacttttaacactttaaatttttctttttgactcttttgtaataacacctagcacattgtacacaatattttctgtccttttctgtaagcgtttttcttttttaataatttttttaactttgtaaaagtttttgtaaaaaataggacacaaacacatacattagcccaggcatacacagggtcgaaatcatcagcatcactgcctccaacttctacatcttgtcccgctggaagttcttcaggggcaataacaggcatggagtgatcatgtcctatgataacaatgacttcttctggaataccccctcaagaccctgcctaaggccggtttatagttaactttttaatatacataattagaaggactacactctaaaatagcaataaaaatcagagtacagtaaatacataaatcagtaacatggttgtttattatcgttatcaagtattacattgtatttagtctgttttcacactggtacaaagaactacctgaggctgggcgcagtggctcacgcctgtaatcccagcactttgggaggccaaggcaggcagatcacgaggtcaagagatagagaccatcctggccaacatggtgaaaccctgtctctattaaaaatacaaaattagccgggcgtggtggtgtgtgcctgtagtcccagctactcaggaggctgaggcaagagaattgcttgaacccgggaggtggtggttgccgtgagctgagatcgtgccactgcactccagcctggcgacaaagcgagactccgtctaagaaaaaaaaaaaaaaaaaaaagaactacctgagactgggtaatttatgaagaaaagaggtttaattgactcacagctctgcagaaagcaggctgggaggcctcaggaaacttacagtctggtggaaggagaagggaaagcaagcacatcttagcatgggaaagcaggagagagaacaagagagcaaagggggaagtgctacacactttcaaaccatcagattttgtgagaactcactcaccatcatgagaacagcaagggggaaatctgcctctgtgattcaatcacatcccaccaggcctctccctgagatgtgggattacaatttgacatgagatttgagtagggacacagagccaaactatatcatacatagtatacagaattgtatgtgtgttagttttatatgactggcagccaatagttttgggtacaccagcattaccacaaacataagtaatatgttgtgctacaatattacaaagtccaggacatcaccaggctataggaatttttcagtgtcattataatcttatgggcccactgttgtacacgtggtctgttattgactgaaacgttatgtattgcattactgtactaactcttctaaacaaccccctaactcttacccaccccaaaaagagaccagagctggggagggtcaaactgtcccgagatggaggccagacagaaattactcaagtgcacgagctacatgcagacaataacaacaatgacagcaacagctcctgaggtttcatatgggtcaagttctatgctaaatcatgattttattcagataaacagttttatttaatcttcacaagaaccccattcttagtagggaacatttattcctcctacccatgtttccccttgactcgctaggagggaagcatttgggaggagctctttgagcttctcagttctgtccccttacttcctcctcaggaggagttgggagagttggtgagtttgagagaagggatgagcagctgcagctcctttgcggggacgtctgttctccaacccaggaagatctctgccctccatacactaagcttgctctggagaactctgcttctgtacttctggagccctggtgtgttcctcaattcaactttatcagtaataagcctgacaccatctacaattcattatctgaaactccctgggtgaggtgggtttcaaaattcagaatttttcagattttagacaggtcatgtggttcacatagaggttctaggtcaactccctatcatcaaacacattaatatttttgcaataaaagatatgaatactcacactaaatgggatgaattaagactacatcacatcaattcagatcacattttgtggtcaaatgagttcagatgtgcttcatggatgtaccatgaaggtaatgaagctgaagtttcagcccccagcccagctgcacaggccacttctttggccagataacttattttgtatttatactcatatatatgaatatatatatgagtataaatatgtatgtatgtatgactgtgtgtgtgtgtatgtgtgtgtgtgtgtgtgtgtgtgtaaccctcaaaaatataagcttcaggttccagaaaacctagattctcccatggagaaagatattatttcctcccctaaaatcctgatacccaaaaacgtaggtaccactattattcccatgttacctaggaagagactgagggaagagggggtaagtaccttgacacccagttctaagtggcagagttttgttttaaactcagatgatgtaaggcctgagtttgtgcttttaaccactgcctttctacatttgtgaacaaaagtaagaaaattgttgatattctcttttcagctaaaataaatcctagaggatatcctttatcccaataaatataacctaaggaatccaatttctgtcaaacctctcagtctaataggagaagaatgaaactctcctaataacgttccctagaaatttaggaaaagagcactacagtaaaatttctgtatacttccttctaaagagaacccccagaattagatcctattcacacattaccattctcctgatattgagccttcaatattaggtgaatgctactcttttcccacaaaatgtaattgtatttgcattcctcaatatcctatgtttggcttttcatgaaattcaatctggaaatcagtaaaaaccatgtacataggatcctgtaacattgctataatagtaaacaatctcacatttctctgcacaaaaaacccaagagaaagggaagagtgaatacccatattttacaaatgaagaaactaaggacaagagaaagtaacttctccaatgctgccaagttttgccaaaattggtaacaaagctctggacatttttcttctaggccaaggctgtttatctaaggagcatcaactctggacatgtaggttataattcattaatatttcaggaataactttatctgctgaataaattgctgatgaagcttccccaaaacaacaaaaccattcataaattctgactgattcttatttctttctcagattctccacttggactaagaaaacagtaaggaaaaattttgttctactcctcacaattataatagtattttaaaatatactattatgaaatataaatacatgcatagagaaaatgatgatctcttgaagatgataataatgatattcaccacccatctataacacacctgaacagtttgccatgtatttgttttggatttattcttaactaataaagtccctctgagtgtttctccaataccattcttttcttgcattatccaggggtaaccagcaacccaaattttgtatattaatccatgataatttatatagtacatttatatttaaaactatttaaatataagattttttgtatttacataaaataactatcatacgataacatcatcatatacatacataatatgtatatgtatatatacatatatatatatagtcttagatctatcattccacaactcgtttttatgctttatggtgttttgagattcatgttgatatttaaagctagtagttttatgtctttagcttttgtgatattgtgaatgggacttttgttccaattatgttttctaactggttatggctgttatgtgaggactttatcgatttggattcaagaaaactttccgaattcatttatgacttctaatagtttgtagattctcttggattttctatgtgggcaagaacagcactttcaaataatcatctttctgagggtgaccggctactttgcagaataaaaagctcataggttatctgatttctaacataaaatcactctccggtttccacaagcatacattgcaatagagatatcctatccccatcctgaatgtttttcaagaggtagaattataaccacgctgttttcttactctgtcgcccaaagattttattccgtggtgattacttggtatgacttcaaatggagcaccataaagccacaggactggaagtgaatgggtgtcttttatttcaagaagagaatattacctcacttaggaatacctgtaatttcatgtaacaatggactttttggagaaattgtctttagatttaggaagctcctaatcagatttctatgtaaatagattgaaacaatggtgttctctttttgtttatcaataaaacaagttagggaagaactgtgagttcgacatcatctgttaccattgggaagaaaagtagggtcacataatgaaaatcaagctcaaagatccattacctttgtggttatttattctgaccacctatcagtgctgggggaaatgaccggtagtctcaataaagcaagagtctcctgggagagcatagtctgatttccatgtgaactgggaggcagagctttaactatatgtcctttctcattattttgaactgacatagttaaaggacatttcccccaaatgctgctgaatagaaaacacgatcaaataaactatatgtgtcagttagggttctttggatgcaaacaatagaaactgactaatttaagcaaaaagttattagaaatattctaggtagctcagggagtcaaaggaaatgttgaacaattaggcctcaggaaggaaaggcatgaggcagctctgggaatctgggtaacaggaaagcatggatagtctcttcagagaactgccacatgctagctctacacatactcctgcctgtgtcactccactcaaggtccagactcctggaaggtaaagactaattttcctgatttgtgccacgtggccccttcttgattgtgttggtgtcagaaggaggggggcagggagggcaccttcattttcatgtcattctgagactataattgatgatgaaagagacgttactaagtaatcagggcttgcttactcaagaagggagagaattgaagtacagggggacacaacaagcattcatttcacccatctttaccaaggcttagcacagcagcctcctggcatagcctaatggcattagcaccaaagaggtctaggaccccaaaaggaaatgactccaatgaaatgacctgagaaagccagggagaaatcctgcatcaaatctgcagagaacatcaagctgccagcatagacctcagccttctcggaaaaagtagccttatcacacacgtgactaatgagactgagcctctgaaatctgagaagatctgttcagtgggcatttatgggtaaggtgacctagaaagcttccaggaaacagaaagacttaaagggatttcctctctttcttccctttccttttcttttccctttcctttccttttccctttccttttcttttccctttcctttccttttcccttcccttcccttttcccttctcttcccttcgcttcccttcctttccctccccttccctcccctccccttcttttcctttcctttcctttcctttccttttgtttcctttcctttcctctttctctctctctctttctttctttctctctctttctttctttcttttcattcgttctctttctctctctttctctcttcttccttccttccttccttccttccttcctccctccctcccttccttctttctttccttccttccttcttaactttagactattgtttgagcaggtagcacccccagaagacttctttggtgccaatctcctactgtgaatccttagcttgactacatagctgaggtttcttcctaagacatctctcccatcatctttgtttagctctgctgctgctcctgattgcccttgcctgtagggcaggtaaatgtgcaaactcagggcaggctgcctgggttcaggtcctagctcttctacctacttgcgatgtgactttatctgtctgtatcctggctaataggagttactgctgctgctttaccacttacagctttagactttccctaatcttccctccatctagataagatttactaagatgatacccaatcatagaattaccaccacttcctgatagcatccaatccagagaaaagcctgtgttccttaagaccttttccaaatcacctagcatataaccaaattctaggataagttctttcaaacactgtcttactgagacaccccagatttccccatgacatgcattcttcctctctgtaacaaggaataaacccaacttgttcaactacaggtgtgttcctgatggcctttagctggagcgtactgacacaataacaggctttgaaattcaagtgattcagtttggcatcttagctccaccacttatcagctatatgaccagtatcttacccattacttctatgagttcaaattctttagattccacatatgagtgagatcatgcagatatgtgtctttctgtgactagcttatttcacttagtacaatgtccttcaggtccatccgtactgtcacaaatgataggatttccttctttattaaagctgaataatatttcattgttattataccacattttcattttccattcatttgctgatgagcacttaggttgattccatatctccactattgtgaataatgctgcagtgaacatgaaagtgcagatatttgtttgacatactgattttatatcctttgggtatatacccaatagtgggattgctgacatactgcagttctattattaatttttttaggaaattccatactgttttccatagtggctatgctaatttgcattctcaccaagagtgtgcaaaaattcccttttctccacattctcctcaacacttatttttcgtcttttttttttttaggagatggggtgtcaaaaagtgggcaaaggatatgaacagacagttttcaaaagaggacatttatgcagccaacagacacatgagaaaatgctcaccatcactggtcatcagagaaatacaaatcaaaaccacaatgagataccatctcacaccagttagaatggcaatcattaaaaagtcaggatacaacaggtgttggagaggatgtggagaaatacgaacacttttacactgttggtgggactgtaaactagttcaaccattgtggaagacaatgtgacaattcctcaaggatctagaactagaaataccatttggcccagggatcccattactgggtatatacccaaaggattataaaccatgctactataaagacacatgcacacgtatgtttattgtggcactattcacaacagcaaagacttggaaccaacccaaatgtccatcaatgatagactggattaagaatatgtggcacatatacaccatggaatactatgcagccataaaaaatgatgagttcatgtcctttgtagggacatggatgaagctagaaaccatcattttcagcaaactatcgcaaggacagtaaaccaaacaccgcatgttctcactcataggtgggaattgaataatgagaacacgtggacacaaggtggggaacatcacacactggggcctgttgtggggtgggggatgggggagggatagcattaggagaaatacctaacataaatgactagttaatgggtgcagcaaaccaacatggaacatgtgtacatatgtaacaaacctgcacattgtgtccatgtaccccagaacttaaagtataataaataataaataaataaataaataaataaataaataaataaataaaaagagatggggtcttgctatgttgcctaggctggtctccaactcctgaactcaagtgatcctcccacctcagtctcccgagtagctggggactatagatgcaagccaccaggccaccttcatgtggtataacaagtgtaagataatatcccattgtagctttaatttgcatttctcttatgattagtgatgttgagcattattttcatatagttgttggccatttgtatgccttcttttgagagctgtctatttaggttctttgctcatttttttaatagggttgtttccttgctattgagttccttatatattctggatatttactcctcattagatgtatggtttgcaaatattttctcccattttgtagtttgtgtcttcattctgtcaattgtttcctttgctgtgcaaaagtttttagtttgataaaatcccatttgtctatttttgcttttgttgtctgtgctttggggtcatataaaaaaaatcatggcccagaccaatgtcgtgaaactttcctccatcttttcttctagttttacagtttcaggccttatgtttaagtcttcaatctatttcaaactgatttttacacatggtgtaatgtgagagtctaatttcatatttatgcatgtggatatccagtttttttcattatcatctattgaaggaactttcctttctccattgtgtgttcttggcacctttgttgaaaatcagctaactgtaaatgcctgggtttatttctgggctttctatattgttcccttggtctgtgtgtctgttttatgccagttaaaattgttttggttagtataactttgtagtatattttgaagtcaggtagtgtgatgccttaaactttgttctttttgtttaagatggctttgtttattcagggtcttcaagagttccatacaaattttaggattattttttctatttctgtgaaaaatgtcattgaaattttgataggtatgcatttaatctgtagattgctttgagtagtatggacaggttaacaatattaattcttccaatctgtgaacgtggaatatcttaccatttatttgtgtcttttttttcatcaatgtttatagtttcagtgtacaagtctttcagttcttggttaaatttatttttaactttttaaatgttttgtagctattgtgaatggcattttaaaaatttctttttcagatagttcattgttagtatatggaaatgctactaatttttgtatgttatttttgtttcctacaactttattgaatttctatattagttttaacagttttttggtagagtctttaattttttaaaatatattgtaatactatgttttcttcaaacagagagacatattttcactacttcctttctaatttgaatgccctttatttcttgctcttttctaattgctctggctaaaacttccagtactatgttgaacagatgtggcaagaatgggcatctttgtcttgttcctgatcttggagaaagtgctttcaacttttcattgttgagtttgatgttagctgtggttttgtcatatatggcctttgttgtgttgaggcacattccttctatacttaatttgttgagaatttttattatgaaagaattttgaattttgtcaaatgccttatctccatctattgagatgatcatatggttttgtctttcattctgttaatgttgtgtatcatatttatagatttgcatatgttgagccatccttgcaccccacgaataactcccacttgatcatggtgaatgattcttctaatgtgctgctgaatttggcttgctagtattttgatgagggtttttgcatctatgttcatcaggaatattggcctataattttctttttttttttttaatagtgtccttgtctgactttggtttcaggataactctgggctcataaaatgagtttggaattattcactctttttcaattttttgtaagaatttgagaaagattgctattacctcttctttaaatgtttggtagactatgaagtcaagccatcaggtcctgagcttttctttgatgggagatttttgactactgattcagtcaccttacgcattattgatctgttcagattttctgtttcttcataattcaaccatggtaggttttatgtttctgggaatatatccatttattctacattgttctatttgtggcatacaattgttcatagcagtcttttataatcattgtatttctgtgatatcagttgtaatgtctcctctctcatttctgagtcctttttccaaagtctagctaaaggtttgttgattttggctattttttcaaaagttttcttgatcttttctattgattttctagtgtctattttgttttttctgctccaatctttattatttccttctttctacttaatttcttttttttctagttccttgaggtataatattaagctgtttatttgagatctttttttgatgtaggcatttattactacagactttcctcttagaactgtttttgcttcatgacgtaagttttggtatgttgtgtgtcctttttcatttgtctcaagtatattttggtttcccttttaatttcatctttaacccattagttgttcaggagcatgttgtttaatctctgtttttgtgaaagtttcaaattcctcctgcaattcatttctagtttcatactatttgggttggaaaagatacttgatatggtttcagtcttcttacatttgttaagtcttgttttgtgacctaacatatgatctatcctggattatgttccatgtgcacgtgagaagaatgtgtattttgctgctgtttgaatggaatgttctgtttatgtctattaggtccatttggtctaaagtgttgtttaagtcatgtttccatatttttttccatctggatgatctgcccattgtcaaaagtgggttattgaagtccactactattattgtattattgcctatgtctccctttacaactatcaatatttgctttctatatttaggtgcttgtatgtctcttgctgtcttactttgtgattaggtgatttttctctatggcatactttgattcctttgttgttgttgtttttgagacacggtttcgctttgtcgcccaggttggagtgcggtggcatgatctcggctcactgaaacctctgcctcccaggttcaaccaattctcctgcctcggcctcctgagtagctgggattacaggtgtgcactaccatgtctggataacttttgtatttttagtagagatggggttttaccatgttggccaggcttgtcttgcactcctgacctcaagtgatctgcctgcctcggcctcccaaagtgctgggattacaggcacgagccaccatgcccagcctgattccttgctttttgtcttttatgtatctactgtagggttttgctttattgttaccatgaggcttacataaaatattttatagttataacagtctattttaagctgataatttaactttgattgcatacagaaactctatacttttaccccacatcatccacattttgtttttagtgtcacaatgtacatctttttatatttgtatcccttaagaaataattatagctattattattttttagtagttttgtctgttaaccttcatctcctgtgaaggtatttttgtgcatgggtagctattctaattgatgtttctatggagggacaagcactagaaagtcctattctgccatgttgctgatgtcacttgctcaatattttttattattattagctcagttatattattttcttcatctaaaaaatatgaattcaaaactttgtattggattttgattttaaagaatggttgagctatccttgatttcattccacttgttcttgcaaaatcacataaacatgaattccagtgtttgcacgtgaatgcatgcatgcatgcatgcatttggtgaagggaggagaggagggcctaacatttattgaacattacataccagacaccttgctagtgttgtttatttttaatagtggaaaaagctatagagactatttctgaaaatatttttgaggctagatatgaaattttcaacagaactacaaacaattctgctgaaagaaagggccatcctcctgaggaattcaagactgacttcagtctggatttagatttaactttaaattctctgctaaagacatgaccttcaactttttttttccaagaaatgttttcgacagcctgtaaaacaaattcaactcacgtgagaatgtaaatcaagttaggatatgaaatcacatatgttactttctggctccctagaagtttgacagcagagtttaggttgcaacaagcttcgagatacccgagaagacctttcatttcaaggtctgaaatgattaaatgattaaaattgctctttaataattaaacatgccatctgtataaggcagagggtgacctttcacccatggtctctcaggctgttctagaatttctgcagttggcacatatggtatcagaaatccattgctattcttcctttgaaatattagaagagcagacttagagcagctgtttttgtgctgccagatttcattgaaatgtgggttttaaaagcccttggcttgtcattttgagttagcttaccttaatcacaaatctcaccataatataattcaagtgatgcctgaaactcaatacagcagaacatttgctgaacaatgcacttagcaataataaccaagcaaaatgtacatttttcactgaaatatcattttcatgttatttgtgccctcaaaaatgtctaatagattataaatgctcctttttccataacaacaaaataccaaggaaacaatcttgagtcatcatgctctctttccccaagttggaaatatacaagagaatatgacatttggagatctgctagactatctgctttaggatttcaagactgatagtactactaaaaaattgatgcaaccctgtcattaagccaactgtagtaattagactgcagttgatgagtatacttgtatgtttgtcttaaatgtcatatcagacaacttccacagtttagtgattgacagttataatggtcagaacaaaggaacaccagtcatcataaacataatttctctgtgtctgggggaaggaggtatagaccctggctgtaacagtacttgctaattaaactgtagtatactggagacttttaatctgcctgccttcaacaggctgtttgtttattaaagttcaactgttggactacattcaagggctttcagtgttgactttagtactacttttgaagataaacataactcttcactttcatttaaagcctttgtaagaacttttaacgctgaaagaaaagataagtgagctattattattcttaaaatatacttcaaattttatttttaaaaggcaaactgtggggatttttctcttattatttaaatttgtttctcatataaacatatagccaggaatcaggaaaaatgatcttgtttgctttattgttgtatttattgtattcaggattggaatttaatgtattgaatttcgatggaattcattgggcataaggcataacataaaatagagtacagttgccattttttcctccagcaaaattttaagtcatggagataaataatgagtattcatttatttattcaaaaatatgtatttattagttcctcttaagtacatttttttgtgttggaatacttacaaccatggatgagacatttaagaactcaatctgtacataaaatagaagagaggacaattcattttgtgaagggaagttatgctaactattcactagctgctatgatttcgtcatgtcccccaaagttatgtgttggaaatttaattcccaatgcaacaatgttgagaggtgggacctttaagaggtgattaggtcatgaggggtctgcccttatgaatggattaatgccattatctagggagtcggttagttatcatgggagtaggttcctaataaaaaggagtttggctccctttcttctctcacatgtgtgctttcttccccttctgccttctaccacgggacgatgcagcaagaaggcccttaaccttggactttctagcccccagaactgtgagccaaataaatttctgttcattataaattacctagcctcaggtatttcactatagcagtacaaaacagatcaagacactggctaaccctccaaattcattctccatccttctctgccctacgtcgacctacagattgcattatctgagtttctttgctcctctgactttgggagaatagatagtaggagaagagaaagatttgggtatttattccccctactcgctcagccaaactatgtttcctttaccttatgaccacagcttcttttgggcaatccttcagttctctctgatttcagcccttccattccctgctctgtctcttcagttgcagggatggtaatagcttctcttcgttgttagtcactgggtgcttcaccgtccttggttattgttactcttgacacacctctgtatttagtcccttcattgaattctcttcaattaaccttcctgctgggctgcttactgtcacagacaggaatatggaaggtaaaggaagagaatacagggatttctttaccttcaaattttcagcacgtagatcgtgatagatctgaacaaagctactatccagataaaaaacatgcaatttctgttgctgccaacagatggcattagtagtcatagttggttatttggggccatgaagtgttccgttcttgactctgttagctgcttttctctatttttagaaaatgttttacaaatattaactccatccacacctgataaatgcaaaacagtaagagtattgggaaaagctattttagcaggcatacatttgtttatgataaagccaagaatagagattattcaaaacagatggaaaatagaaagaaaagaacaaagtttgcatatgcacaaagaatgaacttttgaaaacaggaataattttaaagggacagaaaagcattgtgtctaattgttatggactgaattttgtcctctcaaaattcatttattgatggactaatccctaatgtggctatatttggagatagggctttgaggagttaattaaggttaaatgaagtcacaagaatggggccctaacccaatagaactggtgtccttatgggaagaggaaaagacaacgggagtatatgtgcacagaagaaagaccacgtgaggacacagcaaaaaggtggccctctgtgagccaaggagagaaacctcaggagaaaccaaccctgccagcaatttgatcttggacttttagcctccagagaagtaaatttgtgaaaaataaatttctgttgttaaagccacccaatctgtgggattttgttatagcacccctagcagaccaatacacaaacccgtggacagtaatccccaagagactaagtgactaaagcaatgaaaaacatagtatttgcatgtgtggctaaaggctcagtattaatatcaaatgcttattagcattaggagagggctaggaacttgttccaaaactgaaaatgcggaatgaccctggtggcgtctcccatagctgactggatggttatcgatgctatgaatccaattaggaaaacaggggaaagaacgaatttgatggggaaaatgagtctgacttggggcatactgagtttgagttgtcttaaggacattcaagtagagacttctgaaagaacttggaatattagaccagaattaaggtgataaatgatttggggataaaaattcaattgacacatatggttgggttttagttttagtttttctgagacagggtcccactctgtcacccaggctggagtgcagcattgtgatctcggctcactgcaacctcggcctcccgggctcaagcaatcctccctcctcagccccccaagcagttgggactatgggtacccaccaccacgcctggctaatttttatgtattttttgtagagacagggttttgccatgttgcccaggctggtctcgaactcctggactcaagcgacccgcctgcctcagtctcccaaagtgctgggattacaggcatgagccacagtgcctgacctaaaacatatgtattgagcacctactgtgtgctaggcactgtctaatgcttaggttacctcagtgaacaaaagaggcaaaaacccctatctcatggagctgaaattctactggacaggagaaagaaaaaaacaaaaagcaataacataatgagtatgttatacagtattttaggagacaattcaatgccttagggcaacagagcatgccaagggaattggagatgctggtgtgaggaggtacaggttgcaatattctctaacgtcattcagattaggtctcattgagaagatggcatttgaacaaagacttgaaggtaaaagaggtagccgaggggctgtctgaaaaaagtgtggtccaggagagggaataaacactgtaaaggccctagggtgacagcatgcctggtgtatcagagagacagcaaagattccagcaaggctgtagcctaatgaaagaagaggagagtaatagtagatgatgacagaggcacaaggtggaggaggtgtcaggtcactcaggctaagtcttttgtaaggagtttgggtattactctgagtgaaatggaagcttccaaatagaggtgttaccaggtctttcattttaaaataattactggctgctgtattaccaataagcagtgagaagaaggaagggcaagggtgggagcaaggagaccagttggggcacaattgcagtaacagaagaggaggtagaagtttgctaattcgaaggtagaggtgatttactaatgaactatatgtggagtttcagagaattaaaggaatcaaggatgacttcaagagttttaaactgggaaacaagaaggataagaaaatggattaaagaaaagatcataactttcaaaagtattgagatgtttgttgccatctatttgcatatgttgaataggcattctgatatgtttgactggatattaggagtgaggttcaagctaaaaatataaatttgggagtgagcagcacgtggatggtatttacagccatgctattaattgagattaccaagataatgaatgtacttagaaaagaaaatcaaggattcagtcggggtcacgccaatagtaacagttcttggagaaaaggagcatccaaaaaacaagactgagtaggagcaaccagagaagtaggaggaaatttaagagagcatggtgaactggaagccaagtgaaaaagatatcaaggaagatggtatgataaattgcaccagatggtgttaataagtcaaggaagatgatggctgagatttgatctccatgtgctacactgaggttagcacatggaggtcattaatgtccttgacaagagcaattttgttttttgtgtatccattgtatgctttttggtttgaggttaccacgaggcttgcaaattctatcttataaccctttgttttaatctgataacaactttacactgtttgcgtaaataaacaagcaaaaagaacactgataaaatctctacaccttaactttatccccctgctttttaactttttgttgtttctatttatatcttattgtattgactatatcttgaagtgttgcagtttttttttttttttattggttcatcatttagtcttcctacttgggataagagtagtttacacaccacagttacagtgttatgatattctgtgtttttctgtgttcttattttaccagtgagttttgtatcttcaggtgattatgtgttgcttattaatgtcctttctttctgattgaagtactactccctttagcatttcttgtaggacaggtctggtattgatgaaatccctcagcttttgtttgtcttagaaagtctttatttctccttcatgtttgaaggatattttcactgtatatactattctaggataaaaggttattttcctttagtacgttaaatatgtcagccgggcgtggtggctcacgcctgtaatcccagcattttgggaggcagaggccggcggatcacgaggtcaggaaatcgagaccatcctgactaacacggtgaaaccccgtctctactaaaaaaaaaaaaaaaaatacagaaaaaaattagcccggcgtggtggccggcgcctgtagtcccagctacttgggaggctaaggcaggagaatggcgtgaacccaggaggcggagtttgcagtgagcagagttcgcaccactgcactctggtctgggcgacagagcaagactccgtctcaactaactaactaactaactaactaactaactaactaactaactaactaaatatgtcatgccaatctctcctggcctgtaaggtttccactgagaaagtttcgacttagaaaagtctgttgtcaagcgtattggagctccattgtaggtcatttgtttcttttctcttgctacttttaggatcctttgtttatccaagagccattttggtggagtgtgggggaaaagtctgattggagagggtttaagagacagttggggccaggtgtggtggctcatgcctgtaattccagaactctgagaagccgaggtgggtggatcacctgaggtcaggagttcgagaccagcctggccaacatggtaaaaccccatctccattaaatacaaaaattagctgggcgtggtggcacacacctgtagttccagctactcaggaggctgaggcaggagaatcacttgaacttggaaggtggaggttgcagtgagccgagatccaccactgcactccagcctgggtgagagagcgggactctgtctcaaaaaaactaaaaaaaaaaaaaaaaaaagagagagagagagagagagaaagagacaattggatgagcattgaagtaaataatcaagaattctcttgaaaaattttctgccaaggggaacaatgaagtgattgctagttaaggaagtggcattaggacaaggtatataagtgtttttaaagacaggatcaacaacagcatgttgatatattgtggggaatgatcctatagagactgaaaaatgagggatgcagaagagcaagaagaaagttgctggagcagtattgttgggaagatgagtagggtgagatctagtgccctcaggcggtgtatagggaaaattttctctgtgttttttcctctactcacaacactaatcaacgatcatcaacacagaagattttgtgaccaaatatgtggggctttattctccacactccaagcagcggacatcagctcagtgtcctctaattcaattcggacactgtctacccagagacaatgtcagatcctacaggttgagggctcagtccccaacactaccctccctcctccaccacataccagttgcaagtccgggcctttggaacttctgaccaaccagtttcaaggttttttgttttttgttgagactgagtcttgctctgttgcccaggctggagagcagtggcatgctctcggctctgcgacctccacctcctgggttcaagcaattctgcctcagcctcccgagtagctgggactacaggcaggcaccaccacgcccctctaattttttttttttttgtatttttagtagagatggggtttcaccatgttggccaggctggtctcacactcctgacctcaagtgatccactcgcctcagcctcccaaagtgctaggattttaggcatgtgccactacgcctgacctcaagttggagtactcataaccccctctttgggttcaattaatttgctagagtggctcacagaactccgggaaacacttacttacatttactggttcattataaaggatattacgagggaaacagatgaaaagacgcgtacatagggcaaggtgtgggggaaggggcatggagatttcatgtcctccctggtgcaccaccctccaggaacctccacatgttcagctatctggaagctcactgaaccctttcctcttgagttttgatggaagcttcatgatgtcagcattccttctcccagggtatagggtcagaccctctcatgggagggtcttaagatccacaatcagaaaggcagggaagcattagagtcctgccttgaagcagaaggtcagagtcccgcccatgaggcctcacacacctaacattatcacaaaagactgtaacaagggccatgggagttaggaaccaggaactgtggatgaaaaccaatatataacataacaccacaggcaggtttggctttgaaacggagcatgaaggaaagcagaaatgtgagtgcaaacacaggtaaatattgagttggaggctggggaaagttccttctggctggtttcattttttctgaggcagtataaacaaggtcatcagctaagagtggtttggaagtgtgacaagtggcagttgttatgttgggggtgtgtgagattgctgattccaagttggccagagttgggactaccttccttctctgggcaggatggtacttttgatgaggcaatgaagcctcagtcataaggcactgagacactgaggccagctcaagggtttcaggcatcatgggttgtgatgtcactttctcaaccctctgcctaatgtgggatgttgcaactccctgaatagattcagggacccagagctggtgaggtacacatttgggccaggggaggaagcagtaggcataccaaggtgatgctctgagggaggagatgtcctgatcttttctactattctactccaaaaattaaggatctctggtagcagacaacaatcacaatcttctgttcttaatttaggacaatgtcaaaaaactttccatgtgtatatacatatatatgtgtatatatatattcatatatatatgtgtgtatatatgtatatatatgtatatgtatatatatgcatatatacgcgtatatatatacatatatatgcatatatatgtatatatacgcgtatatatatacatatatatgcatatatatatgtatatatacgcgtatatatatataatttttttattttattttttgagacagagtttcgctcttgttgcccaggcaacaagattgtgcaatggcacaatctcggctcaccgcaacctccacctcccgggttcaaatgattctcctgcctcagcctcccgagtagctgggattacaggcatgtgctaccatgcctggctaattttgtatttttagtagagacagggtttctctgtgttggtcaggctggtctcgaactcccaacctcagatgatccacttgcctcggcctcccaaagtgctgggattacaggcgtgagccaccatgcctggctcccttatattttagatagatagatagatagatagatagatagatagatagatagatagatagatagatagatgatagacagataatgtttgtatattttgcaaatgtggatatgtgtttgtatatataaatacaaaacatatatatgtggaaatgtacttgtagataggagaagcaagagagcaaacatgatttatgaaaaaaaggagctttatacacgggatttgtagactcacattgtccccttcctcattgcggatattgagatcaactccaggaaagggcatgagaaccttccttaagaacaataattgcaaatctgttaccatcatctttcctgcctatcaggagtcttaatatgttactgtcaagggatgctcaagagacagaaaccataactcaaactggcttaaaccaatggtgaatttattgacttggatagtgataatggaacaacctgactccaggcatgatctgatccagtgtccagatggatcaccagaacctgtttctttttctgaaacaactccattttcatgctggctctctccttatgaggtggggttttctgagaagcagatgccaagacaggattagatatggttatggtttggatctccatgtatcaatgcaactcaggccctgtgtccagtaatttttaaaatgtcaagtattccacttttcctggtgtacagaccccctagtaagtggtggtaaggactgggagaattatagcatatatttgtagcaatattgcagagtcccttctaggaacctggccacctcttcattcaatgggtctggatctgaaaattaaataaagtttgggaagtgagtgatatggtttggctgtatccccacttaaatcttatcttgacttgtagttcccataatccccacgtgttgtgggagggacccagtgggaggtaattaaatcatgtggtggttatcccaagtgctgctgttctcatgatagtgagtaagttattacaagatctgatggttttataaagggttattccttctttgctcagcacttcttcctgctgccatgtgaagaagaacatatttgcttccccttctgccataactgtaagttgaggcttccccagccatgtggaactgtgagtcaattaaaccactttcctttataaattacccagtctcagatatgtccttacagcagcgtgagaatggactaatatagtaaattggtaccgggtagtgaggtactgctcactagccggtgaaagtgaaatgtgaaagtgaaagtgaaaatgtgaaagtgactttggaactaggtaacaggcagaggttggaaaagtttggaggctcagaagaagagaggaagatgtgggaaagtttggaacttcctagagacttgttgaatgactttgaccaaaatgctgatagtcatagggacagtgaagtccaggctgaaaatggagattaggaacttgttggtaactggcataaaggtgactctttctatgttttagcaaagagacgtggcattttgcccctgccctagagatctgtggaattttaacttgagagaaataatttagagtatccagtggaagaaatttctaagcaacaaagcattcaagaggtgtcttgggtgctgttaaaagcattcagttttacgtattcacaaagattggtttggaattgaaacttatgtataaaagggaagcagatcatgaaaattcagaatatttgcagcctgacaatgtgatagaaaagaaaaacccatgttctttcggaggagaaattcaagctggcttcagaaatttgcataagtaatgaggagccaaatgttgatcaccaagataatgggggaaaatgtctccagcacatatcagaggtcttcatggcagcccctcccatcacaggcccagaggcctaggaggaaaaagtggttttgttgactaggcccagggccttgctgctttgtgcagtctagagacatggtgccctgcatcccagctgtggctaaaaggggccaatgtagagctcaggctggttgcttcagggggtgcaagccccaagccttggctgcttacacgtgatgttgggcctgtaggtgcacagaaatcaaggattgagggtttggaacctcagcctagatttcagaggatgtatggaaatccctagatgtccaggcagaagtttgctgcagggatggaaccctcatggagaacctctgctaggccagtgcagaagggaaatgtgtggtcagagcccccacacagagtccccactagggcactgcctagtggagctgcaagaagagggtgaccatcttccagaccccagaatggtagctccaccaacagcttgcatcatgcacctggaatagctgcagacactcaatgccagcccatgaaggcagccaagaagggggctgtaccctgcaaagccacaggggtggaactgtccaatgctgtgggagcccacctcttgcatcagcatgacctggttgtgagacatagggtcaaaggagatcattttggagctttaagatttgactgccctgctggatttcagacttgcatgggccctgtagcccctttgttttggctaatttctcccatttggaacaggtgtatttacccaatgcctgtattcccattgtatctaggaagtaactaacttgcttttgatttttacaggctcataggcagaattgacttggcttgtctcagatgagactttggacttggacttttgagttaatgctgaaatgagttaagactttgagtgactgttgggaaagcataattgtgttttgaaatgtgaggacatgagatttggaagggttcaggggcagaatgatatgctttggctgtgtcccacccaaatctcatcttgaattgtagttcccataatccccacatgtcatgggaaggacctggtgggaggtgactgaatcatggggctggttacccctatgctgctgttcttgtgatagtgaatgaattctcacgagatctgatggttttataaggggcttttccctctttgtttggcacttctccttcctgctgccatgcgaagcaggacgtgtttgctttcccttctgccatgactctaagttttcctgaggcctccccatccatgctgaactgtaagtcaattaaacctctttcctttataaattacccagtcttagatatgtctttatagtggtgtgagaatggacgaatacagtgatcaagggatcgtgactgtttattggggtcattgtcctcagcttcctactcctccatccttgcccttttctggttgtggatgttaaacatcacccttgctggctactcccctgttttgctcctagaaatgccatgttctattaaccatctcccttccctgctgtgggtcaggcttccattgactgcccctctgatcttggtggttgtgaggttctggcttctttcatttaagtgccatgatctgatcgctattactttggaggccccagtattcccattggatattaacgattgcagctctgtgactgcttctattgtcagtcttggcctgaagaagagagctactgaacttctcagtgatgcatgtgcccttcttaccagcacattcctgatttccttggtgaatggtgtttcctctggactctcccctggaacatagttatcttgtagtttttctgacctcacataatgtagccactccagcaagccaacttctccttctcagcctttttattccttcctcttcctcctgcctaggcaactcaggcatttccactttgctcagtgttggatcactttcttaggcttctaagagccattctaacaatgagttcacactgtcccctgggtcttaccaggccattaaatttcatgtcctacaaaagtacttccaagtcaaagaaaccttgcttgttcagtttcatattctagccccttgtgcaaacaccctcaaaattcagtattggtggccctcattggctagttatatcttgtaatataatttctttcctcctttctcaggcccagcatgtccccagctggatttaaccctagttattggcctagcagccaagagaagaggtcggggttctcctgagaggacacctattaagatacccttattgtgttttccagcggaaaggtcagccccccgctgcaagttcttagattcctggaggatctgcagagtcaacattaggagtatccatccattcaccaaggccatcaggaatgtgctggtaagaagggcaccaacatcactaaaaaattcagcagctcccctctgcaagccaaaactgacagtagaggcagtcacagagctgaactcattaacatctatggggatagtggggttctcaaagtaatagagtaataatgtttcaccacagaagctgtttcaggattccaaattttcccaacccaagctcttacctttagcatacagacctgcctggctggtatcatcaaaatgtctctggagctctgtccatcggatagtgagtaaacaaatctcaaaattttatcttaccactggttctgtcagaacactcagtagcatttgtattagctcaggtccttcaagatctgctaagatgggattagaagtccaagagttttactggggaaacacaaaaaataaagcagaggccaggcacagtagctcatacctgtaatcccagcactttgggaggctgaggtgggcggaccacctgaggtaaggaatttgagaccagcctgaccaacatggagaaaccccgtctctactaaaaaaaaaatacagaattagccaggcatggtggcacatgcctgtaatcccagctacttgggaggctgagagaggagaattgcttgaacccaggaggtggaggttgtggtgagctgagatcgcgccattgcactccagcctgggcaacaagagagagcaaaactctgtctcaaaaaaaaaaaaaaaaagaaaagaaaagaaaagaaaagaaaagaaaaaataaaggggaaggagctagtgcaggtgagaaccttcagacagcaatgcaggtctgacatcagtgaagagagaggaaaggaggaaggagaatttggttggtagagtttcagagtgcagcacaattctaagaaagtttcaaccactttgatggggaattttcaagccaaaatcttccactaaaagtatcccatattagtactccttcccatgtttagtcttgcctgagagtagcttgtaggaagcatggccttgagatgaatatggtggatacatctgagggacagcagctgagtccatcagtcaattttaatttgatatgggcattttaatggccatattcaacatagtctttttttcttttattattattattttgagacagggtcttgttctgtcacccaggctggggtgtagtggtgcaatctccgttcactgcaacttctgcctcctgggctcaagtgatccttgcacctcagcctcctgagtagctggtgcacactaccatgctggttaattttttgtgttttgttttgttttgttttgttttttgtagagacagggtttcacaatgttgcccaggctggtcttgaactcctggagtcaagcaatctgcctgcctcagcttcccaaagtactaggattataggcatgagccaacgtgcccatctcccacatagacttatgatggcttttagcagctacagagactaagtccttccaaatttgaatccagaggaagacaagcatctttatcctagcattcctagcaaaagctctgagattgacttggattagaccaacctaggtcatgtgccccactcctgagccaggcatggtggccagggaagttttatgacctgctttgctcaggtgtagttttcatgtcctacttccaaagtaggagttggaactccacccataccatgagaactgagaggcaatgaggggcaggtctccaagaaacaatatgaacatagaatatatgtatttttcattttaatggctgctttagaaagcaacaagtttgctttctaaagacactgtaacaatttacagttcctccaaaaagtataatagtaccttttcccccacaacttcaccaatgatatcttagttttctttttaaatgcttgcctacctgatgtttacattattagttttaatttataatttcctagttcctagtactagtgtttctaaactatttttttcatatattcattggctacttggatttgcttttctgtccatggattctccacatctcttgtccgttttcctattgtttatcttttgtccttttttttgtcaatttataaaagcactttttatattatagctaataaccctctgtctgtcctctgcattgcaaatgggtgaagaaaaattagcctggaactctgcacatcttctcctcctccatctttattgtccatactagacccatagtcctcaggatgcagtctagatcaatatgccaggaatactatgggaaaactgcaacatttgttttttaaatttttttaaataatttttttagagaaaaggtcttgctttgttgcccagactggagtgcactgatgcgatcatagctcactgcagcctcgaacttcttggctcaagcgatcttcccacctgatcgtttttgaaaaacaaaacaagataattcctggtcaaggacaagttttcatcacccacctctacccctccccaaccacacatactggggcaagattgctcaaatttcagtcattctggaaccacctccccaatttttgccatatcctttaagttgtgtactatttatatttctgaaaattgtcctttttgcacagatttattttaaaagcatatatcgttgctattacatcattgtaactactggttatatttttccaatacgcattaaaataaattcataactatgaaaataaaagacatttatgtactacccaaaacatacctacctttaggaaactgcattagagcacgtcaataggatcaccaggctagtcaaggacaagaccaagggtttacagagctgtgagtttcacggccttaccactcattgatcgcacaaccactcccatggagtgcagtgggtggtaggttcatttacatcagagaaaaggcagcatggaagagtgcaacttctgtacacatattcaagtagtgagaattagaatccaggtctttctccaaaaaacaacaatgtagtagggaaaagtgttgatttgggagaaatagacctcagtcaagtccagtggaccaactgtacatggtattcagggcccaggaagctggacccagtgccgacgaggattgcactatgaacattctacattctggctagaacattagggattctaaggttctgctgattatgctggcatccagggcttgcaagtggcagcttcagcacccagggctgtggtaggtcacagtctctgggcgggtctcagtgtccaacactgtagctggtgcctgccaggttcccagtggctggggtcaccaggtctgaagagagatgtgctggctgcgggcatggggccagatcctcctgccagttttcctctccctctttctcatccaattgcttatcagcttctcagagaatggttttatccacagccccaggaacaatcagaaaccaagagatgggaatgaagagggtgagtgatctggagtcctgaggtgggtgccccacatgctccagcgttttttttccttttaatggtgccatcctggtgcactggaattttcatctcaaaagttgtcatttggtgttggtgggaagacattttaaaggttctagatggttttggtgaaactcagttaaattggactcagattaatttggtttatctgaaatatgaaaggtagattcaaagttttaaatttgaggaaaagcatggtttctcccccatcactttctgcatgacctatgacatataagctttttgttgtgaataagccattgggttttgttctaatcagacccactcaatggtcatagttcctctttcttaagttttttaaggtcttagttaataaaatgctttatttgttctttttcataaaaaaattacttcagtttggaggcctctctcgatttccttccaaattgaaaaaattttgaaatgttaaaagtcatgctgagttaaattcatgaacctggaaataaggttttaagtatcctaaattggaaccgtatagacaaaataagagacagaatttgaattacttggaaagtgccctgtaaagccaagattgccatttttacaaagacaatgagacagaataattactgctgtctggtttccagagtagaaaagaatgttagtatctgtaagcaaatcagtcttccttactaaaaccaaatccacagttctcagcgttgcactgaaataagaatctccttcgagggggtagggttggggcgacgctgaattaaaagagctagcttgttttctttggtttcatctttcccacagatttctcttttttaacctcttggtcacctctatacatactctaagagaaatagtgttccagtgccatcctggccccttctcccaacaaacagcacctgaaagcataggcccaaacataaaaacaaattcttccttttgttccctagcaaactggactcataccggaaatttttcacgtcttaagactttatcaaaatgctgatgaagaacaaaaaaaaaaaaaaaaagaaaaaagaaagaaaacaaataaaataaatcaaaaatcacatctaagataatctccaaagatggaagtttctgttgctagctagctcacttctagggctggccaactggagcccatgtttctaaggaaacaccttgcctgccaagggcctctcctgaatgcttgcatcttagtctcaggccagttccccttagtgcttgcatttaatcttcccatctaacaaggatatggtttcttagacatcatgatacttttcacttccaaaactgaaaaggggcttctaagccttcacgagatcctcatctatgtcccagattgtgccctaagtgacaggcaacagacaggactttgtgaaggattgcacatcaagtgagacctccccctaagcaggttgttttgatccccaggacttctatctctgatgttcatttacatttgagagcttagtaatcaatatctcaagaaattatagaaagcacttgatgcaactttgggttaatcttctagaatctaatgactggattaaaaaatatactgaaacctagagaattttcttcactaaaagtaaccagacaacaaaggggcatagtgcaaaaaataagtggcaactaaggaaagaactggaagattctagatcagaacagaatagcacagcatggcaagactccaaatgttgccactctcccttagaggtaactagtgagttactataatccaataatttttattaattctcccaaatctggagagaaacaagttgagggggtatccattctttttcttattccgaagatgagaagaggaaatggctactgcagagaaataggtggaatgaggacctgaagagagagggcctgactctctgaaggaaactcaggttcctgcgttacaagctggatttgagggtggatctagagtccaaagataccccttcatggaaatgggaaacacctctgataagctctagcaaaccttggcactggaaaatgacaaacctcaaaagagagagcagagtcagatattctaacaaagcctggcacagcctcatttgagttctcccccttgtctaatgctgaaaacaatggagtgaatagaacataaaatgccataaaactgtagcttcttgaaaaaaatctcaaggatcatggtaaggtggttaggatctcacctacactatatcagaacaaatggaaggtctgaacagagctgtgcaagcattagtagaatgaaaacaatagagcaactatgtaaaccctgcacagcaaaataaagaaataaaggagtatacgatagcatgcaaacacacacacacacacacacacacacacacacacacacacaccccaaataatctaccctagaagagaacacaactcaagaaacatgaaaatttcccacaagtgctttgagctagagaacaatcaaacgagaaatattcagtgaaacaagcctcgaagtcgatagcaagatatcagaatgaaattaaaaggcagatagctccaaggaaataaattgaaggccaaataatttgaatataaggcaaggcttccgagttttctctcttcatttgtttatttctgctaatggtgaacacaccaagaatatttgtcacatactctaagcttacttattgtggtgggctctggtagctgcctcattcctctgtcctctagcctagggggtactgttatctgggaggaggttggacttcgctttctttcccctggtaaacttctcagcctctttcatcacctgcatacccaatctcggtactaagttcccagtgttatatatacacagagtgatttctattttcctggttggatcctaacttcatatagccatctttaagacaaaaagtgctttaagattttgaccagcaggcaggtattaggaggattacagcattgacactaaggtttaaatgctgatggggaaccaggagagaaacctggtataccacttctggctgaggtaaaggaagggtgagataatataaatctcagatgggttgaaggggaatctgaaaatattaggaacttgtgactcactttctagagtttactctgaatccactggtctcatagataacatgaagctaacatggctcccaaacagtaggtaatagtagcaggaagaagtatcttagcaaatggactcaaggactgcatgtcataatcccttggacataagaattttgtagggaaaagattagagagccctaaaattcccaatatagtgggtggggtacagacaaggcagctcttgtgacagctggcagaattgaagagggaaaggtctttcacagagaatactggacctcacgtctagaaaccacagcaggaccacagatgctagacatgacactccctaagaaggggacaggtgagattcacacagtgaggctagcaaggaaggaggaggggactcagtccagtcacaccctagtgccagggcaacacataggctttgctcccagaaaagtatagcatccccaaggtaaatggggaaggagcaaaccctacatttagctaaatgtttattcaaaggaggatgaattaattgactgaacttagattgcaagtttatggttttctgccactagcagaaatgggggatttgacattatactgaattgtgatgtaaaactgaattctgatattgagaggcctagatcagattccacctcttctatgatgccttcctttagtccaccaaatctgagtgaatagttgctcctgtacttagctgcgcctctctgacagtacttgtttcaccagagaggcagaagaacacagttattacaggcagcagctcacactgcctggactcacctcccagctctgttgcttactaggcccatgctttctgtgtcacaatttccttatcagtaaaataagaataaaatagtatcttctgtaaatggttgttgtgaggatcaaatgagttaatctgtgttatgcactcagaacattttctagtacatggtaagttttcagtaaacattatgcagtcatgtgttgcttaatgacagaggtgtatcctgagaaatgcatagttaggcaatttcatcattgtgtgaatgtcatagagtgtacttacacaaacctagatagtatagcctattatacacctaggctagattagcctattgctcctaggctacaaacctatgcagcatgttactatgctgaatactgcaggcaattgtaacacaatggtaagtatttgtgtatctaaacttacctaaacatagaaatggaatagtaaaaatatacagtattataatctgaagggatggctgtcctatatgcagtctgttgaccaagatatagttatgcagcacatgactagttatagagatatatattatgacagtgctggaaaacaacatgagagccagaaaatgttaagaatccctgagaaacagaaagcaattcagatcagaccaatggagaaagccacagcctaaaacacacataagagaagactaatgtaagagtggtttctggggttgctccaagctcagcagcactgaatacaaagagcaggagggagttgtggagcagcttcctgggtgctgatcttagagcactatagctggttgcctctccaccttctcaaattatctcaagaagcaggcagcagaggcaactgccccaggttaacagtgagtgtgaattattggcctggaagggcaggaaaagatatactaccaacacactgaatctggcagcatgtcccagtcctcacccacaccacagaggtggaaatagcctatatacatacacctaaatcttaacttgattgtgctaacacaatcaagaatcatgaaatccaataaagaaaagaaccaatttattaaaacacatttaagagaggggaaaaacacctcaaaattagaaatttctcttatagaaaatggcaaggactaacaagattccaaaggaaatgactaagctggcaagtagattggcttgccacaactccaaaggtgctaaaagtagacagtgagactcaatggatcagtgccagacggtttattactcatagcacagccaacagcaggaacgtcagtatggcagcaccaaatctcctgcccccaagtcccatggagcaatgcaatgtatccagattgtgcttatgaatgcagccagatgaactggagctaaggaacccaggactaagagcttatgaacttttatggcaagcagtaaaaaatctagtccctggggagtaattgtgactatagtcacactgtggttgccttgacctatttaattgactatgttaccagatacagaataagtgcagggtcagaggataattacgccaagaagtttggcacattgagcaaggaaatccagagatgctcagggtctaggatgtatgtctctctcaacactataattagtattctcatggagatagccatgaaacaagaacagactattctggaaaagatgatgaatcttggaaattaaaaatataatcaacacaaacatagctaaagagtgaattagcaaactcaataattgagccatggaattcttacagaatgcagtacaaaagaacaagagatagcctgtagaaaaaagagacaagagttcatgccaacattaatgtaataggagtttcaggaggagagaaatggaagagaggaactaattaaagaaaaatacacagaaaaatatctttgggccaggcgtggtggctcacgcctgtaatcccagcactttgggaggccaatgtgggtggatcacgaggtcaggagatagagaccatcctggccaacatgacaaaatcccatctctactaaaaatataaaaattagccaggcgtggtggtgcacacctgtagtcccagctacttgggaggctgaggcaggagggtggagtttgcagtgagctgagatcgcgccactgcactccagcttggtgacagaatgagactctgtctcaaaaaaaaaaaaaagaaaaagaaaaatatctttaaagttttgaagaaaagaaaatggtgtcgaaactagaacatattaacagactaagccagctgtgctctagaaggtatacaaaataaaaacatttggacacttgaagagtcaaagagtttatcattcacagacatctgaaaaaaatactcaataatatccagcaaaatgaaaaatgaatccaaggggaaaatgtgggattcaagaaagagtagtaagcaaagaaactagtaaaatgaagagttaattctaaataatttattataattcaacagcaatttaaatatgtcaaataatcattaataactttaatagtaattaaaattccatctgatttctgaaatccatatgacacagaaatcatatggaagtttaactgctattaaatagttaaagttaaaattatttaactgggaagtggcatggggagaaagagaagagtaaaaacatattaggatctttgtctaggttgagaatgtagatcctgattaaatgatgatagaaagatgcatataaaatatctccccaaatttttaaaataacagctcaagaatagaaatagaatgtgtattttgaggtcactagaggaaataaaggaataaagaataaattgatggaataggatataccttacaaatgctactgaaaaagaaagcaagtgtagcaatattatataaaacagaattcaagtaaaagaaatcattaagtcaaagaaaaagtgatattccatattgacatgtagtacagtacaccaagatgacatatgacaaacctttattcacctaacaacatagttttaaaatagatgtaacaggtaaataaaatataagaagaattttaatatataaaatcttgttattttacatatactccccattgtttttttctcttagctgttcttgaaaaattttcccttgcggataaactatatttttatattattaatttattgcaatgccaataaaaaaattttgttttgatattttgcataatatattttatgccaggaatgtctaggcatttgaaattgtgattcttcatgggagaagaggatcacggatggaactttatggaataacaacatttcagacattggtaggagtggaaccagttgaagaaactgaaaaagaaagaccagcgatgttctaagagagctaggagaaatgatacagaagtcacgaaaaatgtaatcaagagcaaagaagtaaccagatagaaaacatatatgcaaacatcaggccttgagggtgaaagaatctggtacctggtaatgccatggaaatagctagaacctcgttctttaggaatagaagagaagaaagaacctactgattcatgtaacacataggtcagctgtaccctcattagttttccaataagggcaaaaatgagtattaaagagatggcttgttagttatacaaatgctcaatctaaacctcaaccatggaaccagagcaggctatttactgacataatgtgttgaggaaggaacttcctctcttcgctcttagccaaaactctttttccatctaatcaggagaaaagcatcagacaaatcctagttgaggggcattctgcaaaatatctgaaagtactgaggatagtagtcctcaaaactgtcaaggtcatgaaagcaaggcaagagtgagacattgtcgcagaccagaggagacatgatgactaaaggcaatgtggtatggatgggatcttgcaaaggagaaggacgttagtgtagagactggtgaaatcctgataaaatctggagtttagttaaaagtcacgtgccagtgttagtttcttggtttcgattaatgtaccatggtagtgtaaggtattaacaataggagggccagtgcagtggctcacacctgtaatcccagcatttgggaggctgaggcgggcggatcacgaggtcaggagatcgagaccatcctggctaacatggtgaaaccccatctctactgaaaatacaaaaaattagccgggcgtggtggcaggtgcctgtagtcccagctactcgggaggctgaagcaggagaatggcgtgaacctgggaggcggaggttgtagtgagccgagatcgtgccactgcattccagcctgggtgacagagtgagactccgtctcaaaaaaaaaaaaaaaaaaaagaaaaagaaaaaattggaaaactgggtgagggggtatacaggaactccctgtagaatcttcacaatttttctgtaaatctgaaattatacaaaaataaaaactttagtttacaaaaaagctgtgggaagcatgtagagctctgagaacagtggccaagtcatgtgtcctctgtttccctgtttctgccttccgaaaggagcctgaggccagctgtccttcacatagctgaggcagcagaatctttaccattcaccttgccttttctttcactcaactttcccatgggtatttcaaggatactttcggctaggaggaagtaacattcaataggacttaatttgaaaactgaactgtaaaattttttccccagccacatcagatctgcatccaatcaaacaatttgaaattaaatagaaagatttgacctttcccacagagcctgtgaactctgtccccaaaataatagagagagcaactttattgttgctgtatcacaaaacaactaggacattaattccagaccctttctttaaggagatgttgcagtaataaaatgaggcattgaaatgcttttttccaaattcatagtttttattctagaactttcaaatataaatcatactgtttgtttttccataaaactagaggaatgaaaatcctcatttgggaaaagtttttaaagctttgtggcaaaaaaagatagggaattaattttttttttttttttactatttaaagggttaattagttaagtaagaatatcttggcaataccatcctgaataacagcacatgatattttaaaatacaatggagttgccaatttgtttttccttactatgttttgggggttgttttttagaacttggctcatcaaagttggatgatgctatttcatgtttttccaagaaataggagaaaagacttaaaactaagaggatttatacagtactggtagggatctagatacatgaaaataatgaagtaaaatgctggggtatggatgactatggcttaaaacaggaattactaaatgaaatgcacttttatgtaaaattgagcaataaaaaggatttggattaattttggacttaattttttttaattgtagaatgtgctgtaaagaagagttgtcaattgtgcacagaagataagaaagtaagttaactttcttatgaggaagttgttctgggaatgttataaagtcacaatttacagttgtcatttaaaagatatgctaaactttgttttacacattttttataacaagaatgactcataacagttattaagatctatttatgcatttcaaaccattctttgaggatctagaaataaacaatggagataattaagtacaaacatgtacttcctctggaaaattatgcttcaaaaagaaaagaattatttgcttgaaaaaaattatactgaaattttggaataatttttgtaagtaaaggaaaagatatatcttttgagatgtggtgacaatttccttcccacttctatttcctaaagactagaaagaatgacataccattccttaaccacagtgtagatggagtcctcttctttgatgattaaatgtctgaaatcattgctcttcagttcagatttggaagaaagcagaaatgctataagttatgagggaaatggccactttgtgtcacagacaggtttgcagcaagccacataaaaaccactgtagtctaacttgtattggataacagacgatactaaaaacagaagcttgaagtcactacttagaaaagggcacactctggtagttggtgtctctcatagtgatctagatatacaccctctgccctgtcttatcttcctctaaaaagacaaatgtctatcactcgtctactttaatgaggacctgggcttctggctcatggcattctccagccagttcatactaccattgccttacatgctttccacagccagcgatgacccagacatactctttatacagtactggtgggggtctagatacgtgacctgccttcctcaaccctgccttcctcaaccctgtgtagtaagacatcacttctgtggcatctctgaaccctgcacaatctacattggctcttacattctcactcccttatactgtacctactctttagcctcaacaagacaagaacatcctccagtcctttaacactcttcttttcccttcagtttattggccctcttccatagacttccttctcttctatgaattctcatggttgttcacctgaatacaatattcttccagtttttgttgtcgttaaatgttttataaaggaaattttcaaatacaccaataaagaaagcaatataataaaactttataccccgaagagccatcttggtcaatttttttaatgtatgctcttcccctctaaatgtattattttgaagcaaatgatgatatggataccatatcattttatttaaaaatatttaagcatatatttctaattgatattttactttaaatattacaagttcatccatgatcatatctaaaagttaacaatatcatcttaatctcaccaggcacccagaaaataataaatttgtcttgttgagtcatttttgtttgtttgtttgaatcacattcatacattgcaattggctgatatgtgccttaagtatcttttaatctatatgtcccttctccctttttattttgttttttgcaacttacttgttggagaaactagattgtcctatttggtttctcatagtctggattttgctggtcacatcctaaaaggatttggattaattttagacttaatcccaaaaggatttggattaattttggacttttatcatgttcctcttttccctgttcttttgttcttataaactgataattagatataaaggctttatcagattctgtttaattttttggtaggaatgcttcatgctgagaggcccttcattaggaggtagataagattttttgtctagcatttgatgatattagcaatgatccttgcctagatctattgtttccctgggagttgtaaaaaccactactttaatggctttgatctctttttttaaatttgaaattttattttttgtgggtacatagtaggtgtacatatttatggggaacatgagatgttttgatacaggcatgcaatgcatacaccctcttatttttaacggcactggacccacattccgcaactctgattggtcctttggtttatattttcgtttgctgtgcattactagctgattgctgcttgagcatatttcatcaacatctgcatgaatacagctacaaagtcacaatttctggtctcacctgagcccaaatactacctatcacttgcttttggttagcaatattgcctaaaatttcccacagcagcaatttccccatcccatcaatatcaacagatgtattcatctccaattttatggaaaaaattgaggccttaggtataaacttcattccccaactgataacattgctgtcatttttacccatcattacctattcttatccctccttttagaggaagaataccccctgcacttcccctatatttctcttttggacttgaacatgtacatttttgaattgtaactcgtatcatttaaattgtttttatgttcaccttccccttgttctcagctccttaaggacagagtccatgtttttttattcatctttgtatctctaacacctcacacatttcccacacatggcaagcattcaataactattgaattaactcttgagccattcaaagaagggtaaattaattcagtatactctataatgtaacatgatagatacttttttaaaattttctaaatatcatttataatggaaatactgggaatatgtgtatttgagtgtaatttttaaaatatttccagtacctcatagaaatgaactaaaagataattccacatggtcaacatagaattagggtattatcctttggagaaagatcccctgccctcccagaagttggaaggatgcaaagctttcagtggtagtttctgccacctcctatactcccagagaaagtgccagagtttataagatggtaactcatgaagcaaccgagaatatttgagctctttttggactaaaaggaggataaacagatgtcttggtatattgtgctactttatgtccacttctccgtggacttggagagaatatatataccaactccttttcatttcccagaatattccaatttgtatgataaatgatattcttcttaactgtaagggaatcttccttagattctatctgaaacatttccttgtgatttcatagtgtaggactagccttcctagagttagaaaacattcttaccaaaagctcattcataaaaatcacatttacaaccccccccccacacaactcataaacatagcgtatgaaaaacatattatattttcttgatattttatattagaaataaaatttcaaaaatcaggctaactaaaaaaggagaagcatcttgtaatctgtgcttttattgctattcagtcgttatgcatccctgttgaatccttggaacgaaagttctcaatcatggtgtcacaatgataagacttgtcataagtacatttttttgctttttgctaatgagcatcataagactgttgcaactgacttaaaatcagagtagatactaggttttctccataatcacatctttctcactaactgtgacctgatatggatggttggttgagacaaaaaggcgtcaagttacagcaagcccagtgggatttttgaatctcctgcagcctactttatctattgcacagttcataggaaatgaccattactcagatgcttgtaaaatgcatttataaatgtcataccttacaacccacaaagagatgctcactttgatatttatttttctgaaaaattgtgtgtgtgtgtgtggtagggcatggagtctgggagaatggacaaggtgatggatccgaatctggatatggcagtcaacatgtggatatcacctgttgggagtccttcagctggaataaatatatggacaaccagtatcgtggattatttcccatggcaactattcccagcactttaccactgttggcatgatcctcctttcagggtttgactttccttgagaattttaagaccatctgacaggttcaagtttcctcatttttcacctgaaccaattcaatatcttttctctttcattgactttccccttgagaagtctgttctcatttctgaggtgaatcccttagtccttgcctctatctatgtgtcatacttggaaacacatgcacattcacaaactcaaagcctttctcatttccttgttccctctatgacaaatccagcctatttctgtgcattggcttccttctgagttcagacaaaatggaaaacacaaacaaaaccaaatcttctctttgtttctttctagaagctgaagtacttattctgtgcttattctaccattgcttccgtatcacacagtgtgatttaatccttagcaacctgatttagaggttacaaaagactcaataaccaaatgcaaaaacctttcaaattaatcactcattccttttggaaacttgctccttccttggcaatcttggctttatacaggccctatttcttccctcaccattttgtttcctttaccaattcctcttcttcattttcctgaatgagcacattcctaattcctaaggagcgcattccttcatttcctaaatgagcacatttcttcacactgtgtcctcactcttgtgccacatctttcacagtcctggtctctaccacaacctgcatataaagaaatcccaaattcacatccttaaatctagtgacacccaatggtgatgctcacagctgcttgattggcatttctttctggatagtttttttttttttaaatcacatcatgctcaaaatttctttaactaagtttataattttgccttccccaaagaagctcatgttctttacttgtttatttctggtaccaatatcccataattttagaaatcattggcttttttttttcttttttccccgaatctgctctccattcttttctttcacctggaaaaatcctggattttctgcacatcccatcccccaaccactggcataatattaagccatttgctttatacaatcttaaaccactaaaaattattatgtatcttcccactttctgcatgttttgattttaatgatatttttattaaaatagcaattgtgatgtccatataagcttaataaaacagctctaccctaaaatgagtactataattttcccatgaaaacataatagccatcactctaaagccttttagctggcttctcagttgtcacactccaaaaaggctgatggcttcatatttacatgggttattttccttagttacaagaaaaaaatcatgtaatttaccttaaattatacattaccaatttaggaatgttgaatatattatactgttcttgggggcaatgtgaagttctggtctttgataactttttagatgtagttaaggtattagtcacatatttttgtggcaagggacagaaaccaaactcaaactaatttaataaaaaggggaattcattggcttacaatattgggaagaccaggtgtggccttgccttcttgcacaactgaaccaaaggatgtctttctcattttcctcttttctttcatctctcagctctgcctccctctgggaattgactttatttttctcttgtggtaaatggacattctgcatacagctgggcaaggggctgactgccagcagatctaacccaatgtctgtaacttaaatagttgtaactcaaagaagattctgattggccctattggggttttatgtctggtccagcatttgttactaggctactgcctgggtcaaaagactactccagtagtaggaatagggtgagggaaaactgattggcagccacaggaccacacagggcttggggaagaggtcctcagtagaaaagggtgtgattaccagaaaaagaagaatggggacacaaagtagcagacagattttaaaaataaacgacctcagtctactatttttcccccttgacctttcaggacaggcatattctattttctccatccatccccatattttcctaaaaatgctcctggcaaaataatgcaactaaatctcaactgcaattggacttacccaaggtcactatcagctactgcccccagctctaagtctgaaatctctgagagatgtgcattactcttgatggtgtttgaatacagctccacacactccttcaagttagctatataatcagttaaactaactctcaaagacccactattcaatagaagagagaaagccggataacaacagtaaacactcctatttagaaggaggatagtggccaatagtcctataatatattccaagtctgtaatacattgttgagtttccctggctgggcagtgagttgttggtcaccagtctagctgctaccaaaggagtctcttttccattattctctgagccccaaccagagagaggcataggggagattgtctcttctggggcctgcacttctttaggagctcgcctgtggtggacttggttactggaacctgggaatcagcttagcacttaagtgcgcatagctcttagctgcaagttcaggtttttttctggcaattcatttcccttaaaaccctgctagatcttggacttgattcctagacactctgagtactaacaaccaaggccagaagtctctgtgggctgtaatctttgaatctagactttatctttgcagttccagtctttcggcaaccgtccaggaggacaagactcattcagtgaaagtggcttcaattttagatttgactgaatggcttgatttgaccgttaatcttgtccagtgtgaaacaaaagctggcctgtgatatacccttggtacttacgcagtgtctaaggggtggttctttacattggagtgaatcattacctctgctggtcccaggatgtacagcaagaagtgattgggtggggtctgggttcaatcttacaggattggttaccagcacagagccatgctacttaggttagaacccaggctcccctatttactaggtatgcaatcttatgtaagtcatttaacttctctgcaccttcttgttctcatctataaagtggacataatagtacctagatcaccgggttgtcatgagtatgaagtgagtggatatatatatataaaggacttagaatatagtacctgtcacatggtaggccctatgtaagtgacagccatttttactgctttgtcttccttttttttttttttttttgcttttccaagttcttctggttttacctcccataatgtttttcacctttatgccttgcttaagggacttagaattccattttcctatttctgcatgattatctgagcaccagtgagcagtgtggggagaggggtgaggtaaggcttgttgacagtaccaccagggccatgtgtaacagaggagcaatcccaaaggaaagagtcggggatgcaggcaagaggaatggaaagagtgatagagagattttaaaaaccatttacctcagttcttattactactttgtgaaataatatctttggttttgtttcctaaacctagagtctgagaaaggggttcaggtgcatgtgatttttgagtgactgctcttcagcaaaaatcctatggagtgacagactcagggaagataagcggcaagagccaagaaaagatgaggtcttagctaaatctcactcttggcctgaatcatgggcagcccttgggcaaaaaaagtcacaaggtagagttgttcctcacttgaggcaaggatgcccactgtttggaaccccatgtcagtcagtcactggcctggagaaatagtaaccttgtgggctaggtggtccctatcgtcgtccaagaagaggggaagctgtgagccactgggagccaaaactttttgcagctgaggtttggatgcatgggtctgacaaaggagatctcaataagttaccaaaggcatctactacaaataataataataatggttattatttattgaatacttattgagttaatactaaaaacttcctgggattgtggttattatacttggacaccacttttatttttctctttccaaatatagtgtgtttggtgtagtgaagaaaaagcatgcaaaaaatactgttttccctatttcggttgtcgattcagttctatatattggttaaactgtaaaggtgagttgtccttatttagatttttatgttctttatttcaattgacttgcaaatgctagtgatttgctacatttgaaggattataaattattacatttgccttacatattaaaatatagcaagtccaaaccaccatggcacatgtatacctatgtagcaaacctgcatgttctgcatatgtatcccagaactttaagtaaaataaaaataaaaatatagcaagtccagggatgttcattggtctttcctcctgatgtaggcttattggttgtttgcagcaattattcattcaaattaagtcaacattcattttgattggtggatgctttggcataccagtagctaaatactttaaatttccatttctaaaatctctagtgtatgatatccataacccacttaaagaatgtttgtattcttatgtcattttaggaattccaggattttttttataagctagtcctggtctgaggatatattatatctagaaacattgctataacttatattttttcagctaatgtattctacactgagaattgctattcagaataatgattcactaggactgaacaaatattaatcatcaaagaatctttaagttatactgaaatgttggacttttggtacgttatacaatacttaccaaggcaggaaaacgtaccagtaccatttaagaagtttccttaaagaattgaaacaaaatgctttctaggtaaatcctagctatgtgaaaaaacccaatctagaacaaccagttgtcttcttttttccttcactgaagtaaaaagatataaattttgccctcaaatctctgtttctttccggtactatcagatatatttaaatcatgcatgtttttgccttataaagaagttacacttcttgtaactagtatgaactagtctcctatttcatgtttgcccttctagtttcattttacaacataccaagctaataaactacattgtgcttactgagataagaaaaaaaagtttacaaggggtagaaatctggttttgcagcaagcattggttgtctctttggtaatggactgctgaaattcaaacaataaatcatttcctgctatctagatgtatctttagagatacaacagcctgagggatttgttgttttacctattaagatagtaccagaaatgagtttagaggtaaaataaagaaaaattaagccagtagcctaatagttcaccaatttaaaaataagtaaatcaaatgttaactcctctagcaacccagattatttttaaatgttagtgattgttgtgttaatggtagttttattggaatatgtaatgtatgttattgtatcattactttcaataatcatttgttaaagaatcacattgcatgatattagaaaagatgcaaatagcagaaattactgatgttctgttaacttaaaatatatttctttttatacatttcagttgacatgtttggaatcatgatgcttctactcattgcagtattaattacaggattcgtttggtactgctgcgcctatcacttttacctgcaggagtatgctcattttatccttattaagaatgcactttggggtaatatcattgaagagaatactaagctagtcatcaggaaatgttttgccttttttatgtaataaaaataatatatccacatggtaaggaagaaaagtccaaaaagtacggaaattgtaaaatgaaaaaaaaaaaaagtttaactttctcatcccccaccccacctctaacactgtcttcccagaagtaatccttttagtatggttctatttgttgttcttctgtagttacctccatatatttgattttgatggttatgttttcttttcatgattaattttagatgttatctattgacccccaatcattaaagcagaaaaatttatcttgcactatacacattttttttgctattagtaggtattatcattgtgttatttttgggttgttactatttttttcattatttttagttattagatcttaagattactaatatttctcctgttgactttgagtaatcaatttaattccttgtttctatgtctcaatccttctcctgttacacataagaaaatttggatcccttccatttatcctctctttcctctatctcctaaattctataagctttctcattaatttgaccttgtcaaatgtgtaatatttacattctgttctgtggccataattatatcttgaaatgcttactctataatttcactctaaaatttgttaactactaaaaaggataacatatttatacatgattgtataaatgttgtttaataaagaaccaaagtggagtaggaaatataattctatgccactaacctatattgcttgaaaaagaattatcaagtgccaagatcaaatagattctcttttcttactctttatttcacaaaatcatgctacatttcagcttacttcatgttacttaattgtaactttcctatacagcttttgcactttctagagttttaaattatcttcattatttctcattaacaaaaacacatgtatctttattctcatcactgtgatcattcatctttgtatttgctaaaatacattcattttcttcttataaatattcttcttaaagtcttctggcttcctgctttaacatgcaaaaattagtttctttttactgctctactgaattaggagaattttgtggttcctatacctctttttagggttgattttttccttttggtggaatacctcctcaagtaaatttttcaaagggagttcacagaaggtttggagagtatttgcatagtccattacatatcaacaaattagttttttctccttcatcccagtatgatattattttctttcttcagattgtacactttttataagaaggaactgtaaataagatagacgtgacccaaaaataagataaatgcacatttataggtcaacctgtaagtaaaatatgcttataaaaagataaggtaagtcaccatagtgcttgcagaaaaaaaaaaaaaaaaagataagggttggccaatgttccatttgcttgtttaggacctcaacttggtcaggaactttgtatttttctggcttagagatggtcttttccttattaacatacaaagacaagttaggataggatggaaggtattccttatttttcccctctgaaacaaacatacacatatacacatacaaatcagaaagaagaaccaatagggcacattacatatgtggcaaggggctgttttgtaattttttaaatatatattttcttcttaggatcctagctccttgtaagtgtcatcacttttttatatagtatttatgagtaaagtggcaaattctgcccataagagtaggggcctgagcaaatatccatcattgaagcttcttttgtccgcattttaaatgaaaaaccctgaagtctctctgaaaatatcatccaacaactgtactcagttctggtttaactctgctgtatatccaccatctcttctttctgaatttcttcaagagatcttctagaccttgttaattcaatgagtgctgtattctgtaggggtatttatcttcttaaggacttactgtacttcataaaccaaagatcctggttaggttttagaaacatgactttttcttttaaaaaaataccctagaatgaccaatgaaatatcaaaatacttattggtacatttgatctaatattattgttcaatagttatgcttataaaaattaaagcactttaaaaagttccaaatgttagagaaaacaagtgtttcattgtccatgtactcaatgcctccttgattgtcatctattcttttagcaaatatttattgagtatttattatccactaagcaatgtcattgtcatagggatataacaataagcaagaaagatcaggccgggtgtgctggctcacgcccgtaatcccagcactttgagagactgaggtgggtggatcacctgaggtcaggagttcgagaccagcctggccaacatggtgaaaccccatctctactaaaaatacaaaacttagctgggcgtggtggcacgcacctatggttccagctactcaggaggccaaggcaggagaatcgcttgaattttggaggcagaggttgcagtgagctgagatcacaccactgcaccccagcccgggtgacatagcgagactccatctaagaaaaaaaaaaaaaagaaatatcaaacccttgccttcatggagcttataacttactaaggggacacagacaagtaaacaagcaattgttaattctattgctagcttattgatattttaaattatattccatttattttaattgcttttcttaattaaatgttttaattctcctggtggagggataaaagaagaatttgataatgcaatgataaaatattgcataagaccaggtgcagtggttcacgcctataatcctaacattttgggaggccgaagtgggtggatcacttgaggccaggagttcaagaccagcctggccaacatggtgaaaccctgtctctactaaaaatacaaaaattagctgggtatggtggtgagtgcctgtaatcccagctacttaggtggctgaggaacaagaattgcttgaacccaggaggtggaggttgcagtgagctgtgatcgtgccactgcactccaacgtgggtgacagagcaagactctgtctcaaaaataataaaaaaataaaaaaagtagtctatctaatgaaaaaataatagttccaactataacttgtactgttctgaaaataagcctaattctaaattcaccatcagtttgaacagaaatcgtgtctatttttatggaagacgagaaacagttcctattcacgaccgcagtgctactggcaagtgttttcgtttatttgatggaatgtcccagactccttcagtaacagcttgctcccttgttccaaacatcaaaattaaagcatgagtaggggccaggtgcagtgactcacacctgtaatctcaatgttttgaaaggccaaggtgggaggatttgcttgaggctagaaatttgaggttatggtgaacacattgcattgcatacatattgcgccattgcatttcagcctgggccacagaggaagaccctgtctctgaaaacaacaacaaaaatcaaagtatggtaggactcataacaacagatttcatttttcccatttccatgatacattttggtaacctcaatagctataccaggattggtaaaatcacaatattgataaagatgggctaaaattttccaacccagtcggagatattcatagcttcccctgctaccccaactcgcactccacaaaagcaacccaacaaaagatgaccgttgtcttcaggaattcttgcaggctttcccagattaattcacttcatctacctagttccttggctaacctcctatccgctctcctcaactcaattctaaactttcccttacttacaaagctttcccttatccaggactcaaatcttggcttcctttggctgatcacccacagttcctgggcaggcactcccaatcctctacccaggtctggatcctgaaaacccaactggagtcaaaatcatgatctccctgttcacttaattggaccacaaaaaaattttacatcatgataatatgactgaggaaagagtactgcatagtcctttataattactattaataaataactttgcagggtgcgggggggcttcagattattttagtgctttgggctgcaggggcataatgatagggaatgtagaaaagcccaggacccatactttgaggttgcaaaatctggatgagaaacagggtaaaccttttagggtaaggatgaaatggtaagcacatacacactcttttgtcaactcctagaccttgttatgtagaaattgtttgggtgataattggatcatgaaatgtttcaaaaagctattttaggacaggagccaaagtgtaggacaaatgctgcttcttccgaaggttgaaatcaaaccagggggctgcagagaataatgctgcatttcaattttccccatccattttaaattcgacaacacattgacccaggaaaaacactgaaaagagcacaaggttaggtatttatttagtttaggtagacacggttatctttacacagattgagaattgtcagattcattgtagggaataaagtgtagtcaaattcacaaggcaggatgatttttcacccatgagagagcccaatgggaatgcctacattaaaggcttgagtaagtgaaacagggttctgcaaaagaaattgagaagaagatgaaaaagtgggagactgcagtgtcatagacatcaagagaaaggggtctgaagacggagggagagagattcataagtgtcctctggacttacacattggaagatgattggtaagatgtttgcatatggtagttttcagagtatttatgcaagacatagaataaacaggcttctgattgtggaataggaaaatatggagcctataaaatgttctgtacactgcgatactcctcacctgtgaagacagttatttttcaggattggtggtaatagtgcccttcttggtccacacttctttcctagaaaatgaattcagaagatggtttgctgggattagggattcattaagcattcattaagcatccacagcttttctgtcactggagacaactagtcttgtggtcaccatcaaatatctgatcttttcctttttgtcaattacatgttgatagtaccttaagtcacttgagccctaaatattaaaatagcaacagtattaaaatctcagaaatctttttattattcatgaatgtttcatgtttaacattttaaaaattacgtaagtttttattgacttttcctagatagaatttgaaaagataaatttattttctcttctcatagtatatgatgaatagataattgaaaagagatcctccagaaagagcagaaggaagtttcttcaatggtaaggtttcaaattatattgcgtgaattttctgcatgccattttctccgttctattaagccacttttcaggaatataattagaattattaagaaagaaaatggaaatcaaatctgtaaaatgtaggcagattttcaatgcccaaaacatgtaatagaaggcagcagaaggccaagcacagtagctgatctctgtaatcccagcactctggaaggcggaagagggaggatcacctgaggccaggagttcgagactagcccggacaatatagcgagattccatgtctacaaaaaaatttaaaaattagccagtgtggtgcctcacacctgcagtcctaacaacttggtaggccaaggtgagatcacttaagctcagttcaagaccagcctgggcaacatagcaagaccccatcactacaaacaataaaaaattagctgggcatggttgcatgtgcctgtagtcccagctcctcaggaggctgaggtgggaggattgcttgagctcaagagttggaggctgtagtgagttatgattgcgctactgcatttcagcctgggtgacgacaaagagacccccatcaatcctcccctctgcccaacccctaccattaaaagggaaggcagcagaaagtggagatataacagttcaggctgcctttgttgaaatctgggctatccatttactaagtatgccacgttagacaactaacttaatctgtttgtgccttagttcctaatttgttaatattacctaaaaacagtgactaaattattgttttggtgactttgaggacaaaatgagattttacagctaaaatttctagaactaccccgacactcagtaagttcttaataagtgtcacttgttactactgtaatcacagaatctcaacactgaaggcacttaaagttcatcctacccaacacctcttccagtgctggaatcctcttatcaacatctatggcatgtcaaatgatggacagctagggactatcctttggattacaacatagttacaaatttggctttgtgtgtgtatgtgtgtgtgtgcacatttgcctttcagcaaggttaaacatacaggcatactttcactgccacctcctacatccacctgcacagaaaggaggtctctagctagaggcacattccataattctatggcttctgaaggagtcagtgcaggttaataggagggagagggaggagaatgcaagtccttccagaagcctacagagcctcctggagaatctctagggaagagacaatatgtatcagttttaaagtttagtagagtgaccatgtatcttccaaactgggcccattttaagagtgaaagggccactattaagaattatgctaggagagcaggtgaaaaccaagggtgccctaggcaaacaacagcaagaaatgatggttaacacccaatgttgcaagggaaatgtgcacatttatttgttgttgttgggatttggcatttatagaaactttttagaaggcaatctctcagtatctattaaaatttggggttgggggggagtactctttgacctggtaattccattattcgagattttccccactgacataaatgatcctcttaatgtgatgctgaattcagtttactggtattttgtgaagaattttgcacctatattcatcagggatattagcccgcaattttcttttctcatagtgtctttgtctggcttgggtttcaggatagtactggcctcattaaatgcattgagaaggattcccttttcagtttttgagaagagttgagaaggattggtattagttatttaaatggtagaattcagcagtgaagccatgagattttggggttttcttttatgggagaccatttattactgattcaatcttgttactcattatttgtctgttcagattttctatttcttaagaattcaatctgggtgtgttgtatttgtctaggaatgtattcatttcttctaggctatcccatttgttggtgtataattcttcacagtatctcgtaatctttcatatttctgtggtatcagttgtaatgtcttctctttcatttctgattttatttaagtctctctctttttttgtagtctatctaaagggctgaccattttgtttatcttttcaaaacaccaaccattagttttgttaattttttattttaattttaattttttaactcttcttactataatagtataactttcagttttgttgattctttctattgtttttctagtgtctatcttatttctgccctgatctttattatttccttccttctattacctttgggcatagtttgttctttttctagtcctttgatgtgtaacataaggttattaatttgagatctttctttttttatgtaggcatgattgttattaacttccctctaagaattacttttgctgcatcccataaattttagtatattgtgttttaattttcatttgtctcaatatactttttgctttccatttgttttcttttttgaccccgtggttgttcagagaatgtcgtttaatttccatgttttggtgaattttccaaatttcttcttgttattgatttctagtttcatatcatcacggtcagaaaagatacctgatatgatttaaatcttcttacatttgtaaaaacttgttttgtggcctaacatatggtctacgttagtgttccatgtgtgctgaagaagaatgtcagtcaggtgcagtggctcacatctgtaatcccaacactttgggaggtcaaggcaggaagattgcttaaggccaggagtttgaaaccagcctggtcaacagagcaagatctcatctctacaaaagaaaagttaaggccgggcgcagtggctcatgcctgtaatcccaacactttgggaagccgaggcaggcggatcacgaggtcaggagatcgagaccatcctggctaacatggtgaaaccccgtctctactaaaagtacaaaaaattagccgggcgtggcggcgggcgcctgtagtcccagctactcgggaggctgaggagggagaatggcgtgaacccgggaggcggagcttgcagtgaaccgagatcgcgccactgcactccagcctgggcgacagagcgagaatccgtctcaaaaaaaaaaaaaaaaaaaaaagttaaaaagttagccaggctactaggaagggtggggcaggaggagcccttgagcccaggaggttgaggctgcagtgagccgtgatcataccactgtactccagcctgagcgacagagaaagaccctgtataaaaaaaaaaaaaaaaaaaaaaaaaaaaagaagaagaagaagaagaagccgaagtatatgtattctgttgccattggatagaaccctgtggatatgtctgttatgtccatttgtccaaagtgtagttcaagtcttatgtctccttgttgatctttttgtctggatgttatgtccattgttgagagtgggttattgaagtcccctactattactgcattattgcctgtctcttccttcagatctattaatattcatatattttgttgagtgcatgtatatttataattgttatatcctcttgatgaatgaaccccccctttttttttttgagatggagtctcgctctgttgcccagactagagtgcagtggcacgatctcggctcactgcaagctttgcctccccggctcacgccattctcctgcctcagcctcccgagtagctgggactacaggcgcccgccaccacgcctggctaattttttgtatttttagtagagacggggtttcactgtgttagccaggatggtctcgatctcctgacctcatgagaatccctttattactatattataaccataaaatggtagcagtaggttcttacctgtcaataatcaccttgaatgtaaataggttaaattctccaatgaaataaaggggctgaatggattaaaaaataagatccaactatatgctgcctgtaggagactctcttcaccatctttaaggacacacataaactgagagtgaagagatggaagaagatattcaacacaaattgaaaccaaaagagagcaggggtagctatacttatatcaaacaaaatagactttaagtccaaaactataaaaagagacaaagaacgtcattatataatgaaaactacaccaacacaatttattgtgaaagccttttttacaccagtgatataagatgaaacttttttcataaatttccattcacatttgagtatatttttgtgcatctgttcactgctattgatctatctggataatagtttcctaataccataatgttttaattgtggaggatatataagctattttaatatctggtaatggtatttaacttctctccacctcttattactctttctgtttccttttaaaaatttttttttaattttcttttctttgagacagggtctcgctctgtcagccaggctggggtgcagtggcatgatcatggctcactgcagcctccacctcctgggctcaattgatcctctggcctaagcctctcaagtatccaagcctacagatgctcactaccatgcctggctaacttttgtgatttttgtagagatgggatttcactatattgcccaggctggtctcgaacccctgggctcaagcaatccacccacctcagcgtcccaaagtgctggaattacaggcatgagccactgcacatggccctttttaacaatttttaagtttaagcagaataaagatgagttatttattttaacttgtgccaatgctaggaatttcacaaaattaaatatttggctctggaaaagataatgagtctagagtttgcagaagtactgcatgcaacggaaattcacaaatctattatagttttgtttgatttgtttcatcttagtttcctttctcctctttctttctcttttaatttgttgtcttcctatgtgtccttgttttccaacttttgtaccagaacatttcattttaaatcaagatgctattgtagggggacaatgtaactgcagaacagcattcactctacagttggccatataataatcatataaagacttttaaatgcataatgtaaaaaggtacaattttaaatgctttttgatcagtgttctttatttttttattattatttttatttttttgagacagagtcttgctctgttgctgaggctggagtgcaatggcctgatcttggctcactgcaacttctgcctcccgggttcaagcgattctcctgcctcaggctccagagtagctggaactacaggcgcatgcaagcatgcctggctaatttttgtgtttttagtagaaacgggtttcatcatgttggccaggctggtcttgaactcctcacctcaagtgatccgcatgcctcagcctcccaaaatgctgggattataggcatgagccactgcacctggccagtgttcttttaaaaataaaactgtaaaacattaaaaacaattagtcctcaccgggtgcagtggctcaggcctataatcccagcactttggaaggccaaggggggcagatcacttgagatcaggagttcaagactagcctgggcaacatggtgaaaccccatctctattaaaagtcaaaaaattagccggacttggtggtgtgcacctgtagtcccagctacttggaggctgagatgggaggatcacctgagcctggggaggtcgaggctgtggtgagctaagattgtgccgctgcactccagcctgggcaacagagggagactctgtctcagaaacaaacaaacaaaacaaacaattcatcctgataatccaaaactaccttctataagggaatattttgaaaggttagaataaggcattgaaacacactaacacaaattataaatttaaagaatagatggttaactctatcatgagaaaaagaattgattcaggaatgtgaggaaacaagacagtgaggaggaaggaataaagagctagaaagactgggtttgggggagaatgggatgagagaaagagtttaaagagaacagctgtcttaagttgggatccccaagaactaggctccaacgcagagacttgcctgcaggagttaactggggaattccctcaggagtaacacatgtaagggtcagagagaagcagacttgggtagaaggaacagttaaagtgtcatgtagtcacaagggaggcctcagtcaatcttatggggcactctggaactgggatttccttttagaattgtcccaaattatggcccaaatcccaatatcaaccatcattagatgtgggaggccctccaaaaggagatttaaccttaagtgaggtggctggctgcattggctagggcaatttccaaagagggcctggtgtctggaggtatgagcaccttgttcctgaaaggaatatctgtgcagcacaccatagcatccaccacaacatctgtcattgatttaggggaatattgagagtaatgattctgggaagatagggtttagaaatgttcaattattcattaagagcatactcctcctttacttcgttagcattttctttagaccctaagtaaacatttaaatttatttcaattatatattttcattgtttttgaattgattttaccttggattgacccaaagcagagattgggccacatatgaccacttttaaattcaggttaagcgaattttggaatgaaattaactgtgatagtaactgaaaaaggaaagatatgtaaacataatatttactagaaaaaggagatacaggcaggtttggttccagaatgctgcaatacagcaaatatcacattaaagccagtcacacattatttttttgttttccagtgcatataaaaattatgtttacgctatactgtagtctattaagtgtacaatagtattatgtctaaaaaacaacatacatacctttattaaaatacatggccagacatagtagcttacacctgtaatcccagaacttttggaagcgaggtgagagggtcacttgagaccaggaatttgagaccagcctgtgcaacatagtgagacctcatttctacagaaacatttaaaaaattagccagacatggtggtgtgcacctgtggtactagctacttgggaggctggggtgagaggatcacttgagcccaggagtttgaggctgcagtgagctctgatcctccacagcactacagcctgggtatcagagtgagaccttgtctcaagaaacccccacaaaactttactgttaaaaattgctaacaatcatctgaacatttagaaagtcacaacattttttctagtgagggtcttccgttggtgttgatggttgcagcctgatcagggtggtggttgctgaagtttgggtttgctgtggcaatgaggtttgccacatgattcgttcttcctttcattaaagatttctttgcagcatgtgatgctgtttgatagcattttacccacagtaaaacttctttcaaaattgtaatcaattctctcacaccatgatgttggtttatcaattacatttatgtaatattctaaaccctttgtagtcatttcaacaatgttcacagcatcttcaccaggagtagtttccatttcaagaaactactttctttgctcatccataacaagtggctcctcatccattcaagttttatcatgtgattgcagcaattcagtcacatcttcaggctccacttcaaattctaatctcttgctatttccaccacatctgcagtgacttcttccagtgaagtccttctccccaagtgattctcccacctcaaatgatcctcaagtgatcctcccaccacagcttcccaagtagctgggattataggcatgtgccaccacatcagtcttcactgaagtcttgaaccttttcaaagtcatccattagagttggaatatacttcttccaaactcctgttaatgttgatattttgacatcctcccatgaatcatgaatgtctttaatggcatctataatggtggattctttccagaaggttttcaatttactttacccagatccatcagaggaatcactatttatgacaactatagccttaggaaatgtatttcttaaataagacttgaaagtgaaaatgacttcttcattcatgggctgcagaatggatgttgtcttagcaggcacgaaaacattattaatctttgtgtacatctccatcagaactctcgagtgaccaggcgcattgtcaatgagcattaacattttgaaaggaatcttttttctgaggagtaagcctcaacagtgggcttaatatattcagtgagccattctgtaaacagatgtgctatcatctaggctttggcattccatttatagagtgcgggcaagtagatttagcataattcttaagtgtccttagatttttggaatagtaagtgagcactggcttcaacttaaagtcatgagttccattaacccctaacaagaaaatcagcctgtccttttgaagttttgaagccaggcattgactttttcctttctggccatgatagccctggatggcatctttttccaacagaagggtgctttgtttatattgagaatctattttttagtgtagccaccttcatcaatgatcttaggtagatcttctggataacttgctaaggcttctacattagcacctgctgcttcgccttgcacttttttattatggagatggcttctttccttcaacttcatgaaccagtctctgctagattccaatgtttcttctgcagcttccttacctctctcagccttcatagaattgaagagagttagggccttgtctgtgttagactttgacttaaaggaattttgtggctggtttgatctcccatccagactactaaaattttttccatatcagcaataaggctattttgctctttcatcatttttgggttcactggaatagcagttttaatttccttcaaggatttcttcctttgcatttacagtttggctgtttggcacaagaggcccagctttcagcctgtcttggcttttggcatgccttcctcactaagtttaatcatttctagcttttgattgaaagtgagagatgtgcaactcttcctttcacttgaacacttagaggtcattgtcaggttattaactggcctcatttcaatattgctgtgtctcactgaagagggaggcctgagaagagaaagattggggaacggccagtcagtggagcagtcagaacacatacaacatgtattgattaagtccactgtctcttatgggtgcagtttgtggcacccccataacaattacaatagtaacatcaaagatcatcatcatggatcaccataacagatataacaataatgaacaactttgaaatattgtgaggattaccaaaatgtgatagagacacagagtgagcacatactattggaaaaatggtgccgacacatttgcctgacaccaagttgccataaaccttaaatctgtagaaagcacaatatttgtgaggtacgctaaattgaagtgcaataaaataagatatgcctataattgaaaaatgggatggtttggtgaagtagaaaaaaagcacatctgctgggcatggtggctcaaacctgtaatcccagcattttgggaggctggagcaggtggatcacgaggtcaggagttcaagagcaacctggccaagatggtgaaaccctatttgtactaaaaatacaaaataattagctgggcatggtggtgggtgcctgtaatctcagctactcaggaggctgaggcagagaattgcttgaacctgggaagcagaggttgcagtgagccaagatcacgccactgcactccagcccgggcgacagagtgagactccatgtcaagagaaaaaaaaaaagcacatctaatgggacagagtgggatagagtagaaggttgtatcagagagcgtaattttcacctagaacagtaagagataagtttaaatcaaggattggcaaactttctttataaaggtccaggtagtaaatattttaggcttttggggccttataatccctgtcacaactaccttgctgttgtggtgtgaaaacagctatagaccatacataaatgaatgtatgtggctgtgtttcaataaatttttatttacaaaagcattcagagagccagatttggtttgggagtcatagtttgtggacctgttggtttagatgatcagaaagatcactgaatggcttggaagggtctacctaacttgtttcactgacttgcaacagatttttaaaagatatcaaataaaacagctgaaagaagatataaagggaaagctggaataaagtagccctatgaaacccacaaccccatcacttttgtctcatggctgattatgtgtgcacaacagtcttccttttcatgatttattaatcttgtcatgcttgacatttatattcttacttcagaaatactcagggttgtttgtttgtttggtagaaacaacgattaatccaacaaacataagccacactaataaaccccacatggttttgccaaacatatcataagacttagctaatctcatgctagcagcaacccaaaaggaaaagatttgacttctgaaacacatgtggcagggagaggggtctctccagttaatctgtgtgtttttgacaaatattttacactctatacttcattatgcacctattcaataagaacacatttgatagttttccagttttgaaatctatgtgataacttttaaccatatttgaaaagggtattcgatgccttttcagaaaaaggcaataatattttctacatccaacttgctgcccagccaaatccacaaacatggatgttagcagagaaagctattgttggactgcaggtgagatgagatgattcttaaccatcatgattgtacaaccaataggaatttactctgacattttgtttgcttttacaatttggatgcccaaataattaaaaaggtagaattaaagagaagcctttatgtgtcttggctgtcttttggtaaatatatgctgttaaattacatactaagcaggccagagcctaatgaacaaattgtgactcaaaatcatggagaaagacttaacctactgtttccttctggtagggaaaagtgtcagttaagagtgagtatgagtggcagaatgacaatagctttgttaaccgcactgtagattagatgattgttgcctgaaatgtcagttcctggttggctataagaaaatgcctgtttcggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcttgaacccgggaggcgaagcttgcagtgagccgagattccgccactgcagtccgcagtccggcctgggcgacagagcgagactccgtctcaaaaaaaaaaaaaaaaaaaaaaaaaaaaaagaaaatgcctgtttctcatttcactcaccagcttttctcccttcatttaaatggtaattacacacttacaatgcactgcaagtatctctagttttactgagtcctctgggagctctagaaaccctaggactttcataatgagggatacatttttggagttatttttttgcttgggaagattttggttctattaaattttttttctattttcacttgcacttttttttcactgaaaaccaatacaattttttccaactaaatcgggagcattggtaaaattgaataatgacattcaagtcatgtaattttcaattacatttatatcttaagtattttaattaccttggcagttactgcatacatgccagtttggtattgagtgccattttctcataaataagtcagattaatttccattaattcttcccccattttttcccttttaaaaattgtattcttaggctgggcttggggactcacacctgtaatcccagcactttgggaggccaacaagggaggactacttgagctcagaagttcaaaaccagtctgagcaacatgatgagaccctgtctctactaaaaaaaatttttttaattagctggatatggtagcatgcacctatagtcctagctacttgagagggtgaggcaggaggatggcttgagctggagagatgaaggctgcagcaagctatgattatgccactgcactctagcctgggtgacagagtaagaccctgtctcaaaaaaagttatattcttattttattttaaaatctaatgggtaattctaattcttcatctttccttttttccttctgctttgtgtgcattgcattaagttcaagattcattttggtattctgtatcagtaactacttatttctctggtgtggtattttttactgatcttctagaggtttcaggcaaaacttaatggtctggtgaaattaacaatgaccagtacagaatatgggtcactcgatatattcctgacctattgtttgtataaacaatttttattctttcaatatcaagatcactttgatgtaaaacttcatcaaattcttgggaggaccagcacttgttttttgcgaagttagttataataattaggcagtcaatgtataaagacaaaaggtgatcaaaatacagtgtagggataacatttttttctgtaagtgtatgtagtgatgatttctgtgaaaagctatctaaataaaataaaaccacgtaaatgaaaccctgataatagtaagggcaatgcatttttctcaagggacttctcctaaaatgtgacaagcatttttgaggagttagggtggagtgggcaggaggcttctgtagttaggctcaaagttgcatctggagtttactagctgtgaaacctaaggtaaattgtttaacatctctgagacttgattacctcatctggaatacaggaaaaataataaccatttttcaaggagggttaggaataatttaggaaaaactcctagaatataatacataatcactaaatggtgattcttgggctctcgggcaagggaaggagccaggcaagatagggccatgaagtagaaggagctcaatctcagggccagaaatatcttggattctcatctctgccccaacagtttttcactgtttaacactaagcaaattatttaaatgacttaagtattcctgtataaaaggaaacaatgctacaaaagctgtgtgagatgtaatttaaataccatgtataaagcactttttatagtacctgacacatagtagatgctcaataaatggttatattattacctattatgagcctattatgtcactgtaattctagaggcgctgtgagatcataaagaggaactttacagggtaccataaggcacttgagatctttcaaggaagacaagcccttgagataagtataagtttagatactataaaatatcagactgggcacaatagctcacacctgtaatcccagtactttgggaggctgaggtgggtggatagcctgagctcaggagttcaagatcagcctggacaacatgatgaaaccctgtctctaccaaaaaaatacaaaaaaaatttagccaggcatggtggtggtgcacgcctatagtcccagtgacttggggggctgaggtgcaacgattgcttcagcacaagaagcagaggttgcagtgagctgagattgcgccactgcctccagtctgggcaacagtgagaactcgtctcaaaaaaaaaaaaaaaaagaaaagaaaagaaaaaatatttctacagtaagttccatgttaggcacctaagagttgagttaaagcctaaagaactcatgtagtacatggagatcaaataaggcttaatggaggtatcatggtctcctacctgagcttcaagaatgtacagtttatcaacaggcagattggagctgctaggggaggaaattttcaggggaggacattttcgggggaggaatcagaataaacagtagacatgaaggtgaaaaagtacagattatacctgagcaatagtaaataaattctgctattcacttacagtataaggaacaggtaaggtgagaacgtaacagctgacactttttgggcatttataatattctgggcactgttctaaggactttacatgtgttaactcattgaaaccttacaacaatcccttgaggtaaatcctaatattagccgtactttaagacaaggaaactaagcctttatattgcctttatgtgagatagacaatggtgccacttactttgaggctgtagaagccctgtgctgaaacgtagcgtggtgaatggtatgtggactatgcttccacactcactcatccctcagccagccttgtgccgggaccctcagcctagacatgtgtgcgcagtggccctgctcaatgtcgcacaggtgaggtgagcaatctggcttcagaggctgagctttcaatcatgactctgtgatgagaaaggcacttgggccttatttgtggggaatcttgaaatctccacatagggatatgaactttattttaaagatgacatggaaatatagcctttattttgaaggaatgtgaaggcttttttttttttttggaggggcggacaacagcataatcagatttgtaaggaaacataccttgatggtgttattggggggatggggaagtgggttgggtgggtggtttaaagaaggaaagattcagtcaggaaaaccagtcaggaggagactgctaggcattaaattgagcacagatgagagcccaaacaagggtggtagcactggaaactgggaagaagtgacagacttgaatgacattcaagttagaattggcaagtcctggtgatcatttagaagtagggagtgaaaaagagtccctggaagagaccccaaagtctccactgtgggtggctggaagatacggatgctgttaatataaaggaggaaaacaggaggaagggcaagaaagttttggtgagaaggatgaagtctgcatgttgaattagtagtgatagcaagacatgcatgtagtaactccaaccagaagctggaattgtgaatctggagctggggatatttgcgctagagacctagtgaggaaacagtttacaaacatgaagccaggggtgtgggtgagagtgactgtggagtggacccttcaagatagccttaatataaagtgtggatagaagttgtgatttcccgcaagaagctggaggctgggactcacagggcaagtgggctgggacacacagtgctgaggtgcagtataagggtggtcaggagcaccaaatgcagagtgcaagcaaacattgttcatatgcataacctattaatatttgtaaactacagtaatgcttttaaaatcttaggatgtttcaaggtactaagacgcacttcactaaataataggtcctatagtagctgaaaatagattgtagctttccaaagtgccttgaattgcaggatgcattttacatactaagagaagaatcatataccataaatgttttcttttacaagacagtggctacctgggagcatcatgtagagatgtcatctgagcaatgaatgtccaggctcagtgggaaagagcactgggatctgtagcaatatctgccctgtgtggaagggcggggaccactgtgcctaaattggctttccctcaattaaaggctttccaaggtactgttaaaattaaatttctatgattgtcagtgcctagtttatcacacatatttacatattatccgaaaagaaaaaacaaaagaaaaaaaagtgcaaattgactccttataattttgtggtagcacagctctgcagtagcctagatttatgaaatgatgctaaatgtcaggctctctagagtgaatgaatgaaaaaaaatgatatgccttcaataggataaataagggagaatcatgtacacacctttaactcagccctttcctaatacgagctttatttgtgtgtgtgtgtgtgcacgcacatgcatgcatgtatgtttgcctgtgtctatgtgtgtgtctttagttgtttgggactttggataaatattctaatggaagtatggtaggaatgtgtgaagaaaattgaaggtaattgcttcttactgaaagaggaagaaaagtttttgaagtttctccagttcaagaacttttattatagaaatccacaggcaggcaatgtaaaaaagcaaatgctgtgtgaaattattcaccgaggagatggtaaccatatcaataaagttttggaggagactttccactgttctatgtaaataactgtgttgcagcttttgttttatgagtactcattatcatagaaatttactgtttttagtcttgaaaatgtggtgcttaaaaacttggaaaataccactgtaattaaatatctattggagttaactctggaataccgtaattttgttttgcagacatcggagctataatcttttgtatttcttctctttactctgttgtcagaacttacaccagtcatcatctctgtgacaatacaagccccttgagggcaaggacagtattttttttttttgtaatcactgtgccattggcaccacctggtatagtgtctggcctctctttagtctcctctaacttttcttcttcttgtccactgatgttttcaagagtcaactttcataacccctcttaggaaagtgtaagatatagtgcctgccatcaaaaaacttaaaatctagttgctgagaggatagcccccagaaacagataataaacaagtgttactaataacttagagaacagatatactgtaattttcacagtaacttttaaaccttgattgcatctttattccctttttagccatggctgaattccttagtgatataggaaaggaccttcacaatttgggctcaagagatagaacaatggataatgaccctgccattactattttctgtgcacagttaatatctctttttccgtatggttggtctcaccattttctttctgataagaggcgcttgcaccaattccaggtatttatttataatgtagttaaaactcttaactttttttcaaaccttatttccactgccatctccaaacaatttttactggttttccttaagcagatgttgtctctttcctctggaattgccagctcgctttacttttccctctctcctcatactcatcttaagagggaaattgtgttttactcaatagagtatagaatcccagctctatcacttactgtttgtgatatcttgggcatattattaacctctctatgtctcggtttcttcatctgtaaaatagggattaaaaataattggttgttcacatggttgtggtgatacaatgagctaacatattgctacagatcactgtgttccttccactcagcctgggcattgctcagaatacttctctatatgatactttgcacataataaacactcagtaaatagcagctgcaatagcagcaccttatagttcttgacatagagtcgttatacatgttgacttgaatagtaatgataagattgagtaagtgataagattatttttctctggatcagataagaataaagggagtcagaaaaagatagctccaagtagaatggagctgattaaataaacatttattgagcttttgccttgtgccaggcattgggaatataagttgtacaacacaggcgatgctctctgcccttgtggagcttatattcctaggtggatacaaaaaaaagtgaagagcaaagccaataatttaaaattgtggcactgctgggaagaaaagaagggagtaaaattaggggaaagaagggtggagaatgtacttgcaataactaggaaaggcctatttattgaaggagtagggtttcagcaaagacaaaaatagaataaggagtcagctagaagacaagtgggagaagggacgaaccgggtggaggctccaaggagagacagagcttggggtgttagagaaactggaagttctttgtggctatagaaatattcggggataagattatgtcaggatttattggccattctaaagagttggggttgcagtagactgagaggtgtgatgttcagctgagctttagactataaaaatgtagagaaatatttggaagtagacatttgagatggaagagcaaagacatggggttgtgactaacaatagtgtcaaggaagacaagaagtagtctgttgaaatggaggagttgcactggggaataagaaaaacaattgtcttttggacgatattattctacagaacagctgctgctttacagtaacagactttgacaggacttctttcttagcagatgaaaagttgaactgatgtggtgaccttttggaatagatggtttctttactgccaagttgaaccctttctgggaatatttgtgttgagtgagctttctaaccttagtgcagggtgagtcaatgagatccttcatgaacattccctttcgtgttggcagaaggaaataaatcgtttatgttagtttgggtaattgaagaagcttgtcatttccaatttactctggtgtatgtggctaatttaagttgataatcattaaccatgtacagcttttcaagggatgaatcaggagttggaaaacattacatttctgtaaaaattggtgtaacggccttgaacttaagctttctagtttgaaggtgaaacttgagagttagcactgtattgtatttccaataatgaatgtgtcttttttctttcaggcttccttcaggattttaatcatccttacagcctctttgagaatgattgaacttccaaattccctgaagttaaaattttaaattctattaaacattttttcgagtatttcattacttttacattatgacttgtacagtaatttgagatcataagggttgaaaaatatcttcaaataagtttttatagttaaaatttttttgacttttcaaaagttcttcttcctagctcatttcataatcttcaaatgtagattctctttgaacataaagtggtataaatatagaatgttcaggcacctgacgtataaatttacatacggtttgaagattggagggtataccctgtgatagtgtctgacattgttattttctcgtcagtgttaccagacagtaaataaatacttcaattctgccaggggaggtggctcacgcctgtaatcccagcactttggaggccgaggtgggcagatcatgtggtcaggagtttgaaaccagcctggccaacattgtgaaaccctgtctctactaaaaatataaaaattagctgggcatggtggcacatgcctgtaatcccagctactcaggaggctgaggcaggagaattgcttgaacctgggaggtggaggttgcagtgagccgagattgtgccactgcactccagcctgggtgacagagcaagactccatctcggaaaaaaaaaatcaattataattttgtttacatgtattattacacaaaatggtccattattcagaagcctcccatttgaggtaatgattggtattattaggatcttttgatgaaatcttggttgaattgatgataatatgtttttaaaatatatagatgtttttatttcccaaataaaagaaataaagactctttacaatttaaggagaatattagagaatttttaaaataggtcaggcacggtggctcacgcctgtaatctcagcactttgggaggctgaggcaggcagatcacttgagatcaggagttcaagaccaacctggccaacatggtgaaactccatctctactaaaactacaaaaattagctgggtgtggtggtgggtgcctgtagtcccagctacccaggaagctgaggcaggagaatcacttgaacctgcaaggcggaggttacagtgagccaagatcccactgctgcactccagcctgggcgacagagcaagactccgtctcaaagaaacaaacaaaaaataaaaaataaaataaaattatgccagacttgtttcaatatcaatagttcttcattaaaattcagtaatgttctgttatattcattaataattatttcaccaacttctttttcataacttccacttgttaggcaaaatttggaagaagaaagtataagtgtatatttgatatttttgctatttgcagtactttgatataaaataaacatgacttcaggtgagcttgagagtacagggcatgtgatattaaaaattgtaagaaaaaagtgatccactttcatagtggtggtgaatgaagctggattttatatatattaaaagtattccttaaagatatcaaggctggaattgcttgagctaggaaaaactaaatttttctgtttgtaactccagcaagacagatcttacattggatcaaagattgatttctctactagaaattttgactttggttaaggagctgaaatagcaatgtggaaataagtaagctcttttgttccaccagaatctcagaacttcctctgcctttgcccccattaagtaaggccatctagacaactgagtttgtttctcctgtctcgagtttcccttagttgtttctgggagtttgtcctcacttaagagtggatgctgaacctcactgtgaatggaggatgtcttatagtactctcagtttgcctttatggttatcttggtgatagtttttttcagtaacattcttgggggatatgcatgctgggtaaatcattctgtctcatttgtctgttggaaatacagttctggcactaagatatggtgaacagacagatggaggccacaacattcaagctttattaaacttgccacaggttagagctttaatctcctaattctagataaaggtgggatgcttacacgtagaaaaattaggaagaataactggaggttgtacttattttgactatttataagattaccagccgggagtggtggctcacgcctgtaatcccagcactttgggaggcttaggtgggaggattgcttgaggccagttgtttaagaccaacctgggcaacaaagtgaggccccttggaatgtatatacgaaaaaaaaaaaaagtcattgctagatttaagtatattttatttttttagagggattaatatctcaaaagcatgttaacttttagaatattaaaagtatatctagtttttcttaattccctacttgtagatattttcacatacttttcaaaatctcattaattgatggtttggggagagtttcattttttttctcttttcaccataggaaattctgatttgttttcttggctcaaaacaattcagatagactgtgttatcctctgtagaatatcatgtcaccctcaataaatcatgaaaaaaaatcatcctttaattacacaacctgagtatggcctttaatttctaatcatctgaaaaaatgcataatcatctttaagtaaaagaaatgaaaaacattaagccatagtaagaacttttattttatttccattacaacagaagtttttaaattaatttcttcatgactggctctaatcaattcattttagaatctaacacgattctattcacaaaaattatttagtttttccagtttttaaatattattttatatagccgtatttagtaattattgataatcctaattacaaaatacacaatactatttccaaatgattaaattttggattttttgtgttaaatgaaattattaataaccttttttttctgttttgggtgacttttttctttcatcacctatcaatcagtgaatctaagaaagtaaagtgcaaatcagctgactgcctttgaagaaaaataatttgagatgagaataagttgatagtgtagtaataaggtctagtgatagctttcccaggagataacttatgcaaaaatgatggaggtctgcccatcattgcatatagaatgctgacattcttgattttaataggaaagcatttatcttttgcacctgctccagtatatgaatagctgtcacgtatttcaacaaaagagaagaaaaactgtcactatgatttaagaaatatgcattggtgtaagaaaaagtgaaatattttgagcagctagaatttatttttcttgctctattatgcctcgtttctacaatgaattatttaagctttgtttaatcgtattagtattttcctgttgagttcatcagtatgacttcatcattatagaaaggtccttgaattattaaagagtgcctgtgtgcatgctttaggagtaaaaggttagtgcatttatgatttctaagttttcagtgatatgcaacaaaatgaagcatctggctaaaatgtaaatgtcatctttgggagaattacatcatgaagacataaaatttaaagttgataacattaaaatttattcctaaaatttcactaattaaaataaaacaactaaaaaatagaataaaatgtattttgaaattgatattaaaaaacaaaagtttattacaggtttttagattcttgatatgttgaccatggagcagagcctttaaatgtgttaaaaacattgaaatgctactgccttttcacatttttatttctaaatattaccacttttctgggtaaaattatgaaggaagcctattagatcttttttacatttctgttttcccagcaggtgtttcccttcatggcattttacatgctgatttttcttctgcttcctttcagttttaattttcattttataaatatgcaggagattttatgattatacacacccaaacccatgcatagggtttatacatgtataaagtatagctgtaatttaatttggctcatcttttaacatactaaaatgaagtaccaaaagtaatttttccccttgagagtgttcactattggacattattcacttattttggcattcctaatattatttaaaatgtctttggacctcttcctttgcaatattcttaacaatctgcagaacatttgaaagatgtacatcttcatggtggcaggtcatcattctttaaggatggttgagaaatggaaacatagaatttgtttttgaaatagcagaaaggcattcagagccatatgtgatgaacaggtaattgattgttttagagcatccatttttggtcaaagtcagggctaggctataaagaactaattgtgtgcatgggagaggaaaaatgaaaaggcagcaaggaaaaggaggggccaaactgactgtgataacaatttaaaaagaaaaatctgaaatggcttcagcagttgttcaaaaagcatagggctttccacggtgactattttgaaagcatagcaatcatttggaagtactggcaacccatgaagcactgagattttatgattttcatttatgcttctgagtccattatatccatattaggatttaaaatgaacagcatataaattaaagctgactctgatgaattcttcctaaggcccttctatccacccagcaacagtctggccaaaaaccttactccccaccaggtaccattctgtttgattcttactggggagacacttgttagctttgttgaattactggaaactcttcatttgcataaataatgctgaatcaagaaaatccagaaaatgtcagctttggacagagagaacaaagtaaatttagaaaagagaaaggagcctaggttccgagatagtcaccattctaaccagaattttgggtggtgtttacacccaagctaccatctggtgagggatcaaaaatgacctatttaataacagctgctagcatgtcttacatcaggtgattgaatgatatacttggaaatagaagatcgagttttagatttaggagaccttagttcaacttagtttccttagttcagctttgacattgttattggtgatcgtggcaagttacttcaagaaaatggtggttttctcattttttaaatgaatcatttgagatagatactagcacatttattttatagataagaaattttttaaacaaggcaaaataaactgcccaagattatgtgattttcagagtggagacaggatttcaagcacacagcttttgtctcataagaagctgattctttgtgagatagcagctcaaccttttcctttaaatatgtataaaatcattcaataattggttatcatgccataaaagacttccccgtcagtgaaactgaatagttctggagaaaaatgctttctcaactatacacccatcaaccagaagaacccatgcttggttttaaagttaaggataggtttactttttattacccttttgtttggtttgaatacttccagtgatttccagctcaaatgtttactttgttcatcaccataaaaaaatcccaaaacacatagattatattaagggcagtcttctagtctgcccttagaagaaatcaaatactgaaaccctagggaatctggttccattcttaggctttatgtcccatgttgaatcctaacaccatttgaaagcttactatgtacaaaacattataggttgttgataataattgcaatagcaacattgcatgtaaaaatattacaaaacctcagtggacatcatgcactatggatacatattctactggaaggaaggatgttttcatattctcttgcataaacttgctgctctagcctatagacagagattatttcatctttaaagataattaaaacagaaaaaaaataatggaatgtttataaacatctgcaattgccaatatggttttttgttttatgtttgttttttgccacaggagagcagaagaaaaaacttacagttcaaaaatgcttaatcaagtgttgttgattctctaaaatttctcctcaaagatgcctggcaaaatatctccaaaagagcttttagcattctataatcatgcattctgatttgttgctctaagggaaaaaaataaaatctagaattgcttaaacggtagaactatttgcaatattttataaaattgagctatattaagtacagtgttacaagatggttactatattgtactatttagtaaatactttctgatgtcttagagtatataccatttggtttaaagataagtacattttgaatatatgaatgataaacatagcattttgctaactattaaaatgttgaccctcagatccttagtcaagataaaacttttaccatatttttcctttgaggataaaagaacaaacttgcattattattattagcttatggaataaaaagaataaaattttatgtaactttaaattaacaaggcattgtcgcattataattcaatgagttaggctttttcctttctccatatccttcttccttcacctccttcattcttctttgtttgggtaaccatatgccccaaattgcataagaaagtctcaatttatgcctgttgtcttagtgtaattaaaaatacaacatcctcaaataaacatgtgaaaacatatttaccatcattagtcactaggaaaatgcaaaataaagccaagttcagatactcactagaatggttaaaattttttaaaccgtccataccagttgttgacaaagatgtagagaaactttaatttcacccatttctgtaaagaacctaaaatcgtgcaaccactttgcaaaatcaacagtttctcaaaaacttaaatacagctaccagtggtaactcagccattctactcctagatatttacataagaaaaatgagtacatatgtccataccaaaacttttccatgaatgtttatagaagctttgtttataataacccagaactggaaatccaaatgtacatcaccaggagaatggataaacaatttatagtatatctatacaatggaatactactcagaaataaataggaccaaactattgataccacaacatgtaagaatctctaattgtgtgaaagaagtcaaatgaaaagggacataatgtataattctgtttgtataaaattctagataatgcaaactatagtgacaaaaaccaggtcagtggttgcctggagataggaagtagggaatgaaaggaggaattacagagaggcacaagggatggtggatatgtttatcatcttgactgtggcaacagtttcacgggtgtatgtcagaactcaccaaactgtgcgacttaaatttgcagttcattgcgtgtcatttatgtctcattcaggctgttaaaatagcgccaccttttgctttcaaaagtatcacagtttaaatgctggtaaaagtctatttcttgatctaaatgctggtttaatagatttttaaatctgggtgttaatttcatagtttactcggtttgcaaaaatccactcaaaatatgtgcacttttctacacatatattaacttcaactcacctttttcctccaaaaagcctaaaagattccctgagggggatatgcagaaaatgtcccaactagacaataaattacaaggacaccctattgtttttcattttcaacttcagaaacaagaaaactaagattagaaacaactttcaaaaagccacaaaaataggaaatatgtcagtggagacttcaactagggaattttttgcttgaaagtctatatgctttcctgtgttttttaggtcagtgaaagaactggcctatctttaataaaggtttgttatgttaaaaaccaatcatccttctgtaatcccttggccccctttaggaggccaaggtgggtggatcacttgaggccaggagttcaagactggcctggccaacatagcaaaaccccatctctactaaaaatacaaaaaattagctggggcatggtggcacatacctgtaatcccagctacttgggtggctgagacatgagaatcacttcaaccctgggggcagaggttgcagtgagctgagattgcaccactctactccagcctggacaacagaatgagattctgtcttaaaaaaaaaaatcatccttattccttatgatcacctctgtacactcatataattcctgacaattcacatcagattccttctcagttaaagaataacatttatttccataattagagcacattttgggacacaaagcaactgatccttgtcagttatcacaatggtgcacatatggtctttgggacaaggaactataataggaagtgttttatggaaacaaaagacttcccactaatggagagaatataattctgaccatagaataaaatggccaataggagaaaatgatatattcatcagtattttgagatacaataaacaattatgaagaaaaacccatgcgccaatggagagttttacatattttggtggcaataactccgtggaaaatcttttctctgtggaagattattgattaccataataaaaagaaagaaagaaatgagcttttgatattaaatagccatttggtttagaaatagacataaaacaatgaattgattttaaagtaataaggctcatataattttaataatcccaccccaaatattaagttgtattattaaggtcctttgcatgcagtagaccttcaaagtggtgtagactaattccagttcatggccagtttagcttaaggagagggagggagagggtaataaggcaggcagggaagaaaaagaaaacgatagccacagcagagcaagagacagctgagtaatgctctgcaggtttctgaaatgttattcccagtgatcttcagctgttacttaaggctttgggccccttatatagtgtagaagtttcttttggttgcctacccaatatctctttctttacacacaggtgctaaaatgcccctgattttgtttaagtagctaccgttctccatatggccatatatttgagggaggctgacctgatttttttttttttattatactttaagttttagggtacatgtgcacattgtgcaggttagttacatatgtatacatgtgccatgctggtgcgctgcacccactaactcgtcatctagcattaggtatatctcccaatgccatccctcccccctccccccaccccaccacagtccccagagtgtgatattccccttcctgtgtccatgtaatctcattgttcaattcccacctatgagtgagaatatgcagtgtttggttttttgttcttgcaatagtttactgagaatgatgatttccaatttcatccatgtccctacaaaggacaggaactcatcattttttatggctgcatagtattccatggtgtatatgtgccacattttcttaatccagtctatcattgttgggcatttgggttggttccaagtctttgctattgtgaataatgcctcagtaaacatacgtgtgcatgtgtctttatagcagcatgatttatagtcatttgggtatatacccagtaatgggattgctgggtcaaatggtatttctagttctagatccctgaggaatcgccacactgacttccacaatggttgaactagtttacagtcccaccaacagtgtaaaagtgttcccatttgtccacatcctctccagcacctgttgtttcctgactttttaatgattgtcattctaactggtgtgagatggtatctcatagtggttttgatttgcatttctctgatggccagtgatgatgagcattttttcatgttttttggctgcataaatgtcttcttttgagaagtgtctgttcacatccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctatgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcgacgttatttctgagggctctgttctgctccattgcaaggctggttcaatatacgcaaatcaataaatgtaatccagcatataaacagtggcctgattcttagtagataaatcctaactgctctatggcactctcactttacttccagtcactgttctagaaaggacacataactcaattcttaccatccagaaatgagaaatctgctggaagcttttagaaaaggttcccccactcttaagacacaaggaagacaccttcctcttcctcagctggacattattgtgtctgaaagtcatttccagatttgctgtagttactttcttatcatgagataagtaagtctatgggaaaagttgatacgttaaggacagaactgaaaaatacgtccttgatgatgtcattgaactacggaattatcgaattctagagttgctactagccaaccaagtgaccttgaaggattgttgtgagcctatgttgcctatgaaataagaaggataaattatttacttgatccatctgggacccttcagctctatcatcattctatggttctcacaatgtacaaaccatttcactgaagttactgaatacttcttgccggcgaaaatatataatccagagaatgcaaatatcagtgagctctaacatgaatttgtcagtgtaatttctgggaatatgagttttaaaagttgcctgaggccatgctcttaaaagatttctaggcattctaaatatcacaagctcatatgtgcttactgttgataccgtgtgaaaaataattggtaagaagctggagtaagtgctgtgctgcagaatctaggctggaactcttgatgttcttgttatatttattacaatataaaagaagagatgggctactccaggtaagctcacctcactcattttttgggggccattataccttcatactgaggtattttataagttggtgattttcacactactctgactttacaattttgaagtttcagcttaaatgagatgaaatgaaattgttctttgtgccaggagttaacagggactattctcttttgctttcaatggtgttgctgctactacctaactgttaacttatatccagtgttttaaaaccatttcatgttggtctggttttgttggtggtgtttcagaattgctgaacttttcaatagtctactgacatttgttttcaaaaccaataaaggagggggatgattcttgcatcaagtggtattttaagctaaatgatctccaaggccttatcccactcttgagaattcctcagaagtaaacattttcctcagtggattttttttctatttatttatttatttattgagatggagtttccctcttgtcacccaggctgggatgcaatgatgcgatcttggctcactgcaacctccatctcccgggttcaagagattctcctgccttagcctcccaaatagctgggattacaggcacccgctaccatgcccggataatttttgtatttttagtggagacagggtttcaccatgttggccaggctggtcttgaactcctgatctcaggtgatccacctgcctcagcctcccaaagtgctgggattacaggcgtgagtcaccacatctgaccttttttttttctatttaataaaacaactattaatgtttcaaaattattgatagaaaaggaagtgcttttttagtcttttttttattattatactttaagttctaaggtacatgtgcacaacatggaggttagttacatatgtatacgtgttccatgttggtgtgctgcacccagcaactcatcatttaacattaggtagatctccaaatgctatcccttccccccaccccaccccacaacaggccctggtgtgtgatgtaccccttcctgtgtccatgtgttctcattgttcgattcccacctatgagtgagaacatgcagtgtttggttttctgtccttgtgatagtttgctgaaaatgatggtttctagcttcatccatgtccctaaaagggacatgaactcatccttttttatggctgcatagtattccatggtgtatatgtgccacattttcttaatccagtctatcattgttggacatttgggttggttccaagtccttgctattgtgagtagtgccacaataaacatacgtgtgcgtgtgtctttatagcagcatgatttgtaatcctttgggtatatacccagtaatgggattgctgggtcaaatggtatttctagctctagatccctgaggaattgccacactgacttccacaatggttgaactagtttacagtctcaccaacagtgtaaaagtgttcctatttctccacatcctctccagcacctgttgtttcctgactttttaatgattgccattctaaatggtttgagatggtatctcattgtggttttgatttgtatttctctgatggccggtgatgatgagcattttttcatgtgtcttttggctgcataaatgtcttcttttgagaagtgtctgttcacatcctttgcccactttttgatggggttgtttgtttttttcttgtaaatttgtttgagttcattgtcgattctggatattagccctttgtcagatgagtagattgcaaaaattttctcccattctgtagcttgcctgttcactctgatagtagtttgttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaatatttaagtctttaatccatcttgaattaatttttgtataaggtgtaaggaaaggatccagtttcagctttcttcatatggctagccagttttgccagcaccatttattaaatagggaatcctttccccatgtcttgtttttgtcaggtttgtcaaagatcagatggtggtagatatgcggcattatttctgagggctctgttctgttccattgatctatatctctgttttggtaccagtaccatgctgttttggttactgcagccttgtagtatagtttgaagtcaggtagcatgatgcctccagctttgttcttttggcttaggattgacttggcgatgcaggctcttttttggttccatatgaactttaaagtagttttttccaattctgtgcagaaagtcattggtagcttgatggggatggcattgaatctataaattaccttgggcagtatggccattttcatgatattgattcttcctacccatgagcatggaatgttcttccatttgtttgtatcctcttttacttcattgagcagtggtttgtagttctccttgaagaggtccttcatgtcccttgtaagttggattcctagatattttattctctttgaagcaattgtgaatgggagttcactcatgatttggctctctgtttgtctgttattagtgtataagaatgcttgtgatttttccacattgattttgtatccttagactttgctgaagttgcctgtcagcctaaggagattttgggctgagatgatggggttttctagatatacaatcacgtcatctgcaaacagggacaatttgacttcctcttttcctaattaaataccctttatttccttctcctgcctgattgccctggccagtacttccaacactatgttgaataggagtggtgacagagggctttttagtctttatctaaagccaggcttatgtgtagacagagtaggaagcagtgattttcaggagtcctgaggttcaggttcatcattaacccagctcctgtgtttgagatgcccatataatgtagttaatcactctctgagataaaattctcctctaccaagaagagaaaagatggacaacaacgctctccaaatattcttccaggtttaaatttctattaataagatataaattgggaaatttgtaaaggccatttcactttctttcataaaaatataatgtttggtgagtccctataatatacaaagtactatgcttctatttcatgcaaaattaaaaagttacagccagcaagctaatagaagtgtaaacatcatgcagaaaacatggacaaagaaaagcaagtgataggctgcatgtgttgccttatagctgtaatcccagagctttgggaggccaaggcaggaggatctcctgaggccaggagtaggctgcagtaagctacaagtgccacagtactccagcctccaacggtgatagagcgagaccctgtctctaaaaaaacaacaaaaaaagcaagtgatatagtggatctatataatggtggtaaattgaatgctcttggctattaataaagccacttgtttacagagggcttataattttatgaattatggtagagcaaatgtaaacatgatttagaaatctttaacaaaactaataatactctcacctaatgcagtttgaaaagtgtataaactctattttgatcataatgtttctaacatggcaaacatgacagtcaagagacggctcttctccaaacacagagtctgctctttggaagtagtgttagggaaagccagtgcccattttcattcctttgcccttgtcttttccatggatgccctgtacccacatgcacaattccactcctgtttctgtctagtcttaagttcctcagcctatctgcaagcttttcagatttaacacatcattcatgacttggatcacccaggctcttctcttgagtctctaattctgacaaacctggaatctctggtatgccttggatacctgggcactcctgaactataatgttctttctcctcttcttctcttgcctagttggcatgtctatgcatacagtgtctgcctcagttcccctgtctgtggtctcattttcctagctaatgataatgtccctcctcctgggatcaatcaggtccttccaggccattccataaaacaagacatcaataccatagagttgaataccagacaaaattgatcagcaatatgcctggccacctagcttaaaactccactcctcttcctcccagcggcagtcccaacttatgtttgggatcttccaccaattttagtccgggtaggctaggtggacctccatccttggtatagtttggatctgtgtctccaccaaatctcttgttaaattgtaatctccagtgctggaggtggggcctggtaagaagtgatgacaccatagggacaggttctcatgaatggtttagcaccatcctcttcgtactgttctcgtgatagtgcgtgagttcttgtgagatctggttgtttaaaagtgtgtagtacctgccacttctctctctgccttccattccagccatgtgaagtgcaggctctttgtttgccttctgccgtgatttaaattccctgaggtctcccccagaagctgagcaaatgctgccatgtttcctgcacagcctgtggaaccacgaaccagttaaacctcttttctttataaattaccgagtctcaggtatttatagcagtgcaagaacaaactaatacaatcctaaaccctaggcaataaaacttgggactcaaaatattcctattcccacagtgattggttcagaagtgggaatgtgaccttaaattatcccatcagagaaaatgttaagacttctactgggagttctggaatagttgttccctcttctttggttaaatttgaacctggaaagttcaagggtaagtgcagctttaggtgtggcttatgtggaaactcatatgatgtacaaaattaacctttggttaaatttgtaactaagcagtttcaaccctgacactgcaggtcacatagcaagagaagaaataaaggccttatattctaaatatagaactatatgcctatgtatgtgaaaattataaattcaagcataatgttaaaaacaactgttcttttctcctagtgtattgtgtggacaaaatacactttcataatgacctggaaggtcaggttcaagttcttagaatccttagatttcagctctggaacatggctggatggaaagatcacatcttctcactctttgtcccatctctttctcactcttgcctcaattctgcacaacaagaggactcatagtcatttgtgaaagcctagcctgttcattcaaattccatccacatcctctgcaaacagttaacacctgcacccaaaggtatacacattgacagtttggctcatcttcaagaggatgaaccagaggaagagatctacacctactccaagccaagaactagcttggagatttggggcagggaatccttgtgtccatggtatccagagtatggtctaaaaggatgtgagaaggttccaggaggatatgtcccattggtcccagaggctgttttgtcccatgggtagggactgacgtggagaagagctctttataatgcagggtccaggggaggggcctttttgcctggatttaaggatgttacatagcttcagacaatcatctcaattgtgagggtagaatctgtgttagaataaatccaagatagtagaggaggaccaaggcaaaccaaggaatgataaagagctgggttatggttacatcatatgagtttccacataagccacacctaaagctgagcttacccttgaacttccagttatataagctaattcatttgggttttgtccaagcccatttagggtaaggcttctgccatttgcaggctgaaagaatatgtctgataggtttctcatggtgttgtgtgaatgactcacgtctgggctgctctgcttcctgaaacagtggggttacccttaatctctgcaagtgagagagttgccctaactcccttccctattccctggtgtagaggaggttctacatctggtgctaaatctatcctttgtcagccccattttgcctaactactagcctgcctcatagctgcaccctcctagtttacagggggaagaaactatcaactgccaaaaaataagccacttagaaaagtacagtcatccctagacatctgtggagaaattggttccaggacacccctcaaaatccttggatattcaagaccttgatataagatgatgtatttccatataacctacatatatcccagatatcctcccatatacttttttttttttttttttttgagatggagtctcactctgtcaccaggttggagtgcagtggcatgatctcggttcactgcaaccctgcctcccaggttcaagcaattttcctgcctcagcctttcgagtagctgggactacaggcacgtgccaccacacccagctaatttttgtatatttagtagagacggagtttcaccatgttggccaggatggtctctatctcttgacctcatgatctgcccgcctcggcctcccaatgtgctgggattacagtgagccaccacgcccagcccctcccatatactttaaaccatctctagattacctataatacccaatacaatgtagatgctatataaatagttgctatactgtattgttttatgaatacatattgtttttattgttgtattgtcatttttttactgttttttccttttttttttttttttttttttttttttttgagatggagtctcgcactgccacccgggctggagtacagtggtgtgatctcagctcactgcaacctcagcctcctggcttcaagcgattctcctgcctcaacctccaagtagctgggattacaggagcctgccaccacgcccagctaattttttgtatttttagtagagatggggtttcactatgttggccaagctggtctcaaactcctgacctcatgatctgcccgccttggcctcccaaagtgctgggattacaggcatgagccactgcgcccagccccaaatattttttatctgtggctggttgaatccacagacacctgtgcattcacaaagccaactgcaatgctacctgagccaatttaaaatatccaacaatgggataaaccacaaagaaaagacttcagcaacttagtgaattctatcatcttgaaagcatcaattctttatcaccagattcttcagtacaggcagttcaaacatgcctttactgtgaaggaaatagatactcctactttgaaaactggttcttgtgttcctttgaaggttgcattcaaaatttaagaagttttgtttcttattactcatctccaatgactgcagttttagtgccagttaataaagattcagctttgaattctggacccctagcagagaccctaaatcctagaaattaacttcttgaggtccacagaacattactttataataaaggggaaaacaaaatacatcaccaatttcaattgatatatcaccattttccccatgaaatcatgcccttatgaaatgtgtggctttttttaaatcaaaaaagtgttgaggatgaaaagttatacatgtggattttttaaaatgaaaatcatggccaagcacagtggctcatgcctgtaatcccaacactttgggagactgagcggggaggattgcttgagctcaggagttggacatcaacctaagcaacatagcaagacctcgttattacaaaaaaatcaaaaaaattagctgggcctagtggctgacgtcccagctattcagtaggctgatgtgggaggatcacctgagtgtaagaagtcgaggctgcagtgagctgtgattacgccactgcactccagcctgtgtaacagagcaagacgctgtctcaaagataagtaaataaaataaaatgaaatgaaaatcataatataaattttcagagtattagcacaaggaagacatccccaattctctaataagtgacttctccagctcctgtagatggtatgtctgctctgtttatacaacatgccctgacaccactccttttacctttggccacagaggggaagagagaaagtgggggtgagaggacaagaataaagctgatgaacaaagaaacagaaatgagagctcaagagggcccagagagacacacacaaagtaggtgtggtggccaaggacgttgactgctttccagttcctggtgccagtctcacttgagggccactttcctgcccattgatttggaaagagactccccatagcttttcaataaattatgggttttttttcctctttaggctagttccaataggtttttgctatttaaaatggaaattcttaagtaaaacacatactttaaaaaagtttatcttctaacttgtgtacagtcatggatttttagctcattaaactttaaagaaaaccttaagagtgactttttttggtttgggcatatcctgaaattctgtgattactgccagtagagcaagaattttctcttctgttacctaagaaagtgctatttaaagcagtcgttttactagcagtcaatgtaagtggtgcaatttgcgatgttcttgggattttaaagtacagatttcccctgaaatcctcagcaataattaggtttcgaatcaattgctgaagtccttaatgactcaaatcatcagcacatttgaaaattttgaactttacctcttggtttctgtggtctctatttactctatatttaagtgattctagcaggcattgatgtttgtcctcaaggaaaagaaaagaaacaatctctgcctgtttttttctaaccttgattaattttcctgatcggtcttttttttattaaaaagaaataacattcataaaaacctctctgccatttatatatttgtattagtttgctagggctaccataacaaagtaccacggactgtagtgatttaaaccacagaaatttattttttcacagttctggaggctgaaagcctgaaaacaaggtgtgatcaggtttggtttcttctgaagcctctcttcttggctcgtagatgaccatcttctccctgtgtgttcacctggtctcccctctgtgcctgtctgtgtccaaatgtcctcttacaaggacactggtcatattggattagggcccaccttaatgaccttgtttaaccttaattagctctttaaagactctgtctccaaatacagtcacattttgaggtactgggagttaggacttcagcatatgaatattgaggggccacagtgcagtccataacaacattcaagcaacattttgagtgcctaataggagctgttctaaagactgagaacaactacgcaataaaaaagccctctcactcaccttcataaacattcatatcttgaagggtatgttttatttagaatgctgtttaagtctctgcaacagagaccatagagtagaataggtggaagcttcattcccacatgagagtcccaaggtggacagcccagacctgcaggacagctgtgccatcccacaaccggcttcctttctgggcccagggtagcttctctggctctcaccgtctcctccacatcacaatcagcaggaaggaggagaggaaaatgcctgttccttttaagggcatggtctggaagtcccacctattatttctgttcacatcactttggtcaaaagagagtcatacacgtacagctggctgccaggaagactgaaaaatgtagtatttagctaagtagtcatgggcctagctaaatcacaatttactatggataaaagggcgaatggacagttaatggggacagagactgtaagaggcagtgtttctatttactatatagtgagtgagacagagtagactattttcagaagcaacaaatgctggagtagaaaaaacaatggaaaaagatggagatgtacagaaaagtggaaaccagagaccagagagagagcaagtaagaaaggagctgcctcattccctaaagctttttagatcctgatcctaatccctcatgttatggcagtactttttttattgctttaaaaaaaccttaaattgcttataaattcagatttcaatttcttttcaaagtgacttttctatttacaatgcccccttgcctgccaagcaagtacttggtttcaaccaacaattcagaaaactgggtcctactgcttactcttatggaaaaataatgccataattgcaactggggaagaagtcagccccacagttgcttaatagtatacattgatattttaactgtgtaaccacaaaagaaggaatgtatgaaaaaaggaaattatgtgtaaaaggtgctgaaagttattaatagggtttgtcaaacctgttaatctcttatatttttgagtaaaatgtacttttagagaaatagtgttcatagaaaaggctgtacacatattcgaaattgctatcacaaggattgtacagttttctagcaataaggttttcctatatagtgtaataaatacatgcaaagcatcccagtcaaaagtattgatctactagtggttatgaaagccataaagctcagataaactcataaaagtttaaaagggagcttttctaaagactggaaattcatttattttatatacttcctagataaatttcaaaaatgatggttcataaaatactatagttttttaaaaaaaggaattccaaaattacttcactctgcaatcaatgaaccagtgaaaattcacctgcaactgctacaaattagacttacaaatgtttggaccacccaacattcattccctcttcttaacagtatcccaatttcctttgggaaattatttcttctgcttggaaatactcctggtaaaatggtgaattcaggtgccttcatttctgctgtggatgagaaagagacctctggaggctcctttcaccagaaccttccactcaatgacgagacagagctagaggcctcgcacctgatgtaagctaggtcaatttaaagttcactcctgggaatttaaatcttaaataatgtgaaaaagaacctgacattgataggatttactcattcctgcactggtactctgcttgttgagtctatgcttaagtctccaaagatttgcataaattccaccagttcctatataattccattttccttagattcagcagatttggtttccattgttttcaatcctcaagccctaactgttccaccttctatctactcatttataaactgaccaaactacaactaaaaataagtaagtaaaataaacaataaaacccaacaaccttacaacagatgaagaaatttaggcaggaacggccaacaggaataaaagatggacaaaaaggtagaagtctgaataaagttgctacaaagttttctcaaatttttcaaaaatcttaataagtatgataatcatatggtaattgttcccagtagaaaagataaaagaaagtatcaaaagtatcacagggctgggtgcagtggctcaggcctgtaatcccagcactttgtgaggctgaggcgggcagattgcttgagctcagaagtttgagaccagcctgggcaacatggcgaaaccctgcctctacaaaaaatacaaaaattagccatgtgtggtagcacacacatgtagtcccagctacttgggagactgaggcaggaggattacttggtcctgggaggtggaggttgcagtgagctgagattgcaccattgcactccagcctgggcaacagaaggagaccctttcttaaaacaaaaacaaaaaacgtatcacacacaaaaaaatagttcaacttcattagtaatcaaataaatataaattaaaacttgatataaacttttccaacataaaattgaaagtggtttaaaatgtaaatactgttgagagggtacactgtaatctggcaatatgtgataagaacaatcaaaatattcgtatttcgtataccactacaaagattatagaataaaagatgagtggtatgaatagatcttacacaattgtgggaaaagctggggaagtgaaagcccagataaggggaagtttgagaatcagaaaaagaatcattaaccagtactcaaccactggggttggaggagaaccagtgttaaaggaaacaatctgagatactggcatggacagtgaggtgatttggaggcggtttttgggaatccattgcctctgaagatctgcagccaggcatctggtggcaggtctggggccactctccatcagcagggccaggaataggaagaagggctaggcaccaagaggaaaagagcaaggactacctggaagttttcatgtactgacaacaaagaccttcaaagagaaaaggaagccactgcctaacttccactgttcaaacctcacatgagttcctcctttggccaactcttgcctcctagcctgtagggaaagaaattctgggaaacaggtccagacccaaccaaattgacaatagtacaatccagtcctcatatattttaaccctgtctttccacatctaggaatggattctaatgaggtgggaaatgtcatcaaatattaaatgaaagtataactatggctgtcatagttaaatcaggcaaggaccaggcatggtgactcatgcctgtaatcccagcactttgggaggccgagatgggtggatcacctgaggtcaggagtttgagaccagcctggccaacatggtgaaaccccgtctctactaaaaattagccaggcatagtggtgcatgcctgtaatcccagctactcaggaggctgaggcaggagaattgctggaacctgggaggcagaggttgcagtgagccaagatcgcgcccctgcactccagcctgggcaaccagaccataactccaacaacaacaacaaaacaaaacaaaagaacaggaaaaagtggaaataagttggtagctccacagcagaggaaaggtgaaataggttagggtaagacacagataagacttttcttcttacctgaataagaaaaggaaaaaaataaataaataaaagacttttgcatgttcattaaaaacattactttgaatgacttttagtgatatggttatatcttcataatatataatataaaaagtatacacaaaattctacctacattagaattacaattttggaaacatagtcatagattttgttttctttttacatttccttacactttttacacttctttcattcttcgtgaaagacccaaagtcacttaaaaatccgaatcttttaaaaatgtgtaacctttggctaaaatcccatcgaggcttttcactgcacctagaataaagtgcaaatccttcccactgtctgcaaggcccttcatggtcctgcctgtgttggctgctctaactgcatatcagatagctctttgcttggttcactgagctccagccccactggactttggtaggttcctagcataggctaaggtctctcctgttgtaagggtttggcaatcattgttagtcacttgagatgctgttacccagatctcgttattcaggtctgagttcaagtgttacttcctcaaagatatctttctctgaagaccccatctaatgtgtctccattccccacccctacccagcagtctttcaccctcttattgccctgttcatcttgtcttcattaactaaaattatgcttttccttagcaatgcccctcactaggaagtagggtccactactcagagcagggaccttatctgtctatttattattgtacccctgtgatttcaacaaagtcaccaaggctctctatgttactgaatgaatggattaatggatgaattaattttttgaattttttacaatgaaaaagtttccttttattaggaaaaaatatttggaagggatatgttgcttgaagggcaatcttgtgtcaggagggattttcacatgatatgtaacttaagctttcttggttgtcttatctagtgattacccaggcctatttttgctgctctgttcctcttgcaagatctaggtaggagtctcccttctacagaagggttacgaattaaatgtttgtaaatgcgtggaaatctggaaagcattctcccctacagtatgaatcatgtcattcatagcagttagtaggcaaaatgagttttgcccacaatatcatggtaacactgtaaaatttccagagatcataaattcaaaccctattttatgaccatacctgcctccctttctagctcaaggcatcaggcactctcagcactctggtctgtgaccccagtccccccagtgacaattctgctctcttcacattgcttggccttgtctgctttcatgtcctatcctattatgaccaatgtgtcaactgctcttcctcattaatcctaaacttacttatttctgtgtccttcagaaactcctctctgagaaaaatctcaactaaggagaaatgcaactgcctatcttctccacatctgtgccttggttttgagctgtcttgggagcagcaaaattatatctgcttttgccttagaagaacttataatgttccaatctttggatgccttttgaataggcaagtttgagtgaagtcaggttacagtgcctgaatagctttaccctcctgatccagcaacacatacatacaaggatggaagatagtactggatatgtgagtacttgctaagcccttcccttcactgcagtgggcaagtggtcgtccaggcagtgattagctcacttggtggacagccaacaacaaaacagtaccacctacctcctgtactagctaggtctccctccagtctggggaagctgtctcattcttttgggggtagggagaaattttatatacaagaaataaaagcatcaaagtggagttttcattaggttttagtcagaaggtagaataaacaggtggacctatttctgcaaattttattttgggaattttcatatgataatcttttccacaataaccaatgaaaaacttctagtgctttcctgcggttgatgggtttgatttctttagcaaacatgaattctagtgagggcagctaaatagaaaactttatggcatggaacttagcatcctggcctattttgcgctaacctaattttctgtgagctttgtagcaaatgaagctctctatgtgacaggttccttttttagattctaaaaccggcagctaagttgttaaattttatggttacatgattttggaatcagcctcagcaatttttcatgctttccgtgtctccctaagggaaagtgggcagccattagaaagtagccatggaaaacttccctattaactaagtgctgctggaggaaaaaataaatcaccctatggagcagatttctttcactataaacttatggatactcacttcacctgggcccacaacactccctgtcaatcatcctgtttcccaactcacctctttctcttttcaacaataatttttcaaaccttccctattattttcacatcccttgccacttctccactatcaaaactccagttgctccaattctctattcactcttagaaactgtccttgcatagaaaatagaagccatctgaaaggtactccttccattctcaccacaattatacaaatctgctctaatccagacccaactcttcccccttcctttctattaccatagaagaagtctccctcttctgtttaaagcttacctctctgtggtaggcacctggaagatgatggttcccagcgttccccacttcttggttattcatgcccttgtgtaatcccttccttttgaagaaggttggatatggtgacttgctcttaataaatagaatacagaaaagtgatagaatgccacttccaaagttaggttatcaaaagattgtgactcctgtcttgggcatcctctaggtctctattgctctctcacacaccctggaagaagctagctatattgtgagttgccctatagagagattcgtgtgccaagggaggcatctggctgacagccagcaaggaactacccaacagcttgtaaaacactgaatgctgacaacaactatatgagcaaactcagaagcaggtcctcccactatgtgagtcttgacagattggaccacaacccaagcaagtagcctgatggcaacctcttgccttaagctagatgcacccagtgaaactgaaccctggtttctaaccctgagaactgttgagaataataaatgtttgctgtttcatgctgctagatttttaagtgatttcttacgtagcgatacataaataatacaaccttcatctatcctcggtatccttctcatctgcttctctctttcccacatcttcaaatcttctctctacccactccttctaattagcagttaaacatgggggttggggacaatctatctaaaagaagaaaatcttcaattctaattcctcttttagctactgctacgtttctccccgcctctttagagtcaaacttgagttatctgcatttaccgtctccatttcccttccatcagaatgacctatagggcttgttaagtcacagacttctgggcttctcctttagagtttttaatacaggatttttgaagtgagatctgagaatttgcattccaaaccatggcctgagaatttgcattctaacctgtttccagatggtactgatactgctggtctattgatcacactttgggaattgctgctctacacttgttagaaatgcagcctctcaggtctcagctgcgttctaccaaattagaatctacattttaacaaaatcatcaggttatttgtatgaacactaaagtttgagaagcactcagatggccttatgtgtcagacaattccaaattcattccatgaaaacagcctttatgctatagctgtcatgctcacattcaccttttacctttcaaactggtttaaaacaaaagagctaaatcatgtatgtggtcctactctttgtctcatccattgatccttctctggattggaattttcttcttgaatacacataaagtctaacaacaaatacatggtgctttagataagacaaattacaatgctacatctaaaccaaaagtggtttgtactctgcctgccaagtttttcaatttgttctttaggcttttcgcagggtgcctttttgaggttactgccccctaccttttcagttttactccaagctgaaacacagcctctcattttcctaaagcaggacctggttataactttaccaaagacttggagttcatggaatggaaacacatgcaaaaaaagcagccagtggatatgagtgcttcacctttcccaaaggtgttctgacctatttcttgatgtgttgctaagatgcagcttacctgcctcgctcttatcctctgccttctacctcatgttatgccttcttccaaattcctgcctacccagaacacaaacccctatctcatctgagtgcagaaactgggaaaaccctagttttccctccttgccccagtctaaagtctgccccagccaacagtgtatcatcatttgcagtttaattcctcggagtccttaaaacactccaatctagaagagattttggctgtatctttgtatagtttaaaaggttcactaggctgggcgcagtggctcatgcctgtaaacccagcactttgggaggctgaggtgagcagataatgaagtcaggagttcgagaccagcctggccaacatggtgaaaccccgtctctactaaaaatacaaaaaattggccgggcgtggtggtgcgtgcctgtaatcctagctactcaggaagctgaggcaggagaatcgcttgaacacaggaggcagaggttgcagtgagccaagatcgcgccattgcactccagcctgggtgacagagcaagactctgtctcaaaaaaaaaaaaaaaaaaaaaaggttcactagaggtttcaagttaccaccatttcgcccctcaaaaaagatttatctgacttcaaaggcacttagtcaaagagataaatgcttcaagatttcaaaaaatttagaattctactgcaggatccagcaattccacttctgggtgtagccaaataaattgaaatcaatttgctgaagagatagctgcactactatgttgactgcagtatattcacaatagccaagatatagaatcaacttgtgtccatcaatggatgaatggattaaaaatgtagtgtgtatgcatacatatatatatgtgtgtgtatgtatacactttatatatgtatagatgctctgtctctctctctctacacacacacacacacacacacacacacacacacacacacgcacacacacaatgggttaccattcagccacaaagaaggaaatcctgtcatttgtgacaacatggatgaacctggagacattgtgctaagtgaaataagccaggcacagaaagacaaataccacatcatctcacttatatgtggaatctaaaaaaaagcctaactcatagaaatagagagtagagtggtagctaccagaggctggagtgggcagggtttgtggggggctggggagagagggaatgaggagttattgatcaaagggtacaaagtttcagttagagaggagaaataaatttttgagatctattggacagaagagtgactacagtcaataataatgtattatatatttcaaaataggtaagagaataaatttcaaaggtctcaccacaagaataatgattgaggtaatggatatgttaattagctagacttaatgattccacattgtatacatatattaaaacattacattgtgccccataaatgtatacaattatgatttttcagttaaaaatgataataataataattttaaaaataattgtaccatagatagagcactttttccatataaattattcaggcaatagatcttgctgtcagaaattcatacatgtgatggctgtgtttaaaaatgatactaacagtcacttgtatatgttttctgtatgggtataaacaatgattcaggcatgtcaagtgtaatttttaactcctaatttctttttgtcagcaatctttcaaaaattttctgtttcttgacaattttggtgaattaaactggaacaaaatcatttcattagatggtgctgaacaactagatattcatatgagaaaaaaatgaacctctgaaatttacacctcaaacatacacaaaaattaatttgagatggattataggccaaaacataaaactgtaaagcttctagaataaatcatagacaaacatctttgcaactttgaggtaggcaaagatttcttaaggaaaatacagcaagcactaacattcccctcccagccacacgcacacacattggtaaaatagacttcatcaaaatttaaaactttcaaaagacacagctaaaagaatgaagatgagccacaggttgcaagaatatgtttgcaagacacatatatgaccaaatacttgcacacagaatatataaataatacctacaaattaatgatgttttaataaacacaattttaaaaataggtgaaagatttgaagacacctcaaaaaaagatgcataaatggccaataagcacttaaaaaatactcaacattatattctcataaaaacacaattttaagccacaatgagatacccacaaaacccactagaatggctaaaactaaggagaataaaactccaagtttttataggttacttctcatatattgaagtataaaataatttaaccaccctggaaaattatttggcagtttcttgtaaagttaaacattcacttaccacccaattcagaaattccactcctaaatataacccaagtaaaatgaaatgatgaccacacaaagatctacatgcaaatattcacagcagctatattcctaatagccgccactggaaccagcccaggtatccatcatcaggaaaatggataaacaaactgcaatatagtcatacaatggaatacaacccagcaataaaaaggaactaactactgatatacacaacaaggataaatctcagaagcattatgctgtgtgaaagaagttggactcaaaacactacatgtgtgatttttactgcatacatgaacttcatgtaagaagttcaagaacaggtaatccaggatttaaaaaggtacaacacacccaaatacaggaggatagttgatataaccaacagagatgttaattgttaccttgtttatgctggtatagaaggggatatgatagtctgcacagcacatgctcataaactcccaaggtatggtgtgaatttggccaaattatactgcagcacaatgaaatggcccactgaaaatgtcttcagcactttacaccttgccacccaattctatgaattctcaccacccaattcagatgtcatttcctctatgaagtttttattccctcttatagctaacacagttttaaattattttctgaactactgaagcacttttattcttccaagctctagttctcatgatgcaatggctgaaaatataactggagcttcttttctgaaatgtccttttttatagtgtgagccacacagggttaggcacacagaaggtatttgaatgcctaaataaatatttgaatttcaaaaatgtttaatctcatatgatgtggatctctttcccctgaactcagagcatacacatgataagataaataatttaaatttttcgaaataaatcttgccttggccaagataaataatttaaaattttccaaatagatcttgccttggccaaaaagaataattggaaaagttggataatactctaactttttttaaaaaaaactatactttaagttctagggtacatgtgcacaacgtacaggtttgttacataggtatacatgtgccatgttggtttgctgcacctatcaactcatcatttacattaggtatttctcctaatgctatccttcccccagcaccctgccccccgacaggccccggcatgtgatgttccccgccttgtgtccatgtgttctcattgttcaactcccacctatgagtaagaacatgtggtatttggttttctgtccttgtgatagtttgctgagaaagatggtttccagcttcatccatgtccctgcaaaggacattaactcatccttttttatggctgcatagtatttcatggtgtatatgtgccacattttcttaatccagtctatcattgatggacatttgggttggttctaattttttctattgtgaataatgctgcaataaacatacgtgtgcatgtgtctttatagtagcatgatttgtagtcctttgagtacatacccagtaatgggatcactgggtcaaatggtatttctaattctagatccttgaggaattgccacactgccttccacaataattgaactaatttacactcccaccaacagtgtaaaagtgttcctatttctccacatcctcttcagcatctgttgtttcctgtctttttaatggttgccattctaactggtgtgagattgtatctcattgtggttttaatttgcatttctctgatgaccagtgatgatgagcattttttcatgtctgttggctgcataaatgttgtcttttgagaagtgtctgttcatatccttagcccactttttgatagggtcttttgtttttttcttgtaaatttgtttaagttctttgtagattctggatattagccctttgtcagataggtagattgcaagaattttctcccattctggaggttgcctgttcactctgatgataatttcttttgctgtgcagaagctctttagtttaattagatcccatttgtcaattttggcttttgttgccattgcttttggtgttttagtcatgaagtctttgcccatgcctatgtcctgagtggtattgcctaggttttcttctagagtttttatggtgttaggtcttacatttaagtatttaatccatcttgagttaatttttgtgtatggtgtaaggaagggatccagtttcagctttctacatatggctggccagttttcccagcaccatttattaagtagggaatcctttccccattgcttgtttttgtcaggtttgtcaaagatcaaatggttgtagatgtgtggtggtatttctgagggctctgttctgttccattgatctatatgtctgttttggtaccactaccatgctattttggttactgtagccttgtagcatagtttgaagtcaggtagtgttatgcctccagcttttttctttggcttaggattgtcttggctatgtaggctcttttttagttccatatgaagtttaaagtagttttttccaattctgtgaagaaagtcagtagtagcatgatggggatagcaatgaatctataaattaccttgagcagtatggccactttcacgatattgattcttcctatccatgagcacagactgttcttccatttgtttgtgtcttcttttaattcgttgagcaatgttttgtagttctccttgaagaggtccttcacatcccttgtaagttggattcctaggtattttattctctttgtagtaattgtgaataggagttcactcatgatttggctctctgtttgtctattattggtgtataagaatgcttgtgatttttccacattgattttgtatcctgagactttgctgtagttgctcatcagcttaaggagattttgggctgagattttgggttttctaaatatacaatcatgtcatctgcaaaagagacaatttgacttcctcttttcctaattgaatacactttatttctttgtcttgcctgattgccctagccagaacttccaacactatgttgaataggagtggtgagagagggcgtacttgtcttgtgctggttttcaaagggaatgcttccagtttttgcccattcagtatgatattggctgtggctttttcatcaatagctcttattattttgaaatacattccatcaatacctagtttattgagagtttttagtatgaagtgctgttgactttgtcaaaggccttttctgcatctattgagataatcatgtggtttttgtcattggttctgtttatgtgattgattgtgtttattgatttgctcatgttgaaccagccctgcatcccaggatgaagcccacttgatcatggtggagaagctttttgatgtgctgctggattcggtttgccagtattgtattgaagattttcacatcgatttcatcagggatattggcctaaaattctctttttttgttgtgtctgtgccaggctttggtatcaggatgatgctggtctcataaaatgagttagggaggataatctctttttctattgattggaatagtttcagaaggaatggtaccagctcccctttgtacctctggtagaatttggctgtgaatccatctggttctggattttttttggttggtaggctattaattattgcctcaatttcataacctgttattggtctattcagagattcaaattcttcctggtttagtcttgggagggtgtatgggtccaggaatttatccatttcttctagattttctagttgatttgcatagaggtgtttatagtattctttgatggtagtttgtatttctgtgggattggtggtgatatcccctttatcattttttattgtgtctgtttgattcttctctcttttcttctttattggtcttgctagcagtctatctattttgtggatcttttcaaaaaaccaggtcctgtattcattgatgttttgaagggtttttcctgtctctatctccttcagttctgctctgatcttagttatttcttgccttctgctagctttagaatgtgtttgctcttgcttttctagttcttttaattgtgatgttatggtgtcggttttagatctttcctactttctcttgtgggcatttagtgctataaatttccctctacacactactttaaatgtgtcccagacattctggtacgttgtgtctttgttctcattggtctcaaagaacatctttatttctgcctttatttcattatttacccagtagtcactcaggagaaagttgttcagtttccatgtagttgtgcggttttgagtgagtttatgaatcccgagttctaatttgattgcactgttgtctgagaaacagtttgttgtaatttccgttcttttacatttgctgaggagtattttactcccaattatgtggtcaattttacaataagtgtgatgtggtgctgagaatgtatattctgttgatttggggtgtagagttctgtagatgtctattaggtctgcttggtccagagctgagctcaagtcctggatatccttgttaaccttctgtctcattgatctgtctaatattgacagtgcggtgttaagtctcccattattattgcgtgggattctaagtctcattgtcagtctctaaggacttgctttatgaacctgggtgatcctgtattgggtgcatatatatttaggatagttagctcttcttgttgaatagacccttttaccattatagtggccttctttgtctcttttgatctttgctggtttaaagtctatttcatcagagactaggattggaacccctgcctttttttgttttccatttgctttgtagatcttccttcatccctttattttgagcctatgtgcatctttgcacgtgagatgggtctcctgaatacagtacaccgatgggtctcgattctttatccaatttgctagtctgtgtcttttaattggagcatttagcccatttacattaaaggttaatattgttatgtttgaatttgatcctgtcattatgatattagctggttattttgcccattaattgatgtagttccttcatagcatcagtggtctttacaatgggtatgtttttgcagtagctggtaccagtggttcctttccatgtttagttcttccttcaggagctcttgtaatgcaggcctggtggtgataaaatctctcagcatttgcttgtctgtaaaggattttatttctccttcacttatgaagcttagtttggctggatatgagattctgggttgaaaattcttttcttttagaatgttgaatattgacccccactctctcctggattgtagcatttctgccgagagatctgctgttagtctgatgggcttccctttgtgggtgacccgacctttctctctggctgcccttaacattttttccttcatttcaaccttggtgaatctgacaattatgtgtcttggggttgctcttcttgaagagtatctttgtggtattgtctgtatttcctgaattttttttttatcatactttaagttttagggtacatgtgcacaacgtgcaggtttgttacatatgtatacatgtgccatgttggtgtgctgcacccattaactcgtcatttacattaggtatatctcctaatgctattcctccccccttgtatttcctgaatttgaatgttggcctaccttgctaggttagggaagttctcctggataatatcctgaagcatgttttctaacttggttccattctccccatcacttcccagaacaccaatcaaacctatatttggtcttttcacatagtcccacatttcttggagactttgttcatttcttctcactctttattctctattcttgtcttctccctttatttcattaatttgatcttcaatcactgatatcctttcttccatttgatcgaattggctattgaaacttgtgtatgcatcacgaagttcttggttttcagctctactgtttattctagttagccatttgtctaaccttttttcaaggtttttagcttccttgtaatgggttagaacatgcttctttagctcggagaggtttgttattaccaaccttttgaagcctacttctgtcaactcatcaaactcattctccatccagttttgttcccttgctggcgaggagctgtgatcctttggaggagaagaggagctctggtttttggaattttctgcttttctgctctggtttctccccatctttgtgtttttatttacctttggtctttgatgttggtgacctacagatggggttttggtgtggatgtcctttttgttgatgctgatgcaattcctttctgtttgttagttttccttctaacaggcccctcggctgtaggtctgttggagtttgctggaggtctgctccagaccctgttttcctgggtatcacaagtggaggctgcagaacagcaaatattgttgcctgatccttcctctggaagcttcatcccagaggggcacctgcctgtttgaggtgtctgtcggcccttactgggaggtgtctccctgtcaggctacatgggggtcagggacctgcttgaggtggcagtctgtccattctcagagcttgaaaaccatgctgagagaaccactgctctcttcagatctatcagacatggaagtttaattctgcagaagctgtctgctgccttttgttctgctatgccctacccccagaggtggaatctagagaggcagtaggccttgcttaagctgtggtgggctctgcccattttgagcttcctggcgactttgtttacactgtgagctattcaggcctcagcaatggtggatgctcctcccccgtcaagctgcagtatcacaggttgatctcagactgctgtgctagcagtgagcaaggctccatgggcgtgggacctgctgtgccaggcaagggagggtattttctggtctgctggttgctaagaccatgtgaaaagtgcagtatttggtcaggagtgtaccgtttctccaggtacagtctgtcatggattctcttggctgggaaagggaaatcccccaacccctcatgcttcctgggtgaggtgacaccctgccctgcttcagctcacccaccatgggctgcacccactatccaaccagtcccagtgagatgaaccaggtacctcagttggaaatgcagaaatcacccgtcttctgtgtcaatcttgctgggagctgcagactggagctgttcctatttggccatcttggaagtggccgataataccctaacttttaaactcttatggttaaaatatattgttctcataaccaaggtcattttatacatgacaaccaatataccaaagaaagttcaacaaaataaaacaaaagattttactatcaaatctttaccattttactgtcagaagatcaagagactggtttgatgaaaagtatctattttcaacaggtattttctgtctatctttgacggaaagttaaaaaggacagttctatatttcaaattatttggagcagtgacaaacatatagccaattcattaaggagtacattttatacttttattgaaaaggttaattatatggttttgtgtgatgtgagagcttttaacacatactaaggacaatcatttgaaacgtatattttaggggccaagcgtggtggcccacacctgttagcccagcactttgggaggctgaggcgggcggatcacgaggtcaggagattgagaccatcctggctaatatggggaaaccccatctctactaaaaatacaaaaaattagccaggcgtggtggcaggcgcctgtagtcccagctactcgggaggctgaggcaggagaatggcatgaacccgggaggtggaacttgcagtgagccgagatcacgccactgcactccagcctgggcaacagagcgagactctgtctcaaaaaaaataaaagaaagaaaaagaaaaaagtatattttaagtttcaggtgtgtttggttgttatattctgtactttattactgaggctctcattaattagttctgtactataatgacattaacagaaataatgttcataactggtgattcattacactggatgtacaaaccctcttgcatgaattaatgtttttccctgttttgaatattagccaatgtccattcttattaaatgaatgtatctcaaggccctaccaaataagtacatgtaaaaagtaggaagaaatgtgatattaaacaatatacaataccttaaacataatacacatcagatataaggtaggtagttgcaaattttaagaaattaaaaaccaccagagggcagctcaatacaatagtgatgaaatacttaaaacagtatggtaggtatagtattttgaagtaattataagtcaggtattatagatatagaggatagagagtgaaaagcgacacatttaataaaatacttaaaatttttatatttatattaatacatgttttttagttgaccttcaaatgtaaatacatatttcaattatgcttctctctttttttttttttgttggcagcagcaaaattggccagggggcaagcaacctggctaatattaaattttattttattttattttattttattttaagttattgtagaaagagggtcttactgtgttgaccaggctggccttgaactcctggcctcaagcgatcctcctgcctctgcctcccgaagtgctaggattacaggcacaagccaccatgctcagccacaatattaaatttttaaaaatgtgatcttttatgctcagggactattacgaatacctctatacacacaaactagaaaatctagaggaaatggacacattcctggagacacataacctcctcagattgaattagggagaaactgaaaccctgaccagaccaatatcaagttccaatactgaatcagcaataaaaacctatgaaccaaaaaagccgcacaccagatggattcacagctaaatttgactggtcatatgaagaagagctggtaccaattctactgaaactattcccaaaaattgaggagaagggactcctccctgactcattctatgaaggcaccatcaccctgaaaccaaaacttggaaaagacataataaagaaagaaaactataggcccatatccctgatgaacatagacacaaaatcttcaacaaaatactagcaaactgaatgcagtagcacatcaaaagttaattaattcactatgatcaagtaggcatacctggtattcaaggttggttcaacattcacaaatcaataaatgtgattcaccacataaacagaactaaagacaaaaaccaggctgggcacagtggttcacgcctgtaatcccagcctttgggaggcagaggtgggcagatcgcctgagctcaggagtttgaggccagcctgggcaatatggcaaaactctatctgtaccaaaaatttttaaaaagccaggcatgatggtgcatgcctgtggtctcagctacttgggaggctgaggtgggaggatcatttgaacctggaagggagaggttgtggtgagccaagatcataccattgcacttcagtctgagtgcgagaccctctctcaaaaaaaaaaaaaaagaaaagaaaagaaaaaaaccatatgatcatctcaatagacatggaaaaagcttttgataaatccaatatcccctcacgataaaaaaaaaaaaaaaccaacaaactaggcatcaaaggaacataccatctatgacaaactcacagccaacattgtattgaatgggcaaaaggtggaagcgttcccctcgtggactggaacaagacaaggctgccctctcaccactcctattcaacatagtgctggaagtcctagacagagcaatcaggcaagagaagtaaaaggcatccaaataggaaaagaagaattcatattaactctcttcattgacaatataattctgtacctagaaaatcctaaagattccaccaaaatgctcctagaactgataaatgacttcagtaaagttccgggatacaaaatcaacatacaaaaatcagtagaatttctatacatcaataatgttcaagctaagatccaaatcaagaatgcaatcccatttacaagagccacacacacaaaataaaatacctaggaatacatctaactaaggaggtgaaagacttcttcaaagagaactacaaaacattgttgaaggaaatcatggatgatcaaactaatggaaaaatattccatgctcatggattggaagaatcaatatcatgaaaatggccatactgcccaaagcaatctataggttcaatgctattcctatcaaactacaaatgtcatttttcatagaattagaaaaaactactcttaaattcatgttaaccaaaaaagagcttgaatatctaaagcaatcctaagggaaagaaggccagagacatcacactacccaacttcaaattatgctataaagctacaataaccaaaacgtaacggcactggtataaaaacaaacacacagaccagtggaacaaaatagaaaatccagagataaagccacacacctacagccacctgatctttgacaaagtcaacaaaaataaataatggggaagaaacccctctgttcaatatatggtgctgggatagctggctagccatatgccaaagaatgaaactggacccctacctttcaccatattataaaaaataactcaagatggattaaagatttaattgtaagacctcaaactataggaatcctaggataaaacctaggaaataccatcctggacattgaccttgggaaatgatttgtgaccaagtccttaaaagcaattgcaacaaaaattgataagtaggacctaattaaactaaagagcttctgtgtagaaaaatagaaaaacaaaccaactatcatcagcgtagaaagacaacctacagagtgggagaaaatatttgcaaaccatgcatttgacaaaagcctaatatccagaatctataaggaatttacacaattcaacaagcaaaaaacaaataaccccattaaaaagtgggcaaaagatatgaatagacatttctcaaaagaagatatacaagcggccgacaaacatatgaaaaaatgctcagcatttttcatcagcattaatcagcaaaacacaaatcaaaatgcaaatcaaaaccacaacaatcagaatggctgtttttaaaaagtcaaaaaacaacaaatgcttgcaaggctgtggaaaaaggggaatgcttatacactgttggtgggaatgtaaattagttcagccactgtggaaagcagtttggagatttctcaaagaactcaaaacagagcttccattcaacccattactgggtctatatccaaaggaaaataaatcattctaccagatagacacatgcatttttatgttcattgcggcatttttcacagtagcaagacaagaaatcaatctagatgcccatcaatgatggattgtataaagaaaatgtgttgcatatacacaaggaatattacacagccataaaaagaatgaaatcaagtcctctgcagcaacatggatgcagctggaagctattatcctaagcaaattaattccggaacagaaaaccaaatattgcatgttctcacttataagttggagctaaacactgggtacacatggatgtaaagacggcagcaatagacactggggactactagaggtgggaaggaaggggacaagggttcaaagactattggctactaagcttactatctgggtgatgggatcaatcatgccacaaacctcagcatcacacgatacagccatgtaacaaacctgcacatgtgtcacctgaatctaaaataaaatttgatattattaaaaagtaaaaatgtgatcttggattttccctaatttgtggtggtcagtgctcctcttgtgagaaggaattagcagcactaacttgtttctaatttaaagaaatataaataaaaattagaataataatgataatcctttttaaggtacttttcaaaatgtgcaataacttgatttatttgttcatttgttctttgtccctctttctagtttgaaagctccatgaggtcaagagcatttacttcagggaccttgccaaacaccataactagagttgactttcaataagtatttgttaactccattaagtaattaactgtaaattcttaagggagtaacccttctagagattattctgtgttttcatgtagtcagcagtaataccttccatggacccatccatctatccactcacccacccatccatctacccatccatcttttcagccagccatcaacccgttcgttcatcctttagaccacccctccttccatccctaaagatatctaacgtttaaggacagtctttacaaacggatcctttcttcttggtaattaaaaagaatgtccttcaggaaggaattccctgttcaaagactttccttccagatcttataaagttgcttgagtaggttttacaacaataatggcccaattttcaaaatatgcagtcttcctcaactcctctccttggcctcttcaatggtgaaagaatacattagggttcattatgctccatttccctccctaaagccctgctttttggttaggaactactttttgacaaagtaaaagactaagtccttcctcttccacaaaatttacattatttattttgtaatatgaccagaggttttgaagaaaattcattgccattcctgtagcttcttaataataaagtatgacccctaagactttctatctatcatgatctcattcataagccccacggcttcaaccatcacttttatattgaagccttctgtcttagactgttttcaccttgtatagcagaatacctgagactgggtaatttacaaagaacagggatttatttcttacagttctagagattgtgaagttcaagatcaaggggctggcatctgttgaaggccttctctctgtgtcatctggcagagagcagaagggcaaaagaacacatacatgccagagaagaagggggctgaactcagtttttaaatcaggatcccaatcctgagataacaaattccaaaaagaaaaagaaaaaaggagagagtgagtggagaggaagggaggtaaaaaactaaacaaaaacaagttcacttcaataatattaatccatttatgagggcagagccctcattacctaatgacctctttaagatctcatctctcaacaccattggattggagattaggtttccagtacatgaactttagaggacacattcaaaccacagcaccttctgaatatgtaccttgacccctgattgcttccccaaacttcagagttttgtacccacctagatgacccacagccaccatccatacacagtggtagggcaaggaaaggaaaggaaaggaaatgaaaggaaaggaaaggaaagataagagaaggaagaagagaggagagagaaaagagagattggctgtttttatagattactccccaccttcccttctgagaatagacttccagagagttttcagtatctgtcaacagcaggggcatgggccccttccatccagaattctgggaggagaatgccatgtagagcctgaagacagcatggggcagcctaggtatagttttgttgtctcatttttaggcagaaacagaggctggagaagataccccactctccaatacctccaagtctgcatgaggcagagagaagatacaaaagttccatatcctgggggttggggctgccaaggattgagtcaggggtttgccaggagtcactggggtggttggtggagagtcatctagacctgagggctccatggcagaggaagatcaatcccaactaggagggctgaggtgaggcaagtcaagggcatggtggagtgatggggtagggaagggggatcagggatggggacagataggacaaccacagggctttaaccatgtgtgccaagacaagtgaccaggaatcactttccagaccttcaaagagtgcatgcagtgaagatgggccaacaagcctcctcacctggggtcagtaggagccccgagcaaggaccagggaccaaagccccacaaccaatgatgttctaaaaactactcccttctcagacatcccaagaagtgagggaagggacaaaattttgagaaatgaggacggagttcaatctttgaaatgataaaatagtaagccaactctgactgaatattcatgaaaaggagctcaattttatgctgaaagtaactaagctagctgtaattggcataattattttcactgtcaaaaacgggatctcatagaaattgagctcagtttagcataattaagtaatatttctatagtttggagctgtgactctgaaattattagcacctacacaaaattgaccccaagatttcttaccaagaaataaattttacaaaagttctccgtaacaccaaatttttataaccttgagatatttaacactgctctctagtcagttttttttcacttagccaaaaattttgaacattttcctaagtaaccaaatgttcttcctcaatataatttttaataacagaatggtaattgatcatagggctgtttcataagttaattaacttatcctttttttgttttaactatacttagattgtttcctattttctgctatatgaatagcaatgagataatgaacaacctatagatatatcttccagggcctttttttttttttttttttttctttggagatggagtgtctcgctctgtcgcccaggctggcgtgcagtggcgcgatctctgctcactgcaagccccacctcccgggttcacgccattctcctgtctcagcctcccgagtagctgggactacaggcgcctgccaccacgtcaactaatttttttgttgttgttttgtattttagtagagacggagtttcaccgtgttagccaggatggcttcgatctcctgacctcgtgatctgcccgcctcggcctcccaaagtgctgggattacaggcgtgagccaccgtcagggctcttaagataatttctttttttttttttttttttgagacggtgtcttgctctgttgcccaggctggagtgcggtggcgcgatctccgctcactgcaagctctgcctcccgagttcacgccattctcctgcctcagcctccccagtcgctgggactacaggtacccgccactatgcccagctaaatttttttgtatttttagtagagacggggtttcaccctgttagccaggatggtctcgatctcctgaccatgtgatccgcctgcctcggcctcccaaagtgctgggattacaggcatgagccactgcccccggccaagataatttatttggagtaagtttcttgaagtggagtttctggaccaaacagtatacatatttttaaagttttgatccatgtgaccaaattggccttgacagatgttatgctacttaaaattccaactgagtgcctcttttcttacctcctcagcaacaatgggtattagagtgtttaattctctttaaaaaaaaaaatctttttgggctgggcgcattggctcatgcctgtaatcccagcacattgacaggcctagagaggtggaccatttgaggtcaggagttcgagaacagcctggccaacatggtgaaaccctgcctctactaaaaatacaaaaaagttagctgggcgtggtggcatgtgactgtaatcccagttgctggggaggctgagacaagagaatcgcttgaacctgagaggtggaggttgcagtgagcaccactgcactcccctgggtgacacagcaagactctgtctcaaaaagaagaaaagggaaaaaaagaaaaaatctttttgattaaaaatcatcttgttggctgggcatggtggctcattcctataatcccagcactttgggtggttgaggcaggaggatcacttgagccaaagaaggctgcagtgagctgtgattacaccattgcattctagcctgggtgacagagtgagaccctgcctcaaaaaaaaatcatcttcttttagtttgtaatgatatgactatagtgaaatgagacacttcttattgatgggtaaatctctctctctactaagaatatcaatgctttgctgccaatatttctcccagcttggtattttaacaggtattgagcttctctgtgaacaaggtaaagtgacatggaggtatgaaaatgtcagtgatggcaaaagcattagggatgtgtgtatgtgcgtgtgtgtaaccaaatgatttatgttttgaagaagtggttaatggacaatgtcctgttaccattttttattttgtacaaagtaaaaaaattcctttttactcctcaaaaggttaaccatagtttagaacaggcaaatccataaaggcagaaagtagactaggggttgctcaaagttgtgggaaggagggaatggggagtgactgctaatgggtacagggtttcatttttggcatgatgaaaatattctggaattagacagtggtaatgattgcacaactttgtgaacgtactaggaaaccactaaattatacactttaaaagggtgaattttatggtctgtgaattatatctcaataaacccagtattttaaaaagtcaatgtgcttatttttcaggtacacagatgatatttccctttgaataaaaaggacaagatgttttaaattattttctcaaggcaggaagaatagactctaaccttactgatccaatactaattcaaggcaaatgggcataaagtttgtatttggggtgctgaaaattttctggaatgagatgatggtgatggttgtgtagccttgtgactatacagaaccccagtaaagtgtacacttaaaaatgatgaattttatggtatatgaatggttaaatctcaacttttaaaaagtgaaataaaaagttaggtacagatgctccttggcttatgatgaggttatgtcccaataaacccatcaaaagttgaaaatatcctgtgaaaaatgcatataataccccaataaacccattgtaaagtcaaaaattattaagtcaagccatcattaagttgggggctgtctgtatatgtacataaaaatttgtatacatgaatgttcatagcagcattatttataatagcctccagacaacccaatgtctatcaactgatgaaagaacaaggtatgagatactcatacagtggaaaattactaggcagtaaaaaggaatgaaataccaatacatgctacaacaaggatgaaccttgaaaacattatgcttagagaaagaaaatataatggcccaaaagactacgttatatgacaccatttatgtgaaatgtccagaatagtcaaatttgtagagatagaaagtaaattaaacagctttattgagctctgggttgctctgggtgaagagaaaaatggggagtgactactatttggtaggggctccttttagagctgatgaaaatgttctcaagttcaatagtgatgaaaattcaccttgtaaatataataaaaaccactgaattgtccactttatttatttatttatttagacagagtcttgctctgttgcccaggctggagtgcggtggtgcactcagctcactgcaacctccacctcccaggttcaagcaattctcctgcttcagccccactagtgagtggctggaattacaggcatgtgccaccatgcccggctaatttttgtagttttagtaaagacaaggtatccccatgttggccaggtgggtcttgaactcctaacctcaggtgatccacctgccttggcctctcaaagtgctgggattacaggtgtgagccactgcacctgggcaaattgtccactttaaatgggtgaattatatggtatgtgaattacttctcaataaagctgtttaaaaaggaaaaaaaattactgacaaatagttacaaaatgttgagacaaaggttgaagagagacagatggatgatagaagatggcctctgctaatacgatgtaaaaaaagaaatccttgatctttgaggaatcgccacactgtcttccacaatgatctagaaccagaaataccatttgaccctgcaatctcattactgggtatatatccaaaggaatataaatcattctattgtaaagacacatgtgtgcctatgttctctgcagcactatgcacaatgacaaagacatggaatcaacccaaatgcccatcaatgatagactgtataaagaaaatatggtacatatacaccatggaatattatgcagccataaaaaggaatgagataatgtcctttggagggacacagatggagctggaagccattgtcctcagcaaactaacacaggaatagaaaaccaaacattgcatgttcccacttataagtgggagctgaacaatgagaacacatggacacagggagaggaacaacacacactggggcttgtcagtggggtggcaggacagagagcatcaggatcaatagctaatgcatgtggggcttaatacctaggtcatgggttgataggtgcagcaaaccaccatggcacatgtttacctgtgtaacaaacctgtacatcctgcacatgtatcccagaacttaaaataaaataaaattttatttacaaaaagaaaaaaaaaacccttttttttcttcccaaccttttctcaattgtaggcagcatttatctatttcttgaatctataatgattcctttaacacttttctagatcttgagttatttgttcaaattatttgtctcctctccaagactcattgttctatacttgtacgcattgcaaatactatgctcacttgcagagtttttgaaatcgcatgcatttgtttgctcaatattacgatgtattatgttacaatgaagagtttaatgccatctttaaatgcttgcttttgccttgcacccttttttaaaatataaaagtgctagattaagcgttcatgccagttaccacaattgttgattctgccagaagagcatttaccagtaggttctggttcttgttacccaactccttccctatgaaaattatgtctccctagtaactaggttgttttggccattgttttgactttaacagccctgggagtggaatcttgtcaaatgttttaaatcatagcacttccaaattcattcaacaaacatttattgagtacctactattggccagatactgttttgctattttttttaatcaacattaaagaactccagctggttaatcgagcatgatttttctcttacagataccagtaacagcaattcaaagatgtgaatgggattaattcagggctgttgctcctgacagataagtcagtctacctgttgttgaatgacatgcagaaaagaaatttggtaagaagaaagtgatttgagtaagtactttttgaatttgtagaatatttttgtttttcagcttttaaataacatttgatgttaaatccttacaagaacgttgggagtcaggctgggcaacaccttccccatcattcttctgtggatgaggacatggaagtcagggaggttagctgatgtgcttgttcagaggtgcacaggaacccagaaagtccaactcttatttcatcttaccctctaggtaaaacatctaggatcaaacaagactgataatacagtctcctaaccttttccaaactattttaatcaaacttgattctaatgtgaagttgtctttaataaggaaagaatcccacttagctatttgctcagcgaggtctgggattctatctaatctctatatgtcagtgtataatttgagcaaggttaaaaagaaaactaaacatttccttaatatttggagagggtggagtcagtctatttgtctgtaagaaataaaaaggtaaagcgtatccctgcttttggtgaggaaagttcagaaacgactgtgttttgtttctgaaaactttggaatacttatctttggctaaatatcaaatataaaaaatccataaaaaattatcctatgataatttttgctggccgcccatgatggctcatgcctataaaggcaggaggatcacttgaggtcaggagttcgagatcagcctggccaatatggtgaaatcccatctctgctaaaaatacaaaaattagctggacgtggtggcatgatcctgtaatcccagatatttgggaaggtgaggcaagagaatcgattgaacccaggaggcaaaggttgcagtgagctgtgattgtgtcaccacattccagcctgggcgacagagcaatactgtctcaaaaaaaaaaaaaaatcgataatttttgtaaaattatacatagtaaaaataaatggatcagattttccatctgttgcaaaaattttatagccttaaatattgcgcaaatgcgtggtggctcatgcctgtaatcccagcactttgggaggccgaggtgggtggatcacctgacgtcaggagtttgagaccagcctggtcaacatggcaaaactctgtctctactaaaaatataaaaattagccgggcatggtggcaggcatctgtaatcccagctacttaggaggctgaggcaggagaatcgcttgaacccaggaggcggaggttgcagtgatctgacatcattccactgcactccagcctgggctacaagagtgagactctatctcaaaaaccaaacaaacaaaaataattaattaaaatatatatattgcccaaatgtgtataaatgctgtatatggagtcattttcacaataatttctcatttttattgagtactaattgttttccaagaactgttagaagttgtttgtaagtattaacttatttaatctcacacactgtgaagtgagctccatgtaacataacataacataacataacataacataacataacataacataacataatgtggcatgacatggtatgatgtgacataacatacctccatcttatagatgaggaaactgagtttctttttttgttctgttttgtttttttttgagatggagtctcactctgttgcccaggctggagtgcaatgatgcaatctcggctcactgcaacctccgcctcccgggttcaagtgattctcttgcctcagcctcctgagtagctgggattacagctgcccgccaccatgcccagctaacttttgtatttttagtaaagatggggttttgccaggttggccaggctggtctcgaactcctgacctcagatgatccacctgcctcgccctcccaaagtgctgggattacaaacgtgagccaccgtgcctggccgagaattagtttcttgaccaaagtgtcttttaaggaataagggcaagatttgaacccatgcgctcaagcactatcctctgctatcttatttaggttaatgctcttgtgctaagcaaggttctatttgagtcccttcagaattcatgtgttgaaatcctaacctccaaggtgatggtagtaggaggtgaggcctttgagaggtgattaggtcatgagggtggagccctagtgtatggcattagtgcccttataaaagagaccttagagaactcacttaccccttccaccatatgaggtcacagcaagaagacagctgtctgcaaacaagaagaggtccctcaccacacaccagggtctcactccattgcccaagctgggtgcagtggtgtgatcttggctcactgcagcctcaacctccctgggttcaggtgatccttccacctcagcctcccaagtagctgggaccacaggcacataccaccatgctcggctaatttttgtattttttgtagagatgggttttcatcaggttgctcaggctggtctcaaactcctgacttcaagtgatccttccgcctcagccttccaaagtgctgggattacaggcgtgagccactgtgcctggccggatctgctggtatcttaatcttggactttccagcctccagaactgtgagaaatagatacctgtagttttagccacccagtctacggtgttgttatagcagcccaaatagaataagacatgttcttagttcagataccagcagctttccccatatttatcaaatgcaagcagtgagttcaccaacactagggccttgggcaaagtttgaagtctttctttaacacctttccatttccctgtacatatctgtcatccccttcttttgtctctgtccaccattttccctcctctcatgggctgtggctctggtgtctggggctcctaagtcctatcatggaactccatccagggcagccctcccgtttaactgaccttttccttcttttttccgaatctaaactgcctccactgtgccacagctattatgagataagctcagtcatattttatgtctaaatagaaacctgttgattaggccagagcacaaaatctggccaggatttcagggtgaatgagaacagtgacttctaaggtagcttgccttttgcctgattccaacccagcaagcaatgcagggaatagacaagacatcaagaatgcaaaggagtggccatgactatccattaccttaccagttccctatgtagtgaaattcaatggaacttcctaactgcagtgaaacaatgctaggtcagaagagcccgaaatgtggttcactgcctttggtatgcacggtagggaaagggggcacatcacaacctgttagggaatgcctgcttctccacagttacttaatactatgttcttatgttcttagtttttgggtctacagaggaatttaccataaagctaataacatttaagcttcaggactcctcatttccccaggcctctgtgagtggtgggagttgcttggagttgtaaagtattccacgtgaggaggggaagccagcatgcaattagaaaacagaattgtataggcatttctgttaaatttcctagagacctcagaagaaagagactaactgatttcttttctcaatctgaattaataatcagtttcatgcctaattgatatttgtggtttaattaatttatgtatttatttattttgaagtggctcataactgcatatgcaccaggccccactcctgaggtctacctgccccttattatcctagctggattacaaaagaatagaatttgttggaaattgatgtgggggctagcagctggtgctgcatattctgtttgcccctccagacctactcttcgctcttctctccctagtctgtcgcccaggtggctactctctgtggatgcttccctggctcccttgccatcaggttgtggtccatcagtgagatctgtatttttagtagagacagggtttcaccatattggccagatcatctgcaggggatgggaggactggaggagagtgttgatttctctgacaatgggttggcagcagggtgggcctcatgggtgtgcaaactatggagtcaatagaaccccattcttaagaagggccctgtgcttggtttaatgcttttctgtcacggtcttaaattcttcattttatatttttaaaaaaatttcaactgttattttagattcagggggtacaggtacaggttcattataagggtatattgtgtgatgctgaggtatgtcattttatctttgaatgtgtgttttgtaagtgaaatcaaagggaaagtggagcatatatgtgaacagaggggttacatgaaatatatgtgtctgcaatttccagttgctccgtttgaatatagtatttacggtgtccccacgatcatagaatgcctatgtacccatgcactacataaggaattcagggagactcaaagcaagtacaaggtccagctgataaagccccgagatgtcatgctttctatttcaaccacaacttgcttaaaattcagaaaaaaggcaatgaaatttgagaaacacatacaaccaaggagcctcatcatatcgtttctttctcatgttacttctctgttacttcctaaccacttacactaaaaatgatgtcatagaaggaaaggggaagatagggcaagccatagttccttttcctttcagtctttccttcctcatccgtaagctgaaagtagagtgttggaatactgtatgagtataagaaagtgaaatgaaacagtcgagttagttttgtgcactatttccactgtttcactaggaacaaaatatgtatatatgtacaaactatgaaatgtaagtgtataattttcatgattctgcatgatagttaaatgcccttataatggcatttaaaattggcattgcacaagataaatggtagaattcaggctaataatttaaagttttaatgttttcttttttcttttttttgttttatattttttcaccagcagtttcaatgttctctttatttagaatagtgttagatacaaaattttagaaacatgacaagttgaggaaagaaaaagagacggcagaaggaaagcaaaactttatactttagtacctttaccacacttttttcttgcttttttcaacttgcactgggctgctcaaattatatagtgggctttggttaatagtgactctttcttccaccgaagtccacaattcctgatgggtggccatgtcctgcagctacaggtctccctgggctccaggagttgcccccttttcctttgttcttcaagcctactcctggtagcactccgtactgtgggtagcactcctgagggtaggtggggtgtgcgggggcgtcaccagagaagggaagtagatttcaccttcccttgttattttcctttaacctctgtccacatctgtgtaagttattctttcattagtctctcttttacactgctctgtttgtttgtgtatattttattatggacaatttcaaacataaatagttaatagtataacagacgtccacgtacccagtatctagcttcaacaataattttttcacccctttggagtgtgtcatttgcttcctgctgggatcttggctgatagaaggcctgcttatgcattttgactattcatcatacccctgtcctcaacagggaccagcaacttgacagcttgtttctaaaaagaaattaatgaacattgacctacagattaaaatggcggaagtagccttaaacatattccctgcctgttcagtgaagcttggttccctaacttcctcctgggcatccaagctcatctgaaactatgttttgttttgtatgcaaagctacaaaaagagggcatgctttgtaccctctaaagtaagtgactcacattaattaacagcatttattcccaccaattgataaatgctttatcttttcacttgtaggagaaaaggaaacatgtaggaagaattattttctttgtgaggaggtcctctttgtgagaggactgattacatggtcatagatcagcagcatatttgtcttcctcaatttcatgaacataattttgtcattaatgagatttgctagtaaagcagaaatgtcatgtctacaaggatagattcactcttagtatgagaccctcgccacttgtctcatcaaaaataatcatttcgggtttagtttttttactagtagacataataaaagtaatatattactattccataaataggcatttggaattagtctctttttcatcatatcccatcaaggataccatagaattgtccaaatcaataggaaaatagagaaggaaggggttggggaaaaaactaatctttatttttttgagatggagtcttgctttgtcacccaggctggagtgcagcggcccgatctcagctcactgcaacctccacctcctgggttcaagcaattctcctgcctcagccttccaagtagctgggattacaggcatgtgccaccacgtccggctaaatttttctgtattcttagtagagacagggtttcaccatattggccaggctggtctcgaacttctgactttgtgatctgcccaccttggcctcctaaagtgctgggattacaggcatgagccacctcacctggccagaactaatatttattgaatgccttctttgtgttataaatatttattgtcaatttaatcctcacagtaatcctaggaggtagatgttattattcctgcattatagaggaggaaggtgaagctcaaggaggttaaattgctccaaagtctacagctacatgataattacaaaagccactatttatgttttgcagagcttgaccctatgcaaagcactttagatccattaggaaattttaccctccgttgtaaatcacattatgtccataatacagattaggtgagtgaagcatcttgtccaggggcacatagatattaactggcagtgtcagaattctgagtcaattttgtctgactcaaatccttgctattctcactcccctctgctggttcccaagggagatgggtacaatttctgttacaatttctttttccatcttgaacttctcttcccttttgccaatgttcattcaatcattctgatctttctctttgataaagggcacaaaatcaaatgtgagtagacagctcctttgtcaccatattgcattgcatagtcaatctcaacagtgggtctgttctttctttgatcgttttcttgtctaatgtttaattttctctgttcattgtctccagatattttcacacatgcagtcctaaaatatcttaaaaagtaatatattttaaaattgatgcataaaatttatcattttaattttacattaaaattttataatataaaattttttatatacaactcttttaccaagagttgtatatacttacatatatataatttctgatataactaatgacatctaaaaaataaatatcacattattcgttgatatctatacggtgagatctaaatagtatagcaatttgatgccttatcctactttctaatttattttttattgtatgtatttatggtatatagcatgatgtttggacatacatatatccagtgaaatgattactacagtcaaacaaattaacatatccatcaccttccatagttaccttttgtgtgtgtgtgtttgtttgtgtgtgtgttgtgtgtgtgatatgagcacctaaaatctactcttaacaaattatcaatgtataatattaagtatagccatcaggctgtccattatatacttttaaaatatacatcataaagttcttctttacctgcaggacattttcttttgtttatttactccttgaaattatatttccattccacttcctactattttttctactttaaagaatttcataagtacatacttctccacaacaaaaatatgtaaaaaaatgaaaataattttaaatttcctgtgatggttcaattctgttagaaaattctacacaatttcttaaaaccacataaatatattacaaatattgatgggtaattattaaacataaaatgtaagactgcattggaattgcagttcttactgagatgggtagtattttccccccatatacccatggtaaatataccaggaatagcatcagtgctatgatttggttgctacaggtgctgagaagcttttcaactaaataaataaatgggaatgagagttttgttatggcaatggggctcaattctttgaattcttgttcagttacacaccaaaaattatatggtaatctatcatcaagatggtttttagtgatctctcctctgtggacttgattagaagtctttcactttggtgaaaagcagagaattagaatccatctaacttgcaacaggattaattatcccatcattgcaatcattttttccccttttttgagtgttctagaggtttttgcacctgaggcaatgcattcgtaggcttgggatgagtgtgaggtatgcctttctatattatcaagtgataaaagcaagatgattgggcaggggagataggaaaggagaacagcccgatgatgaccacaggacaagcttatcagaaaacctattcctttgaaactatccatgcccacttaccccttaggaaaactccacataccttccctcctctgcctgaagactgctgatctgtagacttcactcatttggtgctatagcaccttggcactgtggataaatgttgaggctgatctcctacattgtcctgtgggatggctttttttctcctcccatttttagcacatattttcttaaactttcaactctttcaaaagcttctttagttagccatgtgtggtgatgtgtgcctgtagtcctagctacgatggaagctgaggcaggaatgatcacttgagcccaggaggtcgaggctaccgtgagccatgatcatgctactgcactccagcctgggtaacagagtgagaccctgtctcaagaaatcaagtaaaataaaataaaataaaataaaataaaataaaataaaatacaataaaaaataaagcttctttagggcactataaataagacagcaacatttgtgcacagatgttttataatcctggccaattcaattttaaaaaagaaataaaaagagaaagaaataaggagagaaaggatgaagaagaaagaaaaagaaagaccataaggagtaaaggaagaaagaaagatcacaaatactcttgaagatagagaggagagttacaaaaggctgattctgtatggaggggctgtacatggtatatcaggcatgtggggattcaggtttctctttccacacgtatacagacattgactggttacctctgttcagcatctgttcctcgcttccctcagcaagagtacccccagctcattcccaattatctggcttttatgattgagcccatgtcagctccatgaacaagacctgattgctgacctaggccaatcagtatatcccatactcctggctataggaattgattggttcagttaagcaaatagtccagtccaagagattatgctcatgcttctatggagaaagaaagcatacatgctttaaatatatccgttattggcagagagacgctttctttgctgctggacatgagtgtggagatgtagcaccaggagcctctggtagccatcttgcaaccataaaggcaaaagtgtcttaatttttttttttttaatttttgtgggtacatagtaggtgtatatatttataggatacttgagatgttttgacataggcatgcaatgtgaaacaagcatatcatagagaatggtatgcatcccttcaagcatttatccttttagttacaaatagtccaattacattatataagtgacccaacgctattggtttctactacaattttttttttcaatcttgagcttctcaaagttcttggcaggaccaagaaagagaaagaaactgcgtgccagtcatggttatttgaccaaatcaacctctatctgatccagataagtccccaaatattctgttatgtgaaccaatgaaatttccttattgtttttcagttttaatgggatttcagtgacttgcagaaagaatgataaattatataaaaagtaataatatagtaactcactgtaatcagaatatctctgcatttatttttactcttttttttctgcacatattgggattcacagacacatgttttgaagaaagcatagcgttgcttaaaaacaatgaaaagccacagacctaaaaagaaaaaagaaaagaaaagccatagacttagatcttgattcatgtcaggaaagatactggtgtttatgggggtcaatacatagcacccatcttttctctacctcatctccaaagccactgagatctagatcaaaatgtgaatattcttctgatggagctgctgcagtcatggcgagcttcctaatagttcagacctagctggactttctcacccagccacaggcagcaccgagccagcacaggcctgttcttgggaaactaatgataagggtgcataaacaaatgaagacttcatagacaggctgacttttaagagaagagagaaaggaggggcatggctacagtaccagtgtcttatctcagccagtatgtcaatcctcttacccagaataagataagaatagtcaggggctgagagtcaagaaagcaaatgtacaaaaatatgtaatgagaattgtggcaaatactagaaaggaaacaaacaaggccttgtgagaaaataactgggcagggctgctttaaaagggatagcccagcaaggctctatgagaggacatttaaactgaagcccaaaggacgaaaaggaaactgtcattcaaatgggggaggagattagagacaggagagcattccaggttgaaagatcctgcaaatacaaagtccccagggtggggatgagtataggctaggggtgcacaaggtgaagcctttaggcaaggctgaaccatgccttaagtggggatcaggtgtttggattttgttccaagtgcaatggggagttgttgaaccatcaaataggagagtgacatgaactgatttatggtttcaaaaaatacctttggctgttctgaaaatgagctgggcaggtttcagagcagagacagggaggtcagttgggagaacattgtagtagcccagataagagatagtggtctaaagcagtgccagtggatatacgcagaaggtaatgggtctgagacatattttggagttggctagacacagtatgctgatggattaaatatagttgactaaggggtgcctagattttttgcctagagcaaaaacatatattatttcctccctcccttcctttctttctttcttctttctgtaaataaaatgtacaagaggccattggtttggacttaactcctgcactaagcccaacagaccaaaccaaatggagttactcgtgctgaagttccaagccaccatgctgaaattaatctgtttatctgaacttcagagaaatcaggggaaagagagataatagccaaatccccaaacaggccagttttagctagcatgataaagaagtcacttctgctttaacctttacaaagaaagtaactatgaaatgaccaatccactttttattctcagtttcgtttattcagcctataaagtcaatctcttctgctcagctcctcggaataccaattctattttatagggattgcctgattctggaatcacaaataaaagtcaattagatctttaaaccaaacttgtgattttgtctttgacccttccttttttcctctttttcttctttctttctcttcctcttctattcttctttgccttattcatatttttttgtatgagaagagtacatcaatatttcatgtacagacatgttaagtttgagatatatagtcgagattcaactataaggataagagattctggagtttaaaggagatgtttagtttggatacatatatatatatttgggaattatcagcaattacatggcatttaaagccacaggaataattgagagcatctagggagagggtaaaagaagagaagaagtgcaaggaatcagaagatctccaacatttagaagtctaatagaagcaaaggagctagaaaggaaactgaaaatgcatagccagttgggtaggtggaaaactagaatatagcctcatggaagtcaagggaagagcactttaaaggagggggtggccaactgtatcatatgcacaacaagaacacggtgaaatgaagacagaaagatctcttgcattttgtcccatggaagtcttaggttgcccgtaacaagagcagttttagtaggggaaagaaagataatcataaagagttgaagaatgaatgggacggggaaaggatggtctcatcaacaaataattttaggatatttggatatctattgcagaagaaaaaaattagacccttatctcataccatatacaaaaatcaactcaaaatggattgaagattaaacataagacctgaaaatataagactactagaagaaaacatagggacttagctccatgacattggtttgggcaattactttttggatatgacccccaaagtacaagcaacaaaagtgaaaataaacaaatgggattatatcaaactaaaaagcttctgcacagcaaaggaaatgatcaacagcatgaaaaaacaacctatataatgggagaaaatattttcaaaccatacatcagctaaggggttaatattcaaagtatataaggaactcaaaaacttactaggaagaaaacaaataactcaatttaaaaaatgggcaaaggacctgaatagacatttctcaaaagaggacatacaaatgatcaacaggtatatggggggaagaaaaaagctcaataacactaatcattagagaaatacaaatgtaaactacaataacatatgacctcacaactattagaatagctattatgaaaacgacaaacgataacaagtgttggtgaggatgtggagaaaagggaaccctagcacactgtttgtgggaatgtaaattagcacagccattatggaaaacagcgtggagattcctcttaaaaataaaactgccgtatgacccagcaattccacttctgggtacatatccaaaggaaatgaaatcagtatgtagaaaagatatctgcactcccatgatccctgcagcactattcacaatagcgaagatatggaatcaacctgtgttcatcaatgaatgaatggataaaatatatgtggtatatatgaaaaactattcagccttaataaagaaggaaatcctgtcttttgtgacaatatggatgaacctggagaacattatgttaagtacagtaagacaggcacagaaagaaataccatatgacctcactcatatatagaatctgaaaatttgaactcatggaagcagagagtagaatggtggttaccgagggttgtggagggagagaggttggggagttgttgatcaaaggacacaaaacctgagttagacaggaggaataagttaaagagatctattgtatagtgcggtgactacagttaataacaatgtattgcatgctcaaatgttgctaagagtagattttaagtgctctcaccacaaagaaagtgagataatgcatatgttaatttactttatttagccactccacaatatatacatatttcaaaacatcatgttgtacactgaaatttttaaaaaatcattaaagcacccaaaaagcctataaaataaaaataaataaacaataatttaaatgaagaacaagaatgaatgggaggtgaagaaatggaaacagagctctagaaaactctttttgatagattttgctgtgaagggggagttgaaaagctgtaaatagaaggaaatgtggggccaaaggaggtgtttgtgtgtttctttgcttgtttaaagatgggagattctatggctgtctgtttgctgatggagctgtgatctagtaaggtgggatgtagtgacatgcaggagagaaaagggtaaagcaaagaagtgaggtcttcgagaggaagggaggaaatagtccaaagcacaaagattgagactgaaaattgagagtgaagcctgcccttcgcctaactggagagaaaaagaaggtagaagcagaaatgaggctgggcatggtggctcatgcctgtaatcccagcactttgggaggctgaggcaggaggataacttgaggctaggagttcgagaccagcctgggcaatattagcaagaccccatctctacaaaaaaattaaaaattagacaggcatagctgagtagctggagctacaggcgtgcaccacctgtgtgccgcctgctctacaggtggcacacacctgtagtcccaggtatttaagacactgacgcaggaggatcacttgagcccaggagttcgagactgcagtgagccatgatcgcttcactgcactccagcctgggccacagagcgagcctctgtctcaaaaaaatgaaaagaaggccaggcacagtggctcacgcctgtaatcccagcactttgggaggccaaggcgggcagatcacctgagctcaggagtttgagaacagcctggccaacatggtgaaaccccgtctctactaaaatgcaaaaattagctgggtgtggtggtgtgtgcttgtaatcccagctactcaggaggctgaggcaggagagctgcttgaacctgggaggcaggggttgcagtgagccgagatcacgccactgcactccagcctgggtgacagaatgagacttgatctccaaaaaataaaataaaataaaataaaataaaataaaataaaataaaataaaataaaaaaaaaaacaaaacgaaacagacatgagcaggcaaagaagatgagtgaggttctgtctgattttctattttcttactgctatccaaggcctaggatagagtaatatagctatatcaccctcaataattacgatgtcttataattatattttaaatcctgccatgtataaatcaaaatatgacttaattggtaacgttatgagactttccatagatataaatttacaaagaataacaactttcttggttagagcatgtgtgcgattttttcaatataagtacagtctaatcgaccacatttagaatgaaatatgagaaccaagagtattctatgattatgattatagatataattactgacagttgaaatttgcttgcttgagtagaccagataattaaaatatcatgttaaataggcttaggatcaaacctatacagaactgacggctttgcaaagagaaaaatttccatggctggagaactgcattcttaacctgggccaggtatttcaaaaatatgctgttttggtcatgagggaatacagggagggaggagcgtgggtggggacagaaatgttacagatgactttgtgcaaactcatcaccactgtaggaaaaacaacacaaaaccacgacccagtcagtaacattatcttaggtctatagagaactggcacactttttggctgactgtcatcctcaataatttatcttgtagttacacaatgtgtttccttaagaaaactcaaagagcactatacaagttatttcattgtcttcgtaacattctgaagataaaagcagaagggaagttgtctagaccaatgctatccaatagaaatatgactcaagccacacatgtaatttaacattttctagaaggtacttttttctttttttttgagaccgtctccctctgctgtccaggctgaagtgcagtggtgtaatcatggctcactgtagccttgacctcctgggctcaagcaatcctcccacctctgcctcccaaagtggtgggactacaggcatgtgccatcacgcccagctaatttttgtgctttttgtatagacagggtctcgccatgttgccctggctggtcccgaactctgggctcaagtgatcttcctgcttggcctcccaaagtgttggggttacaggcatgagccactgtacgctgccttaaaagctacatttttaagacctaaaaagaaataggtgaaaataagttgaatattatattttatttaacccaccacatctaaactattatcatttcgccgtaatgaatataaacaattgttcatgaaatctgttacattcttttgtttgtactaagtctttgggtttattttttttcagcttttatttttagatttagggggtacagtactaagtactttgaaatctagcgtgcattttacacttccagcaaacctcaattcagacaggccacatttcacatactcagtagccacataacagcacaactcaagagaataaaagaaagggcgacagtcacagaacctgaagtccagactctattgcaagctaagataatgtgagtcacagtttgtcactgccctgcttaaaatcctccatgggtttcctgtcacacctatcacaacagctgacgtcttacctgtaaggctgcacatggaactgcccctgccttccttactgatttcatagcctgctaatttccccctcattctgtccccatcctaggccttctcctttgctgagtccagttcattcctatgtcaggttggtggcacttcctcctccttcagcctcaaatatatcttctcgtggctcaaaccgtgacttaattcatgtttttgctgaaaagtcattttataaaggccggcctatgatcagaaatagctccttcgctagccactctccacctacttaccctgctttcttaatgtttaattaattaattaattaattaattttgagatgaagccttgctctgtcgtgcaggctggagtgcagtggcacgatctcagctgactgcaacctctgcctcccaggttcaagcaattctcctgcctcagcctcccaagtagctgggactacaggcgcatgccaataagcctggctaacttttgtatttttagtagagatggggtttcatcatgttggccaggctgatctcgaactcctgacctcaagtgatctgcccttcttggcctcccaaagtgctaggattataggcatgctccaccacacccggccttaatgtttattgtgctaagtattgaaagtatatatgcatgtatactgttttatatatacattttttttttgagataggatcttactcttgcccaggctggagtgcagtggtgggatcacagctaattacagcctcaacctcccacgctcaagagatccttctgtccctgaccccagtaaatgggactacaggcatgtgccaccatgactggctaatttttaattttttgtagagacaaagtcttgctatattgcccaggtgggtcttgaactcttgggctccagtcatcttcctgccttggccgcccaaagtgctgtgattacaggcataagccatggcacccagcctgaattttgttgttgttgttgtttactatcatctcctccactggaaagtaagttttatgaggtcaggggctttggtttggtttgtatactgttagattacagcacctggcacacagtaggcttgttgaatggatgagtcattttgggcaggtcatttggagggtacagtgcaacatttaggagcttgcactctgaagtgagactccttgagtttgtactgtagcctgtctgctgactagctctgttcctttgagtaactgcttaacctcttgcaacctcaggttcttcatctgaaaaattgggatgttaataatatctacttcgtagagatgatgttattttgaggattaaatgagataaactaggtcaaatacttaatacagtatctagctcataatagacttgagaaaaattgctattatctattaaacagagatgaaaacgagtgcttctgcttagacatacttcacctactccagtgctccatagccttggctctggtcaaggttcctaacagacgttcctctgtgtgatccatccttatctgttacccttttggcaccactcgataggttgaacgttctcctccctgattcccacaggacacagactttcctactacttttctgcttgtctctgttcatgcccctttgcaggctcctcatcctctcccctttttatatttgttcaggctctgcctttgacactgattattctttcctttttcttcaatttttcaattctgttaatatacacataacacaaaatttactatgtttaagtatatacaattcagtggtattaaatattcataatgttgggcaatcatcaccaccatctatcttaacttttcttattttataaaactgaaactctatgcccattaaacagtaactccccatttccttcttgcttcaacccctggcaagtaccatcctactgtctgtctctatgattttgactattcttaagtacctcatgtaagtggaatcatacaatatttgtctttttgtaattggcttatttttcacttaacataatgtcaaggttcatccatgttgtaacatgtgtcagaatttccttccttttcaaggttgagtaatatcccattgtgtgtctacatcacactttgtttaaccatttatctgtcaatagacacttgaactgcttccacattttagctattgtgaataatgctgttataaacgtgggtgtgcaaatatgtctttgagaccctattttcaattcttttgggcatatacctagccaccgattactctgtataccttctacctgagcaatctcatccacccccaggacttcaattgccatttcttttctttctgctttatttatttatttattttttgagatggatctcaccctgtcgcccaggctggagtgcagtggcatgatctcagctcactgcaacctctgcctcccgggttcaagtgattctcctgcctcagcctcctgagtagctaggattacaggtgtgtgccaccatgcctgcctaatttttgtatttttagtagagacggggttttaccatgttggccaggctggtctcgaactcctgacctcaggtgatctgcccgccttggcctccctgatgctgggattacaggcatgagccactgtgcctggccttcaattgccacttctatgctgatgattccaaatctacatctctagtccagctttctctcctgtgctccaggtccgtacctgtgatgcccttacagccattctgcttggatatccaatattgaaattattctatttcctccaaacctgctgcccttcggtatttcctgtctaaatgaatggcaactccatgtacccatcgtccaaaccagaaaatgtggtatcaatccggagtcctccctctccaatcccacaatccaatcaacctcaaagtagtcacacatctacttctacatactcctatagtcatacccgaattcaggtcaatatcacttcctgtctaccttccagggtactggtaactaatagcttcctagagacacctctgtatccattctttcctccctcaaattcttttccataaagtaactagaataattttaataaaatgcaaatctgatctcattatcggatgctcagatcttcattgcttagaactccaatgtgatgggtagctcccccttgcctttaggacaaagtcaatgtttttagccatttaatatttagttatacatattttaagttttatatacacacctgttacaaacaaacaaaacagcagccctacaacataccctctcccatatcactgtccaccatttcttatggttcagttccctaggggcaaccccttccagctattctacctgattcctttgaaattatctccatatctctaaataacgtatttatagtgctattaaagttttcctcagtaacctctaactttagaaatgaagatttaatttcaccaaaccccataggtacccatacgcatgtacaccttccattcttcttcttcccaacatgatcatgatttaataatattgcattcagtatttgcactgataggactttctacatatttatttctatatatttatttatatctcaccatatagtatactatgctatgagtacacttcctttcttgtactgctttttgtttgttttttttctggagttaatagctctctttttcctcccctgtaactttatttttgtgatgaagatgctgactccatttttgtcgtttgactgttgatagctttcttcttttatcttttctttccttttttttttttttttttttgagacaaggtctcactatgttgcctaggctggagtgcagtggtgtgaagacagctcactgcaaccttaacctcctgggctcaagtaattctccctgaccacaggtgcctgccatgacaccaggttatttttatttcattttatctatttattttttgtagagaagaggtcttggccatgttgcccaggctggtcttgaactcttgggctcaagtgatcctcctgccttggctttccaaaatattgggattataggcatgagccaccatgcctggcctgttgacagttttcaattactaccactttttcttgtctcctgtacatctgggaaccaggataaaaaaaacctgtgtaggcccttgcttctgaaagccaatgagaatttaaaatgacactctggcccattctaggagaattttcttccatgctaagtctatcctttaaccacaataaaatccccaaaccacgcccagccttttgctcatcttctttcccttttgggaaccccctaattactgtactaaatctagtttattcatattcactggtgagtgcattgtgtcatttgtctggatacctaaatttctgggtgggcaatcatgcccatctctgtgcagactgatcaaaacagctttctatgttcttattaatatgtctccaaactgtccccacctctagttttgtaaatcttccctcaacatgctttttaaaattttttaaataaaattcagtctgaaagttttctttttttttttttttatcaacccatcttcacattgatcaatgtggtttaaaaaccagttgttctatcaatgtaattttcctgatgaactttctcctagagtcttctgccctgctccagtccaccagattggttgactggcatccatctgcactgtggtcttaggttctccctccattatcatcctgcccttctcacatattggaaccctgttacatggattacatttccccttttcttgttctggttgaacaaatcttctgatggcttactgagaggtgaacctgggaggtggcatttttgacctttcatatttgaaagcatttattctctgctctcccacctaattagtaatttggctggaaatagaattctagattagaaatcactctcttttacattttctagtatccagtgtttctgttgagtagtctaaaaccattctgatactggattctttttagaatcctaattttgttttctgaaagcttttcgaatattctcttggttcacagggttatgcaatttcacaatgaagtgtctcagtgtagatttattttcatttgttttcttgggaactcaatagaccctttcaatttggaaagtcattttcctttattaaaggaaattttcttgaattatttctttgataatttcctctcttctattttctttgttctttctttctgtaaacttctattattcagatattgaacttcctgaactagtctgtacctttctcatctttttttctccactttccctctctttatctttttgttttacttgctggggaatttcttttcctttaaattttaaagctttacctgaagttttcatttatcttttttcttttctttttttttctttttttgagagacggagtctcactatgttactgaggctggagtgcagtggtgtgatcacagctcactgaaacctcaacctccagggcccaagctattctactgcctcagtctcctgagtaggtgggactactggcgcacaccaccatgcttggctaatttttaaataattattatttgtggaaacaaggtcttgctatgttgcccaagctggtctcgaactcctggactcagtgattctcctgctttagtctcccaaagtgctgggattccactttaggccactgtgcccagcctaaagtttccttttaaactatgatatttttactgtccaatttatttttggcctttgctactttttaaaaaatttgtagtacccagttcttgtttaatggctgtaatatgctataatattttgctatctttttttgaagatattaattcttttcttcttcatagtctttatttcttcctagctgtttttccattagtttgttttggcctctacttttcttattatattccatcaactatatggagatccttggctgcctgcccatccatatctgggagaaagacactgaaaagtttttggaaagcttgatttatatggttcagcctgtcaactatggttttctctgcaggataatctgttggccagaactatgtgaaggaagtgagaaaagatggctagggtccttgacattcagttataaattttcagtaggttgcttctcagccttgccaatggctggcttaggaatcagctttcttgggactgacgactgtaatttttccaatttccaaaattgtgttgctgctttttcctcttccattacctgtgtgcttatggacttatgcttttaaaaacttcattcatcatagttttggtgagttttcagaaggaacagaaactaccatgaatgttgtctgccatttctagtaggaattaaagcatatataccttttactgtataagtattaaagtgtctcccttttggcccttgccaaacttgccaacctcatcttatgtctgttgcatactccaactgcctttcagattctcgaacccgccatgttctgcctttgccatctggcccccacaaatgctgatccctctgtaagaaacttctgctttctgcgtgactacctctatggatccttcagatctcagtttaggtgtgattgctcagagaggatgtgtctcaccctcaaattatggtgaaatgtccttgctgtggcattcagtcttttctctattttaaaatgggtcatgttttattgtaaatggtggttttaacatcattttccctcactagtctgtaagcttcgtgcagggagggattatgaccatgctccatctcacccactgcagtataaccagatcttagcacagtacctgggacatagtaggtgctcaatatgtgtttgatgaataaacaaatgaagacaagtgaaattactttcttacagtaaggaaatagagtactgaaaatggagcctcccacctctttctggttaactacatcaactgtccctcttttcttggtttgtaattaaaaggtggatcacacctgtaatcccagcactttgggaggctgaggcaggcggatcagaaggtcaggagatcgagaccaccctggctaacatggtgaaaccctgtctctactaaaaatacaaaaattagctgggcatggtggctggtgcctgtagtcccagctacttggaaggctgaggcaggagaatggcgtgaacccaggaggctgagcttgcagtgagccgagattgggccactgcactccagcctgggtgtcagagcaagactccgtctcaaaaaaaaaaaaaaaaaaaaagaaaagaaatcaaatatacttgattaggtgccccaaaattggggaaaggagataatgaccacttaaatttgtaggtggtggggccaggataattgtccatctctaatttacagtcaaggaagcagaggattggtaatactacacagatcatgatagaagattctagaactaagaattaatatcttctgcttctagccttgctttttcactgtttgaaacacacctaggatgtttatctctccaactcatccttcatctttgtaggtgcctccatgttatcctctctatctgactttcatcaaataactaccatcgtgttgctattccgggaagtgaatcattggttctcacttgatgggggcagtgcaataatcatcttggagtctttttcaatctacacatggctcttcctcctcctgcccttccagtccctacctagaatgtcatagagcagtcctttaaatgtgcatcctaataactttggtgtgactgtcttcataggtaaggaatgttggtttaaatattaattatgactaagctgtattttattaatctgctactgacattagtacttttcttacttttctcagatgtggaggtggtggtataatgtgagtcaaataccagctttagaacttcttaaatttattttttaattttcagtttttactcacaccatggctgcttacttatagacagctttagaacttgattgacctgctgacttgccactcaccagctgggttggtttgttccattttaccttttcattttgaaaattaaaaaacctacagaaagctaaaaagacaatgcaatggaaactgtatattcctcacctacgttcaccaatttttatcatttttgtcactaccctctcctgtgtgcgtgtatatatgcatatatacatacggagatagatcaacatgtgtgtgtatgttgctattaaatcatatgaacataatttttgttgttgagccgtttaaaaataatttgtatatatcatgacattttatccataaatacttgtcatacctaagaaaattaacttgaatccaacatctaatacactgtcaatattttaatttctaatcttctcaaatgtattttacaactgtgtgttataaaatactgtgcggtttcatattattttttaatccaggagtcagacaaagtttgtgcattacttgtggttgctatgtctctttaatatagaacaataccctgccttgttttgctttgtttttcatgaacaaacatgaatattgataccctttgaaaagccccaatcagtaatcttctagaaggtcccacattctgggcctgtgtgactgctaaacatctttggcagaatacaacataggtggtgtgggtacctcttgttgccttacattaggaagcacatggtattcaggatgtccgctattggttgagtctatgtttgatcacttgggcaagggcgtaacagccaaccaatccattgtgactgtaatctgtatagggttacattgtagaggattgttaccgctacggtttagatgtttgtgttccccctaaattcataccttgaaatctaacctccattgtgatagtattaagaggtggggacttttgcaggtgattagatcatgagagtggggccctcatgaatgggattagtgcctttatgaaagaggccccaggaagcttgtttggccccttctactatgtgagaacaaagcaagaaggcaccatctatgagaaatgggtcctcaccagacactggatctgcttgcacctgatttggacttcccagccttcagaactgtgagaaataaacatttgttgtttataaaccacaaactttatggtatttttgctaaagcagctcagatagactaagaaaattaccatgtgggtattctttttttttttttcttttgagatagagtcttgctctgttgcccaggctagagtacagtggcacaatcttggctcactgcaacctttgcctctggggttcaagcaattctcctgccttagccttccaagtagctgagaatacaagcgtacaccaccacatccagctaatttttgtatttttagtagagacagggtttcaccacgttggccaggctggtctcagactcctgacgtcaagtgatcccactcacctcggcctcccaaagtgctgggattacaggcgtgagccactgtgcctggctgatattctttactcgacaaaaatatatccagtgatttatttgcctcaatcaatgattacattggggttgcaaaattgtgactttctaattctgctgtaacttttacacttactctgctgagtagtgtttctcattttttattttttagagagaggatctcactctgttgcccagactggagtgcagtggtgtgatcacagctcactgtagcctcaacctgctggactaaagccatcctcccacctcaggctcatgagtagctgggactacaggtgcatgccaccacacctgactaatttttaaatttttttgtaaagatgggatctccctatgttgcccagggctggtctcgaattcctgggttccagcaatcctcctgcctaggcctcccaaagtgctgggattacaggtgtgagccaccgtgcctggtcagctgtgtagttttaggaaattaatttgatttcaggccaggcatggtggctcatgcctgtaatcccagcactttgggaggctgaagagggtggactgcttgaggtcaggagttttagaccagcctgaccaacatggtgaaatccgtctctactaaaaaatacaaaaaatcagctgggtgtggtggtgggcacctgtaatcccagctactggggaggctgaggcagaggaatcgcacgaatccaggggtggaggttgcagtgagccgagatcgcgccactgcactccggcctgggcgacaaagtgagactccatctcaaaaaaaaaaaaaaaaaaaaaaaaaattgatttcaatggaccttagttttttcacctgtaaaataggatcataaaagacaactcatagggtgatggtgaaagtggaggtcttcaattgcctagtatgtagcaatgattccacaaatgatagtttaaaaatgtttatttcgatcacttacaaacaccaattagagaggaatcctttttccaaagtcagttgtacatctttcaataccacacttttaatttctttcctataaggtaggaaaaagcaaaatacagtgtcgtaagttaaaagtttggatgcatttattaacctgtctgagtatggccactttcttgaactctctttgcttcagaagagttcctttctatacaataaggacaatcatgattataccaaagtatatcaaaagaaaaagaagtgactaccatcatgcaatcaaaatgctttataaaaggaaacattttggtaaacaagtgtgtgtcaatttagaactggaacctgtgtaatgatcttgggcacatacttttggcatttctaggcccattttcttgtgtaacctagtgataatgataatgcctcttggggtagtatgagttaagataaaatgagatcattaattcatagcctattataaaaccacaagttataatagtaacattgtacagttataaatattgagttattttagctagagaatgtcatatgtgcaatgatactatcaatatgacttctatagatacttttttttttggcttgtaagtgcttgattagaatagacatgtgaatgcagatgaactgtcaaagggcctgggaggaaagactaggatgtttttgatagaaaaggtgcatttctgaacttaattgtccttaacaggacttgtctggactgcacaaaagccataaggttttagttcactaaggttttagtttctgtccactttcacatccatgtccagggttcaattacagggctggtctctgaagtttagttttgatgaatgcaacatgatacattgaaattgatgccattcatgactgaggacccacagttaatggcacatctgtaccacaaatacaagtaataccaaaagcattattaagtgaactgtatcttagaatagtgttagatgttttctcgtataaatgcctatagtacaagttatgtaacaataaaaaacatgaatgatatgcattatcatatttaagcacggtttaatgggagaggggaacttaccagtttttaatgcatgctttgacgctggtagtttatcttctgcaaactattctgagctaatttatgtttaacatcatttggatgtttttacaacttctttgtctttcttacagtcattggcaagtagatcaatttacttaggtcccttggtctcttgagatgtaggatgaaaaaatgtacaattacctataaaataagcaaatgtaggtctcattttcgaacaagactggaggttttgtgtcagcagacagtgatttctgtaaacgtgaaaaggctctgaattaggaaggagtaggcaaaggatgggtggtggaacaaggaggagagatgagggaagccttcattgacctgagttgtgaatacactggtttctggaaccttccattttactcccctttctgatttcaatttgctctttgtcaaagaaaaaaaaaaaagaactctttaagtttggatactgtccaatagttggaacataagggttggtgacaagagttttagagtcaatgtaccaattttactgatgactcactgagaactttgtacaagtcacttaaccttgtgttacttcagttcctgatgtgttcaaaaaggataaatttgatcctaaaactagttaaataggttgactatttagagctctaagaggatatttaataatgtaaatgtctaccactttaataattatactctggcactatgtcttaatctttaactatctatgctttggctaaattctaaaactttacattataaacatatctttttgaaactcattttccagctctattcttcatgttcttggtatccttgtttcatggatttcttttctctgataatattttaaaaactgtttcagatcaataagtctgcttttgctggaattttggattctaattaaatcctttatattttatcttacttaaattaggattctttcccttataatctactaccagcatactagcctgatatttttcttatgtggaaaatatccacattttattttataataaaagcataatgtatatgtaatgtgactagaaatgatgtatcttaaatttcacataatttttggcaatgaatccttgtctatcttatttgtgtatgacttactcttcattaatatatctatctatagtatataagatggaagagggaaaatttcatcattacattttatttatctattagagatgggttcttgctgtgttgcccaggctggtcttaaactcctgggctcaagagatcctcccacctaagccacctgagtagctgagactgtaggtatgggtaattgcttctggctcaccattaactttagaattagaattttgcagctatgaatggacctagaggttatctagttcaagcccctcattttatagataagaaaataggtaaatcacttacttgtctaaggctacaatgcacctagtgatagacagtagggactagaactcatgagtcctgggtccccagccacttttgttactactgaactccaatacacttgtatcctttaattggtgaatttggttaaggtcaacccatgttgggttcagcctctagataagcttatctctttgtacttgaacactgcacctttaattcaggccatgcaaaactataaccttgtaaaccagaagttgagatggagaactggcacagatccattctcctactgaaaaaacatgctacacagatgctggatagtcatctttgtttccaaggacaacacatcacttctcagagatagcaatccattctatatttatttgacaaacattaatttacattctctatgcaacaggcactgtgtgtttcatatcttagggtccctgaacttacactgtttaagatgaaggcaaatgtgaaacaaataatagtagaaagagttgaataagtatacatatcttaaaagcgtcaagttaaaaatgtccttctttgcattgcagtttcttgcaaaatttgctcttttaaaatataaccaggaaagggagcaagatgagcatataatggaaagttggttactcataattgccaagctttatttggcccaggcttaacaggtgtttctcctgccaggtatactgttgtaactagaggaagttgttctggagttgggagagctgaagttttgaagtggggtagggaaaaggaaaatattcattatgtttatattagtatttttattattataaaagtaaagcattcttagaacattcaaactatacttaaaggtataaattgcaaagggaaaagttctctctgttctggatatacaatcaacagttttctgttcttttttccagaaatattctatgcatataggaacacatagatgtgtatacattttttccacaaatggtttaaaatattaaacatgcttttctcccaaattagcctgtacatattcacacatcagtacacactgatctcatttaagaaaattggtgcatacctttgtatgcttttaccataatttaagaagaagctgactactttttttaagtcagaaatactgggaaggggaagagcatggtggtggtgcacgcctgtaatcccagaactttgggaggtcaaggcgggcggattgcttgagctcaagagtaggagaccagcgtcggtaacatgatgaaaccccgtttctacaaaaattagccaggcgtggtggtgcgcacccgtagtcccagctatttaggaggctgaggtgggaggatggcttgagcccaggagagaaggttgcagtcagccgagatggcgccactgcactccagcctgggcgacaggccctgtctcggaaaaaaaaaaaaaaatactgcgaaggtaaaataaacatatatttaacatattatatatttgaaacagccattgtcacagtggataacagtcacaggtgtataatagtgaaagttcgttaaattaatatttcttcgtgtttgttgactcgtacaacccattagtgttttgattggttgcatttgtcttttcattcataactgctgaaaactttctccctaactaacctgaggaagtggtaaaagtcaaacttttttccggtatgaggccacccttggtgctgtctgtaattatctagacatggcagccaggatccaacagctttgcgttttaactcatatggtctttcctggcgaattccttgcccccctctgctccccacttagcttgacttcctgtcttttatcatccgcaatctatcaagatcctacaatgtgctcagtgtagggcggaacaaatcactgttttacctcacaatttaaggaaggcagggggctagtttttaagataaaaatcttttaacaaaacataaactccccaaaatttcctacaagccaaacagcattgtcacaccctcacaagctcttattacttacacagccaaatgactcaagattactaacgtttctattcataaggagtttgctggcctcagatcaacacaatcaagccctcccccaccttccttctctctcccctgggagactgacgtttggaactcacgccgcaccaggttttttcagaatgaagacgatgtgtgttcgctgctggaactgtttgtcctgggattttataaacacctcccccactcctttttaaagttctgtttttgaggtgggggaaaaggaggtcggaatctgtttagcctttaaatctcccaattcagaaatatattctaagaatttaatagaaaaagaccaagggctgtgtctgctatttactgcagaactgggtattcctatcagaaatcacctacatgtgtcaccaagatcagagacaaggatgagggaaacagcatgatccctgccttctggagggttacagttgaagcttccgctgcttctgcacttgacctcaaaacaaacaaaaaacccaccgcaaacaacaacaaaaaaatccaggcccacctttccccttggatctttcacttgacagctttctcggcccaaaataaggcaccctacatctgaatgcatccctaaggccttaccgcacccagtccaggaggcagtcctggcagctgccctccaccgaactccgcgctttttcacacacgctcgtggaaggagaaaaccgctcaaacaactggactcggcccgtttcctttcggtaacctccccacagcccaacacgctgtccccagacgctgcccgctcccaccccggtcccttcgtgatcctcccgcgcgcgggcggggcgggggaggagcgcgggggcggccgggaggggcgcggccgggagggggcgccgccggggcgcgagccagacacagagggccgcggaggacgcgggaggcgagcggggagccgaggtcgtgctaggatcccgcgcccaggggccttcgtcgagggaggggcgtggcggcggcagcaggagggcagcaggagctgtcaggctggcggttccgcgccgcggctccttctgcgctgcgcccgcaactctgggctgagaacttctcccgccggcccactcgccctcgccccgcgcactcggcgccaggcgactcccgcaccttgtacccggcccgccccgcctcctccttcggccgcaccactccccctgccggccgcgcttctctccgttacaaaggagggaaaatgagccgggcggcggcggcgcggcgcggggccaccacggcggcggcgagcgcggccgcccccggcaccacgtaaaccgcccccgcccgcccagctgcggcccaggccggagcggagcctgccgtcctccgcctgcctgctgctcgcctccctagacctgcgcgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattggtgagtagcgcgctgcccccggcccccccagcgcccgctcccctcggcctgcgcccccgccgcgttcctggcaccagccatgcagctgccagcggggctggcgtggggtgcgttgtaggcggggatcgagggcacagtgctagggacccgggggagggcaaggacgtaaaggaaagagacccctcttcctcaggatctgggggttcatttgtagattctctcaagcctacaatatgggttctcccctcctccgccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgttcagtctcgaggtctctgaatcttcccgctgctggagagaaatgcgcgctgtggagttgtctggacatttaggaatgtctctcgaacttgttccatttaatagagctcaggggctgttgtctttaaaccaaacaacaaaccaactgaccaacagtgtttaggacagtgacgaataaatgcatgtcacaggttgtaatagggtgacagcagtatcacgtggaatgggtttgttagattttgagtactgggcatagaaaaccccttttaacctgaagagttagctgcctcccctactgtcacaactttcactaataacatgtaactgccctgagcaagagaatgctatagacacaaaagataacccctgcgagtccctaggaagctgcctagtctttgtttcacttgttttaaatgtcatccatgttaacgaaagtgttaatggaaattaaacataaaggtacttaattccttaaaataaaaccctgggatgcacatgagtgttacagatatccttccacccattcattgtaagatatgcaaactttcttcaagtgagagagtacaatggatcgaaatttagccaagtttttttttttttttttgtctttcgacttaaaattttgtgttggtatgcaaaatctttccccagatgactgtaaagttatggtatgaaaccaatctttagttttatttattgcatgtattggatattaatttcactcttcagaattagggatacatgtggagagtccctgcattaagatgaagtttgaagccaagaagagtgtgagagagggaaatgttgagtcgtgtgcattattaacgaggatgtttcaaccctgacccaaaccgtcgcagaggcgggttctggagtccattaagccgtgttctaaaacacattaactatatatttactaatgctaatgattctgctggagcccctccagttttgtgttaaataattcattgcaattgagtctcagtaagaaaccaaggacattaatctaaaagttccttatatttaaataatttcaaggttttgatcgacaatcagtaaaatttggattaagtacagtgctggcaaatgggggtattatagttaattggattttctagcttactgagatttagtgatgtgaaactccttttgaatccaactcttgttaaaatgtcttctaagagctggtggattttatatcctccctttaggacacagaatgcagtgcagtgagcacagctgattatttcttgtattgatggaaaatatgattctgaatcgtagatctcattatggagtattgtaataggagatattgaagtgattatagttgtataccaagccaacgacattcaaagtagcattacagaaacaaaatctgtatcttcttattttcttgatgttttatattgtatttgcaaaattaaaaccagtgaactcattctgattatctaaggattttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggattacaggcgagagccaccgcgcccggcctatctaaggatttttaaggcgctagaggttgttgagttgagggcttactgtgggattatatagtgcatgagttaagaatgtgggctgtgtgtcacacagactgtttcccatgttgccatgcccagccaaggtctctcaacttctctgagcttcagtttttcatgtacaactcagtttcgttgttggcttttagtgaaataatgcataccatgtcttgtgtggcacattaaataaagactcagtaaacgttcaagatatgttatcattgtttttgttattattaggaattccatcatactgacataactgatcttatagatagaaagcaagagaagagggaagtggccattgactttgtagtgtagccagccttaaaacggagttaggcaggcctggatttgaactgggttttcgctgcttgctctgtgccagtggaattttgcagccggtggaattaccctaaagcccagagtcctcatctgtaaatattcatatacggtgaatatatgtgaagactaaatcggataaaacacctgaaaaatctagtgcagtatctatcacaaggtgaaggtcaataccataggctgtcattgttccttgcaatttctgtttataccccatcatcctcctttcttcattggtacttcatgaggagatcgaagagtgaatggtttattcttgttgaataatccacactgcaacatattcattctctttaaccaatctaagcttttgaaatagacatgctgactttattttgctgctttagtattatccaaaagtgtagcttgttgtatggtgaaatgtacaatactattatttagctgtaagaaattattaatcattcatctattgaaaatgaggaaatatttgaaagtatctgatgtctggtcagtgtttatcattaataataataattctaaatacataaagcagtgctaatgtttaatttgtttacacattagagatcatgctgactttgtcactgcccaccccaaatacagctgagctgagattactatattataaaacacatggctttcaagccatagtgctctaatttatgacatctgccagggaatgactatgatatagttatggttcttttataagatgagtgtaattgaattttaaagtcacccatcaatttcggtagtatttatggttttctactaaatagtgtcagcgtggttccttatttaggaattactacagttgtctcacacttttttttaaaatttaggctaacaaagacaaatgggaatttaattattgagtagtttaagtattttaaagttcatttcctcttttctttcttgtttcttttttatttttgaatgttagcctagaaggagaaaggctttatgtaatatccggtgtatgattaaggtcaaactgacattttttcatattcatttgaatgcattgcttcatacttatttggactgtctcctagagaaaggaagtttatactctgcgatatttgagatgaacaccatgtataccatttctttaaaggacatggtttgtgagggaactaaataaaaagaagaggctgtgattacactgaactttggggtttgttaccttgtgctgtaactgtgtaattctagagtccagttgtcatgtgacgaattcattatgtcagaaaagagaaatataaggttaaatgttcagacacaaaatttaactgttgtaccacattttccccaatgcaacttcaaaatattttaatttgaaaactacaaaatggaatttatatccatgatcttttaagagagaaccagtgtagcattttcatacaccaaaacttaagtgtgtctcaaaagatactctccttttgccattgaggtaggactcattaattcaacaaataattatttagtacctcttccccactgtagatattgttctgacagtcagatcgactgactaatgtgggtggtccctgtcctcaaggattttaagggaaaacaggccaattaacaggcatttacaatataaagtgacagattctaccatgaagattagcgaaatttgctgttggagaacacaggaggagcatcactttcatctaggtgaaatcatgagaagctttctagaggaaggactgtctgagcagaggactgaatagaatatctgctgatcttaaatattttgatatatgccccttggctattccagaataatgtaatatgcttgttactccatgaaatccttaaagataattgtggatttacatttacatgaatgattaatggcaatcagggaatgtaatcaataatgagatcttgtgttcttgtttgggtcagaatttactcatcagtgacctgatgaacatctggcaaagacatcttaagttggtctttgttgtcactgttaactgctgttcaggacaaggactcaatatttagaagaaaccgtgtaaggtgtcagtctagcagtgaatgacttcagtgaagtaatggtgttctgtggtaccttgagcttgagagtattgtgcagatgagataatctggcttcctgttcattatgtcatagcaaatacacttgcagtttcttctattttctcctcttgatacctccagaccccacctctttgtccagaatgttggagaattgtcaggacttaggagataagaaggaaatagtccagtttggttgttcaaggaattccagttttctgctgtcttcatttctcaacttgagggtcttcattccatatttgcagttccctaagggatagtatctttttttttggcggcagaggaacagggtctcactctgtcgcccaggctggagtgcagtggcgcaatcttgctcactgcaacctctgcctcccaggctcaagtgatcctcccacctcagcctcccgaatagctggaaccacagggcaccaccaccacgcttggctaattttatgtatgtatgtatgtatgtatgtatgtatgtatgtatgtatgtatgtatgtggtattgtttttgtagagacagggattccccctgttgcccaggctggtctcaaactcctgagctctggcgacccatccgcctcagccttccaaagtgctgggattacaggtgtgagccactgcacctggtggggtagtgtcaactgtagttcttattggatgctttgcttaagaaaacacatggctaaatttccagaacttttataatgtccaaaataaagacagtatatttaaaagtttgtgccgtgaattgtaagtttgctgctgtagctttgcatcttgcatggcagccacatagtgcgcgtgttccattaatctttgttaaatgagctaggtatgaggctgtatggcaatttgcttatgttagactttgtatttgaaatcaatgggctattaatttcttattcctaaaagtttagtttttcagatgaagcaacttgtctctatttagaattacattactaatgttttgtaaaggactcattagtcaaagtatgttaattaaaggacacgccttgggttgagggagtagacagtatggtaatattgttgactggtatttatacagagccttgtagcctagaagttaaattctagtgaaaatgcagtcattaggaattagctaggatcttaatatggttctatcaaaacagattattttagatttaatgtaggttattttagttttaatgtaggttaagttaaatacataattaaaacatgtgcaagtaattgaatgcaagataagccattcacaacaaaggactatctttttattttccattcactttcagaagaaatggttatccaataaagaaagattagtttattaggcaaaagggaaaaataagaaacttttagaaacgttttatttccctcagcctacctgcatcccccttaactcaccgcaatcacattcttcttgaaaacacaaatatatgaaacagagaaaataaccttttcacgattgttagagtatgtatcctaagcttttctatgatagcttcagtttaggcacattacttttctcagagcttaattgccagaataatttgcttttcattgcttttgtcagaacaaagctttccaatagctacccaagtgcttctatccagactaaatcatgtataaagcagcaaacacctatgcattgttccgtaaatttgaaacatttctccagctagtagtttcagataaattagctatttaatgcattcttcttaatatgaaacattctaagtaattgtaaaatgtaaggaactagatgtttgccaactgtaggtgaaattcttcttctatgttgggtgaaaaaattccagttctaaagctatgaacagtcacgcatacttgatggtggtcccgcaagtttacaatactgtatttttactgtacatttttctatgtttagatacacaaatacttgccattgtgttacagttgcctatagtatttggtacagtaacatgctgtataggtttgtagcccaggagtaataggctataccatatagcctaggtgtgtagtaggtgataccatctaggtttgtataagtacactctgtgacatttgcacaatgaaattgcctaagggtgcatttctgagaatgtatcccagttgttaagtgacacatgtctggatttaaagtaaatttgaagtattttctggttcctataaaatattctgaatgtattgttttcttttgaaatactttgttataaaatttatcatgtcgaaatgtttaaattatgtctcttactctgcaatgcttgttttagcaggcttagtctttcatcaacacacttacacttcacttagtatgaaaatgtcattcagggctctgtgcaaagaaggtgtcatcctaacaattggtgatatcttctcaaaacccaggagtttaaggggaaatttctttaagattacttcgtgattcttttatactttcattgaaacatgttccaactaaagaagagatagggaacagttatgtgtgcttctttctaatatctgggaggatagttctatttgcatatttataaaaaatatttcaaaagatgcatgctgtgcaattctctttcatttgcagttttcatatttgtatcataacattgttattcaggttggggtacaatttactttctgaaatgaaaacaccatactgccttgtttttttttctgttttctataacttagtctctttggaatttttcacaataactgtttccttttccttcttattttatagctttgaagaaagatgacaccacctttgatgaggtaggttaaatttctttatctaatgttagatgtatttaatgactaccaggtaaagtcagtagctgccaactttgtacctggaaacaaaaaaaatgcctttaaaacgcgagataacatctgtttatttcattgcattattatattttcaaattttaaataatcgttcaaatgagttttggtagcaagtaacagaaatatgtctttttcaattaataaatgagctaattagaagacacatgcaggcctttgtgttgttgccttcttgctagtggtagtgcttgagacacgcagagtgatgtacgtgcttaaggcaagtctggagctgttggtaagttgggcaccatggctcaccatggctccttgcagacctcagctgaatcagggtgtgatgtgttgtcgatgccacatattgtctgtcagtctcccaagggaggagctgacttttcctgttctagttttcctattctttgtatatcagatccgtcttgatctacttgccacaaagtagtgtaaaatactgttcaagtaaggcagagagttcatatgtaattaaatagcatcctgaatgtgattttaaaattgcagtcattcctgaatttttgtagtataagtaggaatcaccagagaaatagtgaatgtttacaaaatattttcacagtgccaaagagtgaaatgtttcattgtaaccatcctgagccacactcattgatctgtgttgtaaactgggccacatgtgtatatagattgtgtttttatataggaacatgggtgttatctatacagtgtgcttaccctaaagcctgatgaaagcataaatcagtttggtttggtggtttggtttgttttaatagttacatattccatgaaatatgctacctgtcttccctctgctgcagtgcttcagtgaggaaagggcatttgtgctcatggaaagtccccttggccatgtggctggctgtggtgcatggcaggtctgctcagagagaacctgctccaggctgggatttctggatggggccaccgtcatttggctgtcacggtctgctgcttcatctgctgcacctgttctctttttcctgggctgagctttacaaagctgtgtgtccctggactccaaagcaactttccctgccagcattcctgtgacatcctctaaaaaacttaattcttctaggcttgaagcaatagaggagtcttttcttcttccttcatagtgggcaataatggagttttcctctaaacatgtatttctggaatttcggtagtgttgttattgagatatttttcaggagagtgttttctttcttttcaggagcaatcaatatgagaatatttggtaccatttttctctttgtaaagaaagtttcccctctaattatgtagataatttaagcttacataaaaagagagaaataaggaaaaggagaaagaaaaaatctcataaatcctgttaccccgatacaacaactgttgaatgttcttgcttctttctccgtgttttaaaaaaagcagcccattattatatcccgcttttttctttgatatgataacattatattttcccatgtttttacaaactcttcctaatcatcattaggcatttcgaaaaccttttttcttgcttaaacactgttgttagtgattagctttaaaaagcacctgaggctggagcccagctgaaggttaaagatgtgtcaaacctgtaactactccctctctctgttattctgaaacctctgtatagtcaaaggtctggagtttgtaatttgggtcaaaatcatccttagcttttgcaaagtggcttccttcctctgccacaagagattgtaaactatcacaaatcagtaaatcacagaatgctctacttggaagatccattggaaataataattttcccactccatcattacacagatgaagaaattgagatccagaaggggcaagtcatttccagctaatgaaggaaagactcaaggccagaaaatcttgggagatagtggtaatgaaggcatgccggggtataatccccaattcaactaccctctgtttgggcatttgacttattaatttcatatcctttgtaaaatagagataataatagtatctttcctttaagggttaagataattaaataaggtaatgcatatgaaggtttcagaataatggctcacaaaaagtgaatagctcataattggtgttatcatcttcattgccttcatcatcaccatcatcatcgtcattgatgctttcactttgacatccaccttctgtagttggaagggctacagagtagatagaaggattaaaaatgaagaattacagctatgaggagagttaatttcagatattcctctaacatttcacctaaagcttcatgtgatgacttgcatattaaaactgagaaaatattatctaaaacccaccattgtttagattccgtatgggggtgattggattcactttttaatccctgagtgtgttgctcgtagttaactttcagtacgtatctattgaatgtgagtaaatatctattgtagaggagtagagagagtgatgaattaggtgttaggcaatgtggattctcatctgccactttctagttatttgggcaggtcgtttaacttaccccggccatgacattctcatttgtaaaatcagttgaactatgatcttcaagttgcctcttagctctaaatgtaggattctaaataatgtaacaaccaacataagattacaattttttttcatgttttatgtcagacaggtaatgtactgaccttgtagtaaggtttgagggaggcacatcttacacatgaggtgaaaccccaatcatcacgcttatgaactatacaaaaggatcaaaatgacaattttatcacatcagaaaagagcactaaaactctgcttatgtacataggaactgagttcttctgtgatcattttcagattataatagtagaaatttttttgaacgcttgttttttaccttctctctcctggagctggggaactctacagtccattggaatcaattcagattttagtcttaaaactttgagggttgggtcagcttcttaggtatgcaataaggtgtggcaactctccttagtatttatgagctggaaggctccttatttcaaggagtggcctcttccagagagtgcctgagctggagtttggtaacaactccctgattcatgtagaggatgcctctagagtatgtgtcaaatgtttgaccttgaacacagcagaaaaagaaatacagacttatttaatcatagactgaaatgccatgatttcagtctaatctgctaattttcaaaaccagactggaattatattcaggaactatgcttgttgtaaactgggctgtgtttgtgagcacacgtgtgtgtttgtgtgtgtgtttaattgaacagtttagaagttaagtattgagggcttcaggtatttacaataagcaaacaataggaattttgctgaaggcggtcatagttggagaggggacattctatgaatgatcattttgcttttcattcattgtgtatttggtccctgactacaatattagccatttaatgttctgtggtctaaatctacacattttacttggatggactaatcatttctaaaatatcccaagtaaaattttattagtttcagtccttttcccctcccagcttcttgatgtttggaagggtttgacatagtacttggccacagtgaaggggctacataattattggagaaacacatggttaagctagattgaaggtgaaagaagattggtattttgtgtcatagtttttagtggacataatgtttctagtgacattgtgatgagagttttgggtaaagcatcaacttcatacctgtgaaatgactgcagaaatttccaaatgtctttttacccttttgttcctaataaatgaccagaccatgtccttaagtggccccatttttcctggaataatgaacaataactacactatgatttctggtgaatttttgaattttatttttgatttaatgatttattttagaatattaatgatacctaatatatgaaaggtcagaaaatacagataatgtccaccaatgtaaaattaccacgcgtaaaaccttttgaactttggagacaaaagctctaattaagtgtatgtgtatgtgtatgtggaaatagttggaaatggtgatagctacagcaattcatgaattgttctcatgggtaaattaaaaggttaactcatgcagttctgctttatccctctgttttttagctttgatgattgccagaacaaagtgttggctctgcctggctctttggtgagaaatacaaaatttttagcaattagaataaacctttgaaatgcaaagaatttcatatgtttatggcatataatccagataattaagcacttagtttgtttcctaaaaatgggtgaccgtgtatgagttttctaattcttctctgctttggtgagttattttatgtttgtgaagtagaaggctgctagcacttattttgtcattttccagctattttattttttcaaatcctaggaaaatgtatacaaagcgtataaaattaaaaaaaattctacatctggtctgtgagtgctccaagcacatttttataggttaacttgcttactttacatttagtataacaattctgttaggtggagactgtgcacaatgatattggcttctagtccatgtccctctttgttattttatataaagatataataccagagataataaaggtggcagttattattattatttttttgagacttggtgtcccttggtcatccagtttggagtacagtggtgccatcgcggctcactgcagcctccacctccaaggcccaacctatcctcccacctcagccttctaagtagctgggaccacaggcatccaccaccacctggctaatttttgtattttttgtagagatggagtctcaccatattgttcatgctggtctcgaactcctggtctcaggtgatcctcccatctcagcctcctaaagtgttgggattacaggtgtgagccatcacatacagccatgcagtgatttttatgagaaccagaatctagggatgatatggtttggatcgtgtccctgccaaatctcgtgttggaaggggggcctggtgggaggtgattggattgtgggggtggatccttcttgaatgatttagaaccatccccttggtgctgttctggtgatagtgagggaattcttgtgagagctggttgtttaaaagtgtgtagcacctcccccttcgctgtcttgctcttagcttctgccatgtaagaagctggctctccctttgcctactgccaggattggaagcttcctgaggcctccttggaagcagaagtcactaggattcctgtacatcctgcatatccgtgagccaattcagcctcctttctttataaattacctggtctcaggaatttctttatagcaatgtgaaaatggactaatacaagtggttagatacaaatatgatttgtggatatttctggtcattcttttccatttattgagcatggtggaagctggttcagtcttttctctaccctgactatcaccattaagggctgtctcagtgtccatatggatgatgtatacgctgtcatacaacattctagcatccctgactttctcgtctcatacctgctttacccttatttggtttctgcaggaactgcatcttactgggactgtcctagatttaaaatattaaatcccactaacaatctttcctgtttagctttctcactgctgctgtattccctgtatcttttctttgccggcttccagtttctagatgatcccttctctgcctgtcccatcccattctcatagtccataacccattctcccccatagttccttccctgatcactcagggaacatcactctcttgctggtatcctcaatggccttacccctttgtacttcatttgtaatgtacgctgccagcccttgattttgacctggcatcttttcctatcttacctagtggctgccaagagctgcttgaggaaatcactctataaataaatttatcatttccatccttagctggaacgtcaggcaactgtggaccatcttgcatttgtgtccttgtgccgctggcctgtttcctgctgaactcttttcactccccctaagccttcttgcgaccctcctccaccctttcttcttttagtagaaggctttctctctgttagtttcctagggctgccctagcaaagtaccacaaactgtgtgacttaaataacagaatttttattgtctcacagttctggagaccagaagtctgacaaacagtagcagagttggttctttcagaggactgttagagaaggctccattccaggcctctccccttagctctagatgactaccttctccctgtgtctttttacattgttttcccttaatgcatggctgtctatctaaatttcccctttttacaaggatacaagtcatattagattaggggctcaccctacttcagtatgacctcttaatttaattacatctgtacgacccccttttcaaaataagatcacttttggaggtactggggattaagacttcgatatatgaatttttggtggacacaattcaacctgtaataccctccaacttcttagagcccttaataccgttaggtgtccactccctgtcaacatcctgcccattcatgtaccctcatttgctccagtcttacctccttttttcccattgatctcagagggggttttgtcctttgttttgttccaggccagttcctcctcctgtcttctcaattcctttccctcttttctactccagaagcttacataattgattctttcctttcttttctatgttttctgccctctcctttttctagatactttcaccataggctctgaacatgcttaagtcttccccatctcgtccataacttcagccttctgtcctctatgatcagttttcatgctctgattgagtggttgatgtacacttgacgtcagtgtggctgactcagctttctattctaacctccacatccagatgtccaactgcccactagaagtttctgccgctatgtctcacagtcaccttgatttcagcacatatcattaattcttgtatttccccaagcatgcatcttctcttgttcctctctctgctattggctgtaccagccacatgattttccaagctaaaaacctgatgctatcctaaccttttctccaaccccgcatccaggtgttggcttggtttttgttccttgctgtcatatccattctcacagctgatgtgcacactcagctttgtcatctcttcctggacttggagtagttgtataactgacttccctgcctacgacttgcctcctgctccaacagaatgatgggtctgaaatacaaatttgccgatcccctgcttactgctttaaaaggtgcaggtttaactccatactcctagcttatctttcaaggcctttcacgatctatctctttcgtaccttttgactcttatcaaacagttatctttgtgtgtttttttttttttttttttgagatggagtctcactctgtcacccaggctggagtgcagtggcgcaatctcggctcactgcaacctccacctccagggttcaagtgattctcctgcctcagcctcccaggtagctgggattacagacgcccaccaccacacccagctaatttttgtatttttagtagagacggggtttcaccaggttggctaggttggtcataaactccagacctcaggtgatccacccgtcttggcctcccaaagtgctgggattacaggggtgagccagcacacctggcttcaaacagttatcttttattttcgtgacttcattatcattgcagctgctgccatctcagttcagaaccttttcacttttacctattttagttcaataaactcttcattggtatcactgctccatcttattcctccactcagccttcccaaaacatctttcttgtcatagtactcccctgttcaaagattcatgcatcaaatgacgtttgttttatgtcaggctggatatggtctcagcctgactcttgatctagttcagcctcacaggcatttatgggttgaccatctctcagcatcttacagggctgggcctgggtggagattcaatctcactctctcttatagtaagattttataggccaggcacggtggctcacgcctgtaatcccaacactatgggaggtcgaggcaggtggatcacttgaggtcaggagttcgagaccagcctggccaacgtggtgaaaccctgtctctaccaaaaatataaaaattagctgggtgtggtggtgggtacctgtaatcccagctactcgggaggctgaggcaggaaaatcgcctgaacccgggaggcggaggttgcagtgagccgagattgtgccactgcactccagcccgggtgacagagagagactctgtctcaaaaaaaaaaaaaaaaaaaaaagattttatattactttctgtactgttttattttcactgtggtcatatctgccagtcctagatgctatgaaccttccatgcaagaggtctaaaagttagactgttctttaattatgccagtaatccagaaagtcattatatttcaaattcagcatttaagatagctgaaaaagaacatcactacctccttaattctctcattggaaatttagttttaattttctgatgcttaaaactttctgtgcttcagtttttcctttttataaatgtttgatcatatttaccatctccctaattatggtagacataattatcataattaggtctagtcccagacagtggctcaaatgtctgcgtagtgctgtaaagattcagagaggaagtacatgtcacaaagtgcaagatgtatgacatttgggagaattagtcactttcaatttgtaattctcaaaaggcagaatattacagaaatggaaaacatgagtagtgtcctctttccgttgtgagcaccctgcatcctggtggcaggctgtatagcctgtaggaagtctctgctgtaagggtggttagtgttccctcctgggcagtgctctgatttgcatgtttgaattcatttgttgaaagctgacctttgggccgggcctggtggcaatcccagcaccttgggagggatcacttgaggtcaggagtttgagaccagcctggccaacgtagtgaaaccctgtgtctactaaaaatacaaaaattagccaggcgtggtggcaggtgcccgtaatcccagctacttgggaggccgaggcaagagaattgcttgaacctgggagtcagagtttgcagtgagctgagatcgtgccactgcacaccagcctgggtgacagagcgagactctgtctcaaaaataaaaaaaaaataaaaaaagacgctgacctttgacgtaggaagtctttctgtacagcctaactactctattttcttcaacaagtgcaaaatgggctcagctgcagtacattatgcctattttccttctgactggaatttgagtcatcaatttagaaatttttatattgctgggttgtgattgggatggcttctcctattaggaaccatagcaatcattgaaatcagtgaagccaaggtgggtcagagttttctcaggactggaccatagattccagtcctgagtgtttgagactattttttatagtcccaaacactttttttttttttttttgagatggagtttcgctcttgttgcctaggctggagtgcaatggtgcgatcttgggtcactgcaacctctgcttcctgggttcaagtgattctcctgcctcagcctcccaagtaggtgggattacaggcatgcgccacctgcctggctaattttgtatttttagtagagacagggtttcactgtgttggtcaggctggtctcaaactcctgatctcaagtgatccacccgccttggcctcccaaagtgctgggattacaggcataagccaccgtccccggcctagttccaaacactcttaactcttattattcttgtcataaaacttataaaaggcataattacaagatattggaaccagcagtttgctttcagttttgcaagcttaatttctttaggtctcatcagcgtcttaaaggagctttcatcattttaagggaataattgaagtaatgttcactttcccttctgaatctattttattttcaatgtgtaaagttctggttatttttccaacttactatttattttttaagttttccttctttcttagcaacttagttttcttaaatttctttttaaaattaatttttttaaaaaaataataaaaaagatggcatctcattgtattgcccagactggtcttgaactcctgggctcaagcagtccaccagtttcagcctctcaaaatgctggaattacagacatgagccactgtacctggctgtcttttagttttattttattaactcttttgaaatgaactgttgtttcttttaggcatatgagcctgggaattttcttaaaattaattaatttatttatttattttgccttggtaagtttattgtgacctgggtgttccacgagcatcctaaacttaggctggggatatggaaaattattttacagtggttttaggaaaaagccaggtattagcaaaaaattataagattctgaaatcatctgcaagtatggcatgtcttatagtgcaacattatatgattaattttttaataatgaaattaatagttttcctgtttttcaatagctactctaaattctatgataatgatgaatcttatgtgtatgagtaaggaatgtgttgaaaaaaaattttaaggtttttatgacccatgtagttataatacgatagaaaaaaagttttcaatatgcacttttatacctagatgaaaatgcatcaggcaagtacttattcgacctttcactgattaagaatatctttctccaatcttgcaagttacaatttaaaagacatttggaattgcttagagaacccagggagtcctggattctacaattctgtgtgctcttttgtgttttctcagtctctgactaccctcatgtaagatgtctataaagtgtggtatttagaataaaactatgatgtttttcagagtttgggaactattctagtctagcagatctcgaacacgttataactctgtgttctgatcagctgaaatattgaagtgtgtgaatacttttctttaaaaaatgagtatattgaagtcagtctttcaattatgttttggtattttttttgagtgggaaagaagggggctgagttgcagttagagtaccaggaatttggcttattccagatttgcccatgggaatgtgccaaatatgaaattataacctgtgacatatctcttggataacttagttgtcttggagtattagtttttctattttaacggattttcaaaaaaggagattgcaccagttctataaagcagtgatgggctgtggtagaggtggagggtgagagttttcaaagtgctctgtaaagattttggtgcaggtctcttcacttcccctatcaaaatattcacgcaccttgaaaattttgctgctgtagttaggaagggttgttattgggggtgtgtcatatccctcaagtgagttcagagtttgagagcctttcttttaaaatatctgttgctgaattattaggagttgaagatggatattggtacaatcatatgcaaccttaattttttttggaacagctcttggttttagataatgctttctgatttttgattcagaaaatatagtcttcttagtcctaaaattgtgtatttattaatatcaaattcataatccagaaattttagccaaaagaaaaactaaaacagtgatacagaaatttctaacaaagaaatggataagtaagcattattttataacagagaaaaatgagtgagaataacttatggttacttttgattttaatgaaaacattttttattaaaaaatataggtaaagaagagagatgttagttacagttattcagggcatgaattacaaattcttttgtgttataggtgctcgtttattttaaatcttcagctatatagctctctttgtattgtcttcaagtcaatatgatggagaatgtcctgcagtgcctgattctcttctcttaaaaggcagactatttaatcttacaaatgagcatccttgggtcattacatattggggttcaggtgtgcaaaaggcttggtaacatatggcttgtccccagatgccctaattgagttcaaaactttccccaagaggtttgcattactttatctaaatgatgtgttacatgtgcaacaaaaaaggtgttttagtcatgaaaggaaaaaaataaatgtgtacttgcaagatacaatgcaaattgtacagtgtacattgcactaatttctatatagttattagaagataaaaaagattaaaacccataaaagtgacattaattggatgaccacagttttggatgatgcactttgatgatcttcagcattccctttagttaccttattatatcatcatcatcatatatatatatgtgtgcctgtgtatatatacacatattttcctccattttgattatttttttttcaggcaagatagttaggcatattaaactcaatggtggacttttttttcagcttcaaaaccttacctcttatcacaattacatgtgtttcattgaataattttaatatttgctattaagaaaagtaattatgttcatggcagaacatgtataaaatagaaattattatttacagtgaaacagccattgtatgtagagtatgatctcggttttgtaagattataagtatcctctccatgggggaaaacatctgaaaaaaaggaaatacaacaaatggataatggggagattggggtttattgaaattgtgacttgctcagagtcccttagctagaaggtggtggtttaatctagtattctaacctagtctctctgcatccaaactacgctgcctcccaggagaagggagaaagggagaaataacatctaggtactactactacaggtgcagcatatagttgggaaaacaaagttcttacaaagaaacaactgattttggtagtaattctagcagatgaattactgctagaattaggcctaaaaaaggcctaaaagtgaaccttaaagattcctgccatagatctatgtcatttttgaactgagttacacacattttacagagaggaaactgagacccagggagattaaatcattatgttactaaataatgttgctgaagagaacatggttgattagtcgttgtgaaatcaagggagtttctttgctgaattactctttaggttttagatttcagtttcaaggttacgttaaaactaagcttgtattgccatttttatctggatttaggtggggagtgggtggattgtttggtgagatgtaaacttgatccttcgggtagtaatttgtttagtaaaaatttcctgctagacatgagggctctgtagtcaatgaagattatggaaggttaactattggttgaggtaccatggaccaccttgtgatatacagactggtttgagctggaaggcatgatgagaaaactgctgtgttttaactagcatgttctgaaaaaagtgtcagaacatctttcaatgggtgtaaattgccttcactgagcaaggcaaatggttagtattgaacagaaaatgtcagataataaattcattcattttcttcgaatcctgaatatatacacttggattattagcttgtgcgtgtgaagccactctggcttcatttttatttcatattatgacagctaaaatctttgtgaagattaaaaatatggaggaaacagacaggtttttaatatttacatcttagaaagatgaagactttaggtgggtatagggagaaacattcaatactttggattcttttttattggtagagtgagtgctaagaaaagggatagaccaattttttttctctctttctctccttttcctttacgtaaacataaaatgcttccaattcactggattttcttctatgcttccaatatcattgcattttcttctttcctttttctttgttctttctgaaaacaccttgcttttggtggtttagttgccagccactgggctccaccttgccctcaagcctttcatgacccaggtgctgggtccagtgaatgaacttttggttgcttttgccatctttgtaccagacataatacttttttgatgtgcaactggtgcaggcaagggaagatgaagggggaagtctcaggcaggagttagagatgttttataatgattggccgtcttctgctattagagcacagaattatggctcctaaaaaaagacttggcttttctgatgatccccactgcatttaatggactagttctgcaagtatttacattgtttgatgtactttatctttcctttttaccatcagttgagttggaaagatttgaggacacatacagaaagagtgattttagattcttttctgataccatttggactcagaagtaggagaatttgtgccttattgtgtctttttcttttgctttttgatgagaaggagcagggaagtaaaaatctcaagagagcagaatcagttttccggtcaccaagctcattaagttaatatttacttttaaaatgaatgtatttgccagcccttcccactgtttgtttgggaagcatttaacatacatttgagagcctctaacttgtttccacctccattgggtatttcacttctcagactggtggcggtgagtgtgatgcgtggatcccagttgtaacatctgtttctgtcacttcaatattacgtttatcttgagggtaaaggaagggaaagaaatgaagctaaggcaatttttccctgtttttctgtgtctactgcacaatattgattgaatgatatttaacatctctagtgcttttaagcccatttcaaataacacaattgacacatatgtaggggtttaaggaaactggacatttaaataaaagatacagcctgaaaactcaaagattacatttgaaaatctctttccagtgttccataaaatgatatttacagtttttttgtctcttgatacctgcaactttctagatgaaagctgttatttttctttaggcctcagatgagtattttttcactattaaaaattttaatgaacataaaatactgattattttaacttctataaatatttaataaccaaggtcttcaggtacattgtatcgtaatttctgttggttttttaaagcttgctgtgtgagagaactgaccgttatgtttaattatttgaaggctgttttggggaatgtaaaaattgatactgaaggaaaaaaagaactgggtgcggtggctcacacctgtaatcccagcattttgggaggacgaggtgggcgcattgcttgaggccaggagtttgaaatcagcctggccaacatggcaaaaccctgtctctactaaaaaatacaaaagttagctggtgtggtggcccaagcccgtagtcccagctacttgggaggctgaggcaggagaatcgcttgaacccaggaggcagaggttgtagtgagccgagattgtgaccctgtactccagcctgggtgacagagcaagactctcgaaacaacaacaacaaaaacaaatacagagagatatgactctttattcatgatctagttgacatccccttgctgttacaagtatgtatattaaatgtttctgtaatacatgtcctacaagatgatgtatcaatgtatagtatttttgtctagttggcaacctgagaaatatttatgagctttcagtgggacatctaccacttcaaggatcagcaaggcacagacaagccacaggaattattaactcaacaaattattaacttatcaaattaattatctaattattaactcagttgactgggctgggtatttttctttgagatttcttttatttttggtggatcgattgattggcactggcatgtcaggggcaatgacaatgctgtctctagctgaaactctgtgctctccagacggcggtgagtgacgcttctccacctgaacaacctcagaatctgggtgtgagtggaaagtgcaagagcgctggaatctccttcacccatcttccagcttgtccccgtatccctatttataatctgtgtgaggccatctagtagtctccttttccttatctgtacaacagaggtaaccctctccacctggcaaagttgtaagaattaatgaaataatgcttgtaattcctgtaaagggtcttggcacggagcaggcaccaccgtttcatagagctgggctgtgcctctcaaagcattggcacatgcagtgtggtgctgcacgtgacatttgggccatcctccacatgagtcctcacatctgtgggcacaagctgaggggcacatggagactcctggctttatgatgggaacaccagcagtctaattttaggaacctccacattttaaagagggggaaactgagtctgtaaagtccaaatttaggcttcctccttttgttgccccacttctgcccatcacagtggccttgctatgaccacgtgttactggatctggcagaaaaggaatgtccactggtggggtttgtatgccaggtggtttttggtggatgggagtttgcatcccacaagacagtcaggagctctgcatatgtgagcactactaactcatgttttagaaggaaacagcgttcacatatgtcacatctacagtgtgcatctggtcacaggatttccagaggtctatgatgattaccccagatacagagggagggaaaatctccctgtacctcctcgtttttgggttggtgcctcgccagaggttttctgattcttcttggttccctttcttgtttgcctgcatttgtactggctcatgtttattgtctggcaggggaagcccctttgtctctactccatgtgtcttgtgttcatgtgttgagtaactggggcattttctccattgtagacatcacagtcttgggacctgttgtttgagcagatgttcacatccttaaaatactctcttccccctgcaagactgtgtaaggttcctgagggcagagacagcatttctacctctctctgaatctcattctttcagaacagtcctttgcacctagtaggtgctgaataaaagttgcttgagagaataaacagataatacttttggagtcttttaggtgaatttgttcccataattcagactttttttccttccttccttccttccttccttccttccttccttccttccttccttccttcctgccttcctgccttcctgccttccttccttccttcctttgccacaggaattcaccaactgtttattcatggggatgggatttatcttaaatgttttttctgtatggaccttatttaattttcccagtaatgttggcactattatttctatttttacagatggggaaacggaagtttagagaagttaagcaactagcacagggtcacagggctagtgaagctccagaagtggaggtgacccagacacggccctcacgccagtttaagtagcagctggagagacctgctggattgttggcctttgaaagggaacattgaaagttgcttgcatttgatgatgattgggttacatttacttgaattgtgtaacttttaagttgcaaattaatgctaaaagtgtattagggtagccttaggctgtgggactaattgagaaacgaagtacaatggaagtgctgcaagcaaatggattttcctgcttagagcaggtatttactattaatcctgtggcatttgccttaaggagttggagtctttcttagctaattaaaaagtaccggtcagatgttgagtgttgtcaataatttagtgcctgcatctttttatccctgttgtttggaaactacaatttggaatattctgtgcacatttaaaaaaataaatgactgtctgtgtggtaatgtttttgcttagtaaatgtatgcattatcatcttgagcttatgagttttctgtacttttcttgaaacttttattagtagaaaaactgtcaatctaacgcggtgatctttctctgaagtcctcagcatgcaattgggcataaaagttgtgatccctgagcacatgttttggggttaatcctattcatatttttggttttcttcttcattcccaagatatataaaaattaaaagcatttgagattgcacattagtgcattggatttttatctggggtggtcccttctctaagtgggtagtgggagtgtggaagggtgaagcaatatctactaaccttatttgtgatttgggagctagattatcctttttccaaaacatcctaagcgaagactaccctgactgtgtttttactgaaagctcttcctgtcattctgggtagtttatactgtttatttaccttgtataaggaaattctttctttactgtcccatcttatctcagatcaaagtttccacccagggatcctacttaaaaaatattgtctgagactgcatgtgttttctttctttttttttctttttttttttttttagcactctgagtttttgctccatctgcactctctggttttccgtccttctatttatgacaattgtgtaatgaatattcatagtttccattattaatgtaatagcatgccatttgtcagctcactggctttctcgtattatatatatatttttaaaaattctttttatttattttaaaatttttgttgtctttgtcttccgtaatcttttttctttatagagtttgtgatcatgtgtttttcctctaacccagacatatacgtaggtctaaaactgcacagtgcaggatgtcaaatggcttaaaaggatttctgctgtgactgaaagagtggatctgtgcccttctgggggtgtaggctgaccacatgaataccaataattagacatcttttattttaagaaatgggcagctgtttctttagttgaattttgatatctttatagttactttgctttctttaaagggcttttctctgtatatatgcatctctttggcagggttgatggcagactgggatactggcatggcaatagtgggaaagaaggaaggaaaaaaagcacaactgaaaaggaaaacctgaagtgttctgaatattagattttaaggtattagttgtttttttaagttttctttttcaatttattaaaaagtagaatatgtaagtattgtgaatatcaggttttttttcagtgattttaaggtaaaattttcaccgtctcacacttgatcagaaagtctagcaattaactttccccttgagcatcctgagccatccctcagaggtttgattaggatggcagttacagtggtgataatgccttcctggagttttcaagccttttatttaaatcagtgcttattatctctcactgttgttttaaaacacagctcctgaacctgaaagtccagtgaagatttcatctggaaggttgggttactgggtgtgtgggattagaggcacagactgctgtcttcctctttgtcatcatcagaagccctgaaaccccttttcatgcttgctaagattaggcaggagtgtcattgcatatttataatacatattttgtagggcttcatagtttacaaaacaatttcatatgatatttcagtgaatttttgcaacaaaacagccctgtgaaggagtggacatgtagtttcatctctgttttgtagaggtggaaattgtactcagggaaggtaagtgctgttccccaggccacagtcttctgttctcacagtggagctttgtctgggacccaggtttcctgccctctcaccctcacccccttattctgcttctcctgaaaaggtcaggatttaaagacattgcattcagcatcagattaggggaggtatgtgacctagaaaccctagcaatgtggatttcgaaaaggtagttatttcttctatttcataacattaatgacaaataatgagtcactttctaattttctattcagacaaacgcattttgttctctatattctgtgtttctgtgttctagatttatggacctgaatgcttaagtttacatagcagtgagaaacataaatcctattttgtattctttaggtacctcaagagccaacagctcaaactgtggaggcagtactggcagtttggctaagaggaaagagagagaagtggctagcaaccatcccctgagaataggagaaaatgagatatttctgacagtattacaaactggagcagaggtttggtgataacaggaagctgcttatgagaaggatttagcattagatatggatttgaaactctgctccaccacttagtagctttgttaccatgaacagacagttgcttaatctccctgagcttcagcgtcctcatctgcgagtgaaggctgtgaggcagtctcatatattatagggcgataagtcaggatgctggaaccagctgcttggtgtcataaacctgtagtcagtcatatccaggctccaacactccttggctatgtgaagcttaacatctcgatgcctcagcttcctcatctcgaacaggaggatgctaataatacttagctcatagagttgataggatcacaacagtttcaaaacgtgtaaaacacttaaaacggcgaatggctcatagtaaattctctactaaaagttaattgtgtctgggcacagtggctcataatctcagtgcttcgggagatcaaggaaggaggactgcttgagacaagcctgggcaatataacaagaccccagttctaaaaaataaaaaaaaacctggccaggcgtggtgacacatgcccattgtcctagctactcagaaggctgaggcagtgggatggcttgagtccaggagtgcaaggccgaagtgagctgcaatggcttcactgccctccagcctgggcaacatagcgagactctgtctttaaaaaaggttatttttaagtggaataagttacggtagtacctgccatgtacattaagctttcagttggttagtttcttcctctcctatttagatgttttgaagttaagcctaatgaaagcaattcaaaaaccactaaaatacatttattttaatatttgcatcacatttaatttgtgtaattattgatctcttataccttggacattcattttttaaatgtagtattttaaatgtaatatttttgcactattaatcacttaaaatattgtgttatatcatgtctaggaaattcattataggcctttctaagagagaaggctttgtgataaaagccagctgcccagacatttccaaaccctcctcacccatcccccagcatgctacagaagcagcaggctggcagaggtccagatttcctaagtgatgggattgttcccccggccaggaatgagaggaatctgcctagattggagatggctttagctactttgcttttcttcgtactcgtagtcttattcccaaactgaatctgacccagcaccattttccattattggagatgttttaacactgtgtgtggaggtcttgctatttaaacaatgatttctgaatctactttttaattccatgggagcttttccatttttctttgtactatggaagaagaactatgagttaattttaatttatagttatacctctgcaaatcaatacaatctttctgtgacttccactggtagcaccattcttgatctgaggcgagtattgggattgtggttttactttcccatttacttagaggcgggaaggtttagttatttgaatgccttagaccaggaaattattggctattgtcagtggaatttgtttatcttttccacccctacattcctaggctgtgagagaactggtcatcactgtgattgcacctcagtttttatcagttcctcccccagcgctatttttattaaatacttgatgtttctctcttctttgggtataaatttagagaccctcaggcagacatttctgaaagggctctcttactcagctgttgttaaaatgaagagatcaatactgccaagcacctctttttgtttggctacctccaaaattcatgttttctgcagttattctctaggattatctgtgattatctgtaatttctataatttatctatagattataatctaaactgaagattgatgcatgtataattctaatgagcttctcgaccagcactgttcaatagatacataatgcaaatttcatgtcattaacatttttcttgtagttacgttaaaaacgtaaaagaagccaggtgttgtggctcaggcctataatcctaggtctttcagaggctaaggtgggaggatggcttgagcccaggagttggagaccagcctgggcaatatagtgaaacctcatctctacaaaaaaataaaattagccaggtgtgatgtgtgtctgtcatgtagtcctagctgctccacaggttgaggtgggacgatcacttgagcccagagtttgaggctgcagtgagctctgattgcaccatcgcactccagtctcggtgatagaatgagaccctgtctcaaaaaacaaaacaaaacaaaaacagcaaaaaacaaaaacaaaaacaaaacaaaaaaagaaaagtaaaagaaacagataactttacttttattatacttgaaaaaccccatatataaaaatataatttggacattaaagttattattgagatttttactcttattttgtattgctttaaaaatctgcttgtgtactttattatacatctcaatttagactagccacatttcaggtgctcattagccacatgtggctagtggctactattggtcagcacagattttttttttttgacagggtctccttttttgtccaggttggggtgcagtggtgcaatcatggctcactgtagtgtcaccctcccaagctcaagtgattttcccacctcagcctcccaagtagctgtgattacaggcgcatgccaccacacctggctaagttttaaaaattttttgtagagacagaggtctgactgtgttgcccaggctggactcaaactcctgggctcaagcaatcctcgtgttttggcctcccaaactgctgggattacaggcatgagccactgtgcccagctagcacagatctttactgtaacttttcttcttactataaaaagcattgcgttatactggcaattattttcccatcaaagtggcctagaaaagagacatgaatctggcctcatgtctttgctcataattaacacatttctagagagatttcctttgttagaaaaactaattgtgggattaatgatctcagaacgtgaattcaactgtagcacctaaacaggtgctactgaagtcacctaaacagcaggctgaattcttgaccaatagtgataaaaactgctttgtcttatggtaggagtagcagtcaggacaagactcagcatttagcgaaatccctggagggattctcccacataggagccgtgcaactcagttttatgctcctaaaatctactgcaaagctgtgaatgctttttgtttgtgatttgcacttcatttttttcttctcaattattattattttttgagacagggtcttgctctactagtccagagtacaagtggtgcaatcatggctcactacggccttgacctcccagggtcaagtgatcctcccacttcggcctcccaagtagttgggaccacaggtgtgtgccactatgcatggcaatttttatttttatttttgtagagacggggttctgctgtgttgcccaagttggtcttgaactcctggactcaagtaatctacctgccttagcctcccaaagtgttgggattacaggcgtgagccaccgtgcctggccagaaaggtgattttttaggattctagcttgtttgctttccttcccaccccaagataacttttgttatagcagcttgcctgctttctgtttcatttttcaccctgatttttccaggactcctcaatcacttccaagtgttaaaggccattactgattcttaaatgtagatggctatggctgaatttcagccattgagggtccatatgatctattctgccacagtccttctcaaacttcagtgtggatgtgaatcacctggggatcttgttaagatgaaatttgggccaggcatagtggctcatgcctgtaattccagtgattggggaggctgatgtaggaggatcagtagaggccaggagtttgagaccagcctaggcaacatagtgagataccttgtctctaaaaatatatatatatttaaaaaacaacttagacaggcatggggttgcgtgcctgtagtcccagttactcaggagactcaaggcgggaggatcatttgagtccagatgttgcaggctgcagtgagttatgatcacacccaccactgcactccagccttggcgacagagtgagaccctgacccttaagaagagagagagacagagagagagagagtgagactgatttgatgcagtaggtctgagatgaaagtttgcatttttcacagactctcaggtaatgttgatgactctggtccagagaccacgtagagatctagtatatgatagcaaaatgctgctgtcttataccagcctgcagcaaagacattaaaaaaaatgtagtgaggttttccaccaagctaaaagtacttttttgttttatatatatttttttaaattcagagatgatttcattactgcctcttgctactacggcaattacaaatgatagttattattaatatttttaaatgacctttcatggcaaaattatacagctgccaaccctacttatgtctccaagttaataaaagaattttagtagttcacaaactcctcaagtctgatgccaccccaccatctaaattagcagtttatagctttccttcatggcatttatagtattttgtattgacataattacttggacagttgtttaatgtcactttccccactgtgctctaagctcttgctctgtatttttaatcactttgtccctagtgtctcactagcactgggtctggtgtctgtctgtccctagtcaatacttttaggatgcctttattcagtgggtctcagtaggagtggtactgccctctaatggagtgttttggaaattgatgggaactactggttgtcccaaataatgaagtgtgctactggtgtttggtgggcaggggttaaagggtgccagacattctgtagtgtacagaacagctaactaagtgaatgcttatttgatgccttttgcaaaatctttgaatgtccatgttggagattcaattgatgaaaaacctatttgtaattacctaaaccaaaaacctaacttggctgggtgcggtggctcacacctgtaatctcagtcctttgggaggccgaggtgggtggatcacttgaggccgggagttggagaccagcctgaccaacatggtgaaaccccatttctattaaaaatacaaaaattagccaggcgtggtggcgtgcgcctgtaatcacatctgcttgggaagctgaggcacaagaatcacttaagcctgggaggcagaggttgcagtgagccaagatagcggccaagatagtgctactgcactccagcctgggcaacagaacgagacactgtctcaaacaaaacaaaacaaaacaaaacaaaacaaaacaaaacaaaacaaaacaccacacacaaaaccacaaaaaacaaaacaaaaacccaactccatttaacatttaaagacaactatatttatgtatgtccagttttaatacacatacagtcatgcatcactaatgatgggggcacattctgagaaatgtgtcatgaggcagcttttttgttgtacagacatcatagagtatatttacacacacctagatggtatagcctattgcacacctaagctatatggtatagcctattgttcctgggctgcctgtatagtatgttactgtaggtagttgtaacacaatggtaagtacttgtgtatctaaacataggaaaggtatagttaaaatatgataatataatcttatgggaccagaattatatatgaagtttttgttgactgaaatgtcattatgcaacacatgactgtattctgaaattttcagaaatgcagctgctgagtacttcaaaagttgtactttgacttattagcaacattacaaagtaacgtctaccattctggcaaatcccatccttagtagcagtgatgtttgtggtatttgaattattatgtatataactgcactaatacacgtttgtaggaaatatgatggttatgtatatgtgtgtgtgtacatacaaatttagcccttattctaaattatccaataaaaattgttgagaatattcaggtgaattttttttacttttttaaaatccaaatttacccattaaaagtggttgcaagcatctcactacatcattaaatcatttggtggtgttatctctgagtatttacatcttggggtgtgtatgtgtgtgtgtgtgtgtgtgtgtgtgtgtacctaaatcacacatatgaaagacaataaaagttaatctcttttattttctttttatattacattttggactttatgttgtttttctttctctgcatgcataccatctctgtatattacaaacacttactatcaaaaggtggtggtactctgataggattcagaaccccccttctcatggaagcagcatggaatcaaggatttctgccttctggtcttggtttatttctctaagctgctcacataacttttctgaatttgttgggtgatctacattatcactgataaggtaagtcatgatgtgataagtcacagcagatgtttcatgaatgactggacatgtagaaaatgccttgcttacatggtgactcttagccagggctcctcagaaaggcagactgtccacctgagacccaccgttctgcttcacttgcattttcatttagggagagcagaccaccttggaggaagggatttggctaatgataaggtatgaggtagagtggggaagtatggtagtggtggggtagtattaatgagtgaataaaagcagagtatgttttacctttctgggaagcagttaagatccttagactaggggccactattgtaaggattttttgacagttccatgtttatctgtttcttagtgattaacaaccaaacccatgaagacttatagactggggagacttttgtgtcttgttcagcagttggtttggagtggaccacaaagctcagaggcaaaagagtagtgcacagtgtacacagttggtactaagaaaggccctcggggactgggttacgaggtttcgcagcagaaagtcccttcaagcacatgattttagtctgcctagatctggctagaatgttgctcattaattggagctagaaagatacaggaagctcaagggtaaatggcactggaaaaaggtcactgaaggtgaatccatttaagatgaagatcaaggaactagtgcatggctgccatgttgcagcaggacagtaatgatgacactgaaggtgtttcacccttcaatgcagaagagaagacaacttagtagaccaaaaatgcttctcagaataggggattaaaaacaatagaccaaaaaaaaattagacacccaatagcgtaatttttctgtttactcttttgagtgcatgcagttataatccatcttctctgtgaattgctcagcagcagctatactgcgtggatggtgacagttctcttgttgccatgtgatttgggggcagtgaagactgtcacaggtagactgatggtggacctgcattggtggaatcatactgatgaagatgagaagaaccactgggtgtccaggaagagccactgggagtccaggaaggcatcccctcaagataacaaaactgtctcagaggctgaatcaaggatcttttggttgggatttattgcctgttcagtgctgtgggtggtaattgcctttagtgccctcttcttttttggagtaaagtgattggcagtggttatcatgggtgtggcgctgcaagatgccaacctatatggttacatcaggtataaagttggcagtagaaggaatttaaccagcatggctatcttgtagcctggaaagcagtttttaagacaaaacagtaaagataatctgacttccagactagagagaatgctcttatatcttttattatactggggaatgaagacatttttgacaccgaaccttttagtgcccagtccatgttgtaatgaggagtgttggctctatttttccacttaaaagctttacttgttttaaaaaaggaaaattagtttttatactttttattttctttccagtagttggggctagaaaatatgttgtcactagaaacattgtgaaaatttgtcttacaggctgggcacggtggctcacacctgtaatcccagacctttgggaagccgaggtgggcggatcacctgaggtcaggaattcgagaccagcctggccaacatgacgaaaccccatctctactaaaaatacagaaattagctgggtgtggtggcacatgcctgtagtctgtagtctcagccactcgggagactgaggcaggagaattgcttgaatctgggaggtggaggttgcagtaagccgagactgtgctactacgctccagcctgggcgacaaagcgagattctgtctcaaaaaaaaaaaaaaattgttttgcagtgtacataggtatgcacatagtcatataatatcaatatgtcccaaattaatgaaaatgtgttcatttacgtaagtatggagacttttgcattttgattcatagaacatgagaggatgttagtctgtctcaaaactctgtatgtttacatattatttatgttgactattttcagaagtaaattttgcttccatgataaaagtgagcattttggcttatgcgtaagttagaaataattattaatttttaatatgtacctcatggtaaaatttcttagatatatgcaaacaattaaaaaccaaatttgggtcagtggtgttaactagtttctgaaattttgtttatttttatttgtaacaattcattgacttaaggcccaattaatacaaatggaatcaccatagtttatgtttaaggaatacacagagattgctactgttccatttattttacggtaaggatagacaaattttaccttggagcttcctacaagctgttcagtgttccttgagcgaataaaatctatcttttgtctctaaaagagcattattcatatgtcataatgacagtaatcatttaaatacttggcataataaatgcctaaaagacattttattttataaatctttttttttctttctatgatgggtatattgtaaatcatgcatttgtattaatggtatttcttaaagcagtagatgtaactgtaaactaaatcagtctacaaactattctaggcacccatagattctgttgtaggtactgtaaactttgttggagactttagtcggcagattatgttgtgaatatatttgtactttgttaaaatattttaaaagatgtttaattgaatacgtgtcttttttggactagtagctgtgaaggtataaaactttatatttgtataaaattgctgtttatagagcaaaagaaaatgaagatcaaaaatttatggttaatatgcatagaaagtttgattagaattgagtctttttgtttcttttatgattttcttttttttaattattattatactttaagttttagggtacatgtgcacaatgtgcaggttagttacatatgtataaatgtgccatgttggggtgctgcacccattaactcatcatttagcattaggtatatctcctaatgctgtccctcccccctccccccaccccacagcagtccccagagtgtgatgttccccttcctgtgtccatgtgttctcattgttcaattcccatctatgagtgagaacatgcagtgtttggttttttgtccttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcagtaaacatacgtgtgcatgtgtctttatagcagcacgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttgtccacatcctctccagcacctgttgtttcctgactttttaatgattgccattctaactggtgtgagatggtatctcattgtggttttgatttgcatctctctgatggccagtgatgatgagcattttttcatgtgtcttttggctgcataaatgtcttcttttgagaagtgtctgttcatgtcctttgcccactttttgatggggttgtttgtttttttcttgtaaatgtgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacacgaagtccttgcccatgcctatgtcctgactggtaatgcctaggttttcttctagggtttttatggtttgaggtctaacatgtaagtctttaatccatcttgaattaatttttgtataaggtgtaaggaagggatccagtttcagctttctacagatggctagccagttttcccaacaccatttattaaatagggaatcctttccccattgcttgtttttctcaggtctgtcaaagatcagatagttgtagatatgtggtgttatttctgagggctctgttctgttccattgatctatatctctgttttggtaccagtaccatgctgttttggttactgtagccttgtagtatagtttgaagtcaggtattgtgatgcctccagctttgttcttttgtcttaggattgacttggcaatgcgggctcttttttggttccatatgaactttaaagtagttttttccaattctgtgaagaaagtcattggtagcttgatggggatggcattgaatctataaattaccttgggcagtatggccgttttcacgatattgattcttcctatccatgagcatggaatattcttccatttgtttgtatcctcttttatttcattgagcagtggtttgtagttctccttgaagaggtccttcacgtcccttgtaagttggattcctagatattttattctctttgaagcaattgtgaatgggagttcactcatgatttggctctctgtttgtctgttactgatgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatacactttatttccttctcctgcctaattgccctggccagaacttccaacactatgttgaataggagtggtgagagagggcatccctgtcttgtgccagttttcaaatggaatggttccagtttttgcccattcagtatgatattggctgtgggtttgtcatagatagctcttattattttgaaatacgtcccatcaatacctgatttattgagagtttttagcatgaaggttattgaattttgtcaaaggccttttcggcatctattgagataatcatgtgatttttgtcattggttctgtttatatactggattacatttattgatttgcatatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtatctctgcccagctttggtatcaggatgatgctggcctcataaaatgagttagggaggattccctctttttctgttgattggaatagtttcagaaggaatggtaccagttcctccttgtacctgtggtggaattcagctatgaatccatctggtcctggactctttttggttggtaagctattgattattgccgcaattttggatcctgttattagtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagccttgctagcggtctatcaattttgttgatcctttcaaaaaaccagcttctggattcattaattttttaaagggttttcttggtctctatttccttcagttctgctctgattttagttatttcttgccttctgctagcttttgaatgtgtttgctcttgcttttctagttgttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcgttatgtaccctgtagtcattcaggagcaggttgttcagtttccatgtagttgagcggttttgagtgagtttcttaatcctgagttctagtttgattgcactgtggtctgagagatagtttgttataatttctgttcttttacatttgctgaggagtgctttacttccaagtatgtggtcaattttggaataggtgtggtgtggtgctgcaaaaaatgtatattctgttgatttggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcctaaggacttgctttatgaatctgggtgctcctgtattgggtgcatatatatttaggatagttagctgctcttgttgaattgatccgtttaccattatgtaatggccttctttgtctcttttgatctttgttggtttaaagtctgttttatcagagactaggattgcaacccctgcctttttttgttttccatttgcttggtagatcttcatccttttattttgagcctatgtgtgtctctgaacgtgagatgggtttcctgaatacaacacactgatgggtctggactctgtatccaatttgccagtctgtgtcttttaattggagcatttagtccatttacatttaaagttaatattgttatgtgtgaatttgatcctgccattatgatgttagctggttattttgctcgttagttgatgcagtttcttcctagtcctgatggtctttacattttggcatgattttgcagcagctggtactggttgtgcctttccatgttttgtgcttccttcgggagctcttttagggtaggcctggtggtgacaaaatctctcatcatttgcttgtctgtaaagtattttatttcttcttcacttatgaaggttagtttggctggatatgaaattctgggttgaaaatttttttctttaagaatgttgaatattggcccccactctcttctggcttttagagtttctgccgagagatccgctgttagtctgatgggcttccctttgtgggtaacctgacctttgtctctggctgcccttaacattttttccttcatttcaacttttgtgaatctgacaattatgtgtcttggagttgctcttctccaggagtatctttgtggcgttctctgtatttcctgaatctgaacgttggcctgccttgctagattggggaagttctcctggataatatcctgcagagtgttttccaacttggttatattctcctcgtcactttcaggtacaccaatcagacgtagatttggtcttttcacataatcccatatttcttggaggctttgttcgtttctttttattcttttttctctaaacttcccttctcgcttcatttcattcatttcatcttccatcactggtaccctttcttccagttgatcgcatcggctcctgaggcttctgcattcttcacgtagttctcgagccttggctttcaggtccatcagctcctttaagcacttctctgtattggttattctagttatacattcatctaaatttttttcaaagttttcaacttctttgcctttggtttgaatttcctcctgtagctcggagtaatttgatcgtctgaagccttcttctctcaactcgtcaaagtcattctccttccagctttgatctgttgctggtgaggaactgcgttcctttggaggaggagaggtgctctgcttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagtggtgtctgcagaaccgcagattttcgtgttacatgaatgctgctgtctgatcgttcctctggaagttttgtctcagaggagtacctggccgtgtgaggtgtcagtctgtacctactggggtgtgcctcccagttaggctgctcgggggtcaggggtcagggacccacttgaggaggcagtctgcccgttctcagatctccagctgcgtgctgggagaaccactgctctcctcaaagctgtcagacagggacagaggttactgctgtctttttgtttgtctgtgccctgcccccagaggtggagcctacagaggcaggcaggcctccttgagctgtgttgggctccacccagttcgagcttcccggctgctttgtttacctaagcaagcctgggcaatggcgggcgcccctcccccagcctggctgctaccttgcagtttgatctcagactgctgtgctagcaatcggcgagactccgtgggcgtaggaccctccgagccaggtgcgggatatagtctcctgatgcgccggtttttaagcccgtaggaaaagcgcagtattcgggtgggagaggcctgattttccacgtgctgtctgtcacccctttccttgaccaggaaagggaactccctgaccccttgtgcttcccgagtgaggcagtgcctcgccctgcttcagctggcgcacggtgcgctgcacccactgtcctgtgcccactgtctggcactccctattgatatgaacccggtacctcagatggaaatgcagaaatcacccgtcttctgcgtggctcacgctgggagctgtagaccggagctgttcctattcggccatcttggctcctccctctcttccttatgtttaataactatcacagtaaacacgctttttgtttaatattaataatgataattaatctagaagaaaaatattaaagcctagagttttgtggtcacaggaaatcatagccatttaaaaattttaaagtatgtatgaaattttatgatgcagagaaatatgatggagtatttgtaagtcggtaaaagactttaagcataaatgtatttatttcattaggttgaaatttggatggagaggaggaatgaaatatggtttcaaagaggaaagcatacaatgtaaattttaaaagtcttgttaatgtatgttttatatggattatggtgggaataaaatatgatatttaggtttctctggatacatttaaaagaataatattaagaaagtgaaaagataggcctctgtggtttgatctgtgagatcatcagagtgttctaaagttgattttgtggctgtttggcacaactctaaaaaaccattgaaagcctctgtggcttatcttttcactttcttaatattattcttttaaatgtatccagagaaataaaaattttacaaatcacatacctgataagggactggtatcccagaatatataaagaactcttacaactcaataataaaagacaacccaattaaaattcttggcaaaggatctgaacagatgtttcttcaaagaggatatacacatggccaataaacatatgaaaaggtgttgaactttattagccatcagggaaattcaaatcaaaaccatcacgagctaccacttcacagggaaattaaaatcaaaataatgatgagctatctaggatggcctgaagaaaaaaacaaaaacaaaaacaggtaattgcaaatgttggtgaggatgtgaataattggaactctcataccctgggactgcaaaatgattcacctgctttggaaaacagtctgtagttcctcaaatagttaaacatagaattatgacatgatccagtaattccactccaaagtatatacccgagagaaatgaaaacgtgtcgacacagaaacttttgcaccaaaggacagagcagcattgttcataatagccaaaatgtgggaacaatcccaatgtccatcatctgatgaatggataaagtgcagcatatctatataatgaaatgttattcattaatagacagaaatgaagtactgatagatgctgcaacatgagtgaactttgataacattatgttaagtgaaagaagctagtcacaaaggaccacatattgtatgattctgtttatatgaaatgtccaaaataggtaaatctatagagacagaaagtagattaatggttgcttagggccgaggtggaagtagtggtggggaggagatgatggggtggggtgggggattgacagctgtggctctctttgagatcatcaaagtggattttgttgagatcatcaaaatggattttgttgatgtttggcacaactctgtaaatatactaaaaaccatttttattagttcattttcacactgctgatgaagatataccctagactgggcaatttacaaaagaaaaaggtttaatggacttacagttccacgtggctggggaggcctcacaatcatggcagaaggtgaaaggcacatctcacatggtggcagacaagagagagagcttgtgcaggaaaactcccatttttaaaaccatcagatcttgtgagacttactcactatcatgagaacagcaagggaaaaacctgcctccctgattcagttatctcccactggctccctcccacaacacatgggaattatgggagctacaagatgagatttgagtggggacgcagagccaaaccatatcaccattgaactgtacacttcaaatgagtgaattgtatagtatgtaattatacctcaagcggtttaaagaaataatgtaatagtttcatttttaagagtctgtgtttacaatatgccagaaatgacatactttgcattctcaaatacacatgtgatgaactgttgcacatatcaccttaaacatttaaaaaaatgcagtcttaaattaccagttttaatggttgcataatatttcagtaagttaatgtgggatactttgctcattttccccctatataagtactttctcatattttgatgttttaaatatgaatttctatacctgctaattttcttcttttgctactttctttggataaaattctgactgacactcagaaaaaatgaatagatagcaagagtttttttttaattaaatttttatttttttattttttatagagacagggtttcgccatgttggccaggctgatatcaaactcctggcctcaagtgatctgcctgccttggcctcccaaagtgctgggattacaggcctgagccactgtgcctagcatgaattgggattgctgagatttcttgcataggtattgccatgttactttctgaagggttgaaccaatttttctcatttacattttttttttactgttaactatataatttgttccacagtaaacgtttaaaggtgtatttctttgagtatcaaagtaaattattgttaaacctccatttgtttcctattactgccttgagagtgatgaaagttatttattaaatgaactcatactgaatacccactctgtgtcaaaacttgtaccagatactggagactggagatgcaaagtgagaaaggcttagtttcgcactcagaaaagttccacatctcgtggggaaataattacagtaggtaacatgaaggcgtcaagtatgaaaaggtgtttgaggaggcacctggaggttgtggccagcataggaggggaggtgatatgtatgtacagctcaaaagatgagcagacctttgcctggaggcaagatgaggacaaagagagggcattcctggtgcaattacacacacagcctccaaacacagtgatctgggcaagcagttcccacaggttccctttgactgaagagttgtcggcttttttgtgtttctaatttattcattagtacatttggttgttttctttgtttttgataatatgctctgttctttgcattccatacacatattaatagtaatgttaaatgttacttttaagacaaatatttccttttagtctgtcctttgactttttatttttcatcatatttttacattctgggattgtgatgatttgttttgatatacaccatatggaaatttcttaatttataacattatggatttagctggtccagtagtagcaaagccttgtttcttaaggtggttttcccgctaagtatgagaagagttgtaaaatatatgtggggcccttatttctcatgcccaagctctttctgtgtcgaaccgctttataataatacagcgtgacgttaacttgatggctgagttaggaagccagatgacagcttctctttatttactgtcttctcagggtagaatggcttcattcacttgatctgaagagccaagccaacagccctactctgggcctccacaggtctgtggcagcagtaaattgaaaaacctgttcacatctcaacagcctcaaatttttatttttttagcaatatagtagatagtaaggagtgaaacgatataaatcagatggaaagggaattggtatggactgaattgtttctcccttcaaaattcgtatattgaagcgccagtctccaatgtgactgtatttatggataaggcctttatggaagtagttaaaattaaatgagatcataagagtagggccctgatctaattgggttaatgtccttatgttgaagagataacagagaactctctctccctctactccgtgtgagtatacagcaggaaggcagacatctgcaagctaggaaaagggtcctgaccaggaaccaaaccctgctggaccttgatcttggactttccagtccccaaaactaagaaaatcagtttcggttgtttaagtcaaccagtccatggtattttattattgcagcctgagcagacgaaaacagtcataatgataataaccaaaacaattatttattacctaacatatatccattttggattcccttaaagccaagtatgagttaagtcatatctttatctccgttttcctgatgggtaatctaatcattaagtaacttccttcaggtctcagtgccgggaaggtgaatctgtggatccttgttgagcttatgtctaatttaggtaacagctctatgtaattcatttatatatttgagaggaaaagagactcaacagcaaccacaagtagactacaaactcctgcacaaatatgtttgggaaactcacatcctcttcttagtggatatgcgtttaatattcaagactctgtgaaatcctacacggaagaaacctgtttaactttactttatcagaatacttctaggggcacctctggtgataccatgggtaacaatgtttcttggacatcagtttgggaagtgcagcccagagtggtcattagattcctgcactcgccaccataggcctattcaatttgaaacatacttaaatgttgatgagcatgcatgcttattacaatttattgaactaaaaaatgtaatgagaatatacatatatgttacttcaagaaattcagtcgaatttagcttttctttttgcataaagattagacaaaaccttaaggtagatggttatgaattttagacatcttaccgctaagaaaagaaagtagatggctctataaaagtaagcttttttattattattttagtgagcaccaaatgtggtagacatttctgtagggcagaaaggatgagagttccagtctcatggaatttacattgtatagagatgtggagattaagggttacatgtgttcttctcaacatgtttatatatgtatatatattttacacattattgtagttggaaggttttttgcacattgtggccttggccactcataaatacatcctcagtttttttcaggtattaatattttgattatggaaacggactttgggcctatgcttggcttacaatgtttcagtccacaaatgaatcttatttttaattattgaatgaatgatttctctttaaataaccttaaaatgatttaaaatctctaaagagacttgttagttttatccttttttttcccccgtaactcaaaagcagttttaaaaaatctacacatttgccaggcttgaattgaaaacatttgagcatctgagtgaaggtgttggtgaagttggttgacggtttttttctttaatctcatgataacatcacttaaataatttataagaaaaatcctgggtattttcctcctttttttttagagatgagatctcactctgtcatcagtcttttaaaagtaggtcctactacatacttgataacacttaaaatgaatgtttttagacagttataatttatttatagttagatgaaccaaacagcctttaacttctgttgctaaagcaagcccacttcaagatacaaaagattttccatctttaacatattggccaaaggagaaaaagagaaaaaagaacgttgaaaatgtgttgtcctacttcattttcccttctgtgtcacacacagtgagaataattaacagccacttagtagatttcttttaagcagatcactgatctgggaagtgctcacttagtctcagaaaggatttggtcagtggagaagaaaatcacaactgacatttatgggtggagtctgtgggcaggagcagccagctttttgacagcagttgtgagctctgggtaactcccaccagttagtgaaattaatgccaacttctttttgtttctttagccttgccactgtttgcctaaacattcaaagaaaggcagtaattccatcatatttcttgattcacaaagcttaagggcaggcaggaggatgttcatcttatggaagcctccggttgttgagttagtgttttgcattaagatggcaagagaaagctgttgttgcttaattagtgagaggcatactgacagtatgaaggacttttttttttttttttaattctgctggaggtgatttttaatggttcagcgtgcatgtgagtattctaagcccaaagccagaccctggttcctttgatggactgcttgcaaattagttgaaaagtagctataacttaagcctttattcttttctcttgttctttttccccattaagctttccccctcacttaaaaaataaaaatataacatatgcatatcaaacaaaagagcataaaataaaaagttttcctcatgctcccaagtctctggttaccctttttagagataactatgaacagcattttaaaaactgcttccagacattttctttgcctatgggtctcttccccaccttgggctccacactagtggagcttttcttcttagcaatgtatattgaagagtgttttatatcagcatgtatatagatccaactcattctgttcataggttgcatgctattcatcgtatggatgtactataatttatttacctgtttttaaaaattggtgaacatttaggttgtttattgggttttattcttacaaacagatgaatggatagttttgttaacaactaaatattgagtcacatatggtaatatacatttaaaattataatactatatatattgccaaaattgcctgatgaactgactcacaccctcatctgaaatgtctgtttttccacctttacccttgttgcattttctgaagcttgcaatctggaacatgaaaatatatgctttactagttattttaaatttacattactttaattattagtgaggctgagcatattttctttttatgtttataagccattaaattattttttcttgtgaactataggctgctttcaacacttagttatacctgatgagaattactgtacaggtttgggaggacatccagagacttgtagaaccgtcttagtgtgttaggaaccttgaagacgatctagtcccaccttccaattggtataaaaaatatttttataacctctgtgactggttctttgattatctgcttaaatgctttcaatattagaacaatcttagggggcctgaccttgcttggctttgcttgctttacaatgtttcagtctataagtgaatcttatttctaattattaaaagaatgatttcactttaagtacgttaaaatgatttaaaatctctaaagagactggttagttttatttttttatctttttttttttcctcctgtaactcaaaagcagttttgagtgaaggtgttggtaaagttgtttggcgagttaaaacttcatgggcaactaattcctcttttggctttagttgacagaaatttcaagatatgttaaaagagtatttgaatagatagggaaggtgggagcagctgaactctttaaataaattgctacattaagccaggtgcagtagctcatgcctgtaatcccaattacttgggaggctgaggctggatgatcacttgagcccaggagttcgaggctgcagtgagctatggttgcaccactgcactccagcctggacaacagagtgagatcctgtattaaaaaaatagataagaaataaatacatgacatttatgaagctagaagattgtttcaggtccagtcaggggatcaggagcaatgcatgtttactgaatcttgtccttttgactaagaatgagagaatttataattgaagagggtcctttgagggtatgttagttatctattgctgcataataaattactcctaaacttcatgccttagtgcctaaacaacaataaacatctgttctctcacagagtttctgtgggttagcaatttgggagcaacctagctgggtggtttaggctctgggtgtcttggaggttgcggtcaagatggcggttggagctgcattcatttgaagacttgactgggccatgtggttctgcttgcacaatgcctcactcacatgactgttggcagaaggttaaggaatgaggttccttgcctcatggacctctctgtagggttgcctgagtgtcttcacattctggtggctggtgttttctagagtgagtaatccaagcaagggcaaaatagaagcccttatgtgttttaagacctcagaagtcacacattgtcatttctgtaatatcctattgcaggtgcagtatccacacaggtcagtcctattggtatgggagggggctacacagaagagtgaatactaggaggcaaggatcagtggggcctttctagggaatgactaccttctggcccctagagattcagatctcacccacctgggaaacaaaacatactcacttctctcagggcccccagacctcatcccagcactgagcccaattctgtggaggagaattggaggatatttaaacagatttggggaagctaggaatctattaagaattttcctttcttggaagaaatgttggatttgggcagtgttttgaataataaaagcatttctttatgccctgtcctatgaaacttctggcccaaataaataggaaatagatttataatcctgacagaggaatggtgttctagtgaaatattccaacttatttttattcagaaaagcttcatagcatttgctagttctcaaatatgagggttaggttcttggaaaacctgagaactgagagttctcagttgagggacttgaaacctaatagggaaaatatggatagcaaactgtgctggctatttaattgtggtttcaacttcaacctctccattttatactttgttttgtgaggctggggttggaactctgtaaattatgcttcccagattcactggatttccagtttgttcctggcagtaggagacactggtggagaactgaaatgcagtagggagagaaaggactttgctgttctcagctcctgtcactatttctcctagagtcagcaacagctctagcctatagtttctttctttctttctttctttctttctttctttctttctttctttctttctttctttctttctttctttctttccttccttccttccttccttccttccttccttccttccttccttccttccttcctttccttccttccttccttccttccttccttctttctttctttctttctttctttccttctttctttctctttccttccttctttccttctttatttctctttctttttttttaattaaagttctagggtacgtgtgcacaacatgcaggtttgttacatagatgtacatgtgccatgttggtttgctgcatccattaactcgtcatttacattaggtatttctcctaatgctctccctccccctgcaccccatcccacaacatgccctggcgagtgatgttccccgccctgtgtccaagtgttctcattgttcacttcccacctgtgagtgagaacatgcagtgtttggttttctgtccttgtggtagtttgctgagaatgatggtttccagcttcatccatgtccctgcaaaggacgtgaactcatccttttttatggctgcatagtattccatggtgtatatgtgccacattttcttaatccagtctatcattgatggacatttgggttggttccaagtctgctattgtgaatagtggtgcggtaaacatacatatgcatgtgtctttatagtagcatgatttataatcctttgggtgtttacccagtaatgagatcactgggtcaaaaggtatttctagttctagatccttgaggaatcaccacactgtcttccacaatggttgaactaatttacactcccaccaacagtgtaaaagtctacttatttctccacagcctctccagcatctgttgtttcctgacattttaatgatcaccattctaactggcgtgagatggtatctcattgtggttttgatttgcatttctctgatgaccagtgatgatgagcattctttcatgtgtctattggctgcataatgtcttcttttgagtagtgtctgttcatgtcctttgcccactttttgacggggtcgtttgtttttttcttgtaaatttgtttaagttctttgtagattctggatattagccctttgtcagatgggtagattgcaaaatttttctcccattctggaggttgccttttcactctgatggtagtttcttttgctgtgcagaagctctttagtttaattagatcccatttgtcaattttggcttttgttgccattgctttggtgttttagtcatgaagtctttgcctaggcctacgtcctgaatggtattgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttatttttgtcaggtttgtcaaagatcaaattgttgtagatgtgtggtgttatttctgaggcctctgttgtgttccattagtctatatatctgttttggtaccactgctatgctgttttgttactgtagccttgtagtatagtttgaagtcaggtattgtgatgcctccagctttgttcttttggcttaggattgtcttggcaatgcgggctcttttttggttccatatgaaatttaaagtagttttttccaattctgtgaagaaagtctttggtagcttgatggggatggcattgaatctataaattaccttgggcagtatggccattttcacaatactgattcttcctatccatgagcatggaatgttcttccatttgtttgtgtcctcttttgtttcattgagcagtggtttgtagttctccttgaagaggtccttcacatcccttgtaagttggattcctaggtattttattctctttgaagcaattgtgaatgggagttcactcatgatttgtctagcctatagtttctttaggaactcactgtgccaactttactatggcccctaaccaagatctaagtggcaattacactgtgtgccccaccccccattcccccagttccacttaaggttctaataccgatccctcctttgagcacccagatgctggtaactccacatctccctttgtgtttcttcacccctaaggttggtttctgcttctagcagttactaatattggggttgcctctgtgacccctttttatttttttaagtctcttaacacctgtataatcagcttcctgtattaaattccttccatttaaaatacataatgtgtgaggcttctgctttccattgagtggaacagttattaaggtttctggatatgtcacccctcacaattacagtgacatgtttgtagttaatttttctttcttgccaggtgacagtcataccaagaggccactgtcttctccatctggtcctttgttcaaatgtttagtgattttttttttcatttttttaatgctcgtagccattgacttcatggatctggcctcttagagcaggcctccaggatcctaattccttagtccgcagtggtcctagacatccaggttatctgggatgttgagtagtttggttcagtctgtttaatacaagtacttattcctatgtattttccaatacaaaggagcatacactgtataattttggctttaccagttcctgcttgcctgagtgcctgctctttgagcctcctttacacacttcccagtggcctccatcctcacagacactgctcaccagtgggcacttgcaggaccagcacttacttcccctcatctttctttatttttcccaagacttttactactgctctgtcatctgctttgtttcccttttctatttccaaaccctaattccctcattttcttattatccccaattggagtgactgatagtttgtgtatattaaaatttgaagtacttgctgagaagggatatctgctgaattacttgaattttacataaggagaacctcctgcatgaggaagcataattatatcaacttatgaatcaaatgaacattttatagaccagaggaaaatagctactgatttaattaatggtacttctgttcttcaggttaataaattcgttacgcctttctacttttattagaggagttactttgtttctttagtaaacatttattgtgttgtcatgtttacacagctctatatcaggtaggtgcattgagggatagcaaaggagtaaaatgactcagctcttgcctgccttgaaagactttgctctgtacttgggatatagaaaagatacattaaatagtgaagggaccaaaataagtgtgagacgatgtgctagaaactgtatttaaatatgtgttgtggggcagataataatggtacttcctgtacacaggcactgagcactttatttatgttgtcttctttaattcttacaattctgaaatagttactctagttagttgtaatttgtaagtgataaacctgaggcttaaaggttaaatcatttgcccaaagacacacatctacaaagtgacggaagttaggatttaaaccttaggttggcctgagtctaatgatcatgatagatagaagtgaaggttgcatacagctgtgtctttgcttgtttgcatgtgtgttttcaaatatgctagatatcttgtatttgctcccctgaatttcttttccatcctgctctgtaccctgggttggctgacctgtgtggattacaccagtgaacactcttgccctttggttctagccaggtttgaccaatgtgaagaactcaggagatctgagggtagactgagaatgatgttgggtgtatataattttggctgtaccagctcctgcctctaagtaccccttgattaggtgtacttatacactgtacacctcccactcccccagccccacttaggcttctagagccaatccctcctttgagcacccagattctggtaactccacaacccccctctgtttcttcagctctaaggctagtagttgcttctaatagttactaatattggaattacctctgtgacccgttttaatttttttcagtctattaacagctatataatcagatttattattcccctagctcttctccattagattcgcacctgttggctccatctctctgtgtctccttctatcctttcccatttttcctcctttctctggatcctaggaaccactccttgacctttccagcaccgagaggggtaaccattccttgtcatgaacactaaccctgatcatgactttaaaagttgtcccttgatcaaactccatttgaatgcatcatgcccaatttgagtgttttatggatttcctgctgaggcagattggtatgcagaaattcttttatttatttatttatttttattatactttaagttctagggtacatgtgcacaatgtgcaggtttgttacatatgtatacatgtgccatgttggtgtgctgcacccattaactcgtcatttacattaggtatatctcctaatgctatccctccttctccccccacctgatgacaggccccagtgtgtgatgttccccaccctgtgtccaagtgttctcattgttcaattcccacctatgagtgagaacaggtggtgtttggttttctgtccttgcgatagtttgctgagaatgatggtttcacacttcatccatgtccctacaaaggacatgaactcatcattttttatggctgcataggattctatggtgtgtatgtgccacattttcttaattcagtctgtcattgttggacatttgggttggttccaagtctttgctgttgtgaatagttggtatgcagaaattcttgtaaggcatgccttcctttcttcttccctttcccactcctgtcctttcttagtatgttcaaccttgaggataagaaatagctaaagcatggtccctaccctgaggaatttataataaaggttaacatttaattaataataatggaaatgaaaactagtaatgtacttgagaagcagagtgacagagagagaatctagcaaatgaaattagctgattactcagtggaaaatgcagacaacaattcacaaatcagttgctaattctttctaccatgtatattaactttgtcccttggccagaattttgaagttattttctttatttagcttaatgaaacaacatcaaggagagtgtaaagtctttttcaatgtaaagtgactgaaactttgctttttagaactcatcatttcactaaaaaataagttcaccgtaagaactctccatcagatagaattcctgatggatgttccaggatttaagatgcatacaaagtttgggaaggcctgtcagttttttaaaaaaattaataggctttttttgggtgggagggggctcaactttcagtttacaggaaaattgaacagaaagtacagagttcccatgttacttctcattccctattccagtttcccctgttattaatattttgcgtgaatatggtacatttagtataattcatgaaccaagattgactcactattattaactaaagttcatagtttacattagggttcactctgtgttgtgccgttctctgggttttgacaaatgaatgacatgtatttaccattactgtatcacacagtatagtttcagtaccctaaaaaattccctgtgcttcacctgttattcatttctccttctctgccctgagctcctgccaaccactgatccttttactgtctccatagttttgccttttccagatgttatatggttgaagtcaaatagtctgtagccttttcaaactggcttctttcacttagcagtatacacttaaggttcctctatgtctttccatggcttgacagctcatttcattttatcactgagtggtattccattgtatggatgtaccatagtttgtttctccatttacccattgatgtaacatagtttgtttttccatttacctatcttgattgtttccaagttttggcaattatgaataaagcttctgtaagtatgtagtgcaggattgtgtttggatgtaaattttgtactggtgtcccaggatttaagatgcatgtgaagttcgagatggtctatcggtttaaaaaaaaaacagcctggaaaaatgtgatttctgaaaaggggtttatttaaactagtcacagttaagggcagatactgacttccttgccagacatacttaggcttgattaatcacttaatcacatacttaagtatgatctgagaattagagttgaaatacaaactgaatatctgacataaatcaagtataaaattgttatctgttttataattgcacatgagcaacgtactcaaccacttttatttcaaattgaggacctaaacacattacaaatgcatatctagagtatgaacacttctttggttgttaacatagctcttacttccttttgagtaagcaaagagccattctttcaagacttcctgtggccaccaataattctgccgaggggtctgacatcttgtgaatttgccaacctttcatcagagactttgactcatgctgaaacacccttcatttctagtggtctgtttcaatcttctggttcagtgttgagccagaacatataaattcccatctgaaaacctaacttcaggaaaatcacttgaacttttttgtgtctcaccaagtatgaggcctgtctctgcagcctggggatgttataaaggtggattagcccatgtttttaaagcacttacagctcccatggggaaaccttttgcgacttccaggcataattacctgtgtattccagctggaataaggcaaacagagtgcactcactttaaagccaaatgctcatccttttcttttagggactccatttggcttcctcatatggggtatattaatatcttgaacgtgaaagcatttgagttacaatggggaatgtttcacttattattcaacatttcatcataaatttggactcattattattttgatacctgaaactaaatacgtcatgcatggtagcccagaatcttccttaacctaaattagagtggactggtgcttctccttttttctttctttcttttttttttttttgagacagaatcttgctctgtcacccaggctggagtgcagtggagcagtcttggctcactgcaacctttgcctcacaggttcaagcgattcttctgcctcagcctcctgagtagctgggactacaggcacgtgccaccatgcccggctaatttttttatttttagtagagatggagtttcaccatattggccaggctggtcttgaacttctgaccttgtgatctgcctgcctcggcctcccaaagtgctaggattacaggcgtgagccaccgcgccccgccttctccttttttctgaagactgtctagagcttcttgatctggttgtgcccacttaatggaagcattccagtctgcattattctccatgtagttagagcatcttgtgtgacaataaacatgagaaacaactttatagtttttttgcaattatttataaagatcataaacatgaagtttttttagtaactgaaaaacaggcacaactaacaatagtggaaaaacacagtctgtttcatagaaaatgacttaggctaaaatatgacacatctcactgccttttgagatttatgcctctctctgctgacaccaacaagatcgtgtgaactggaaatacttgcagagaaatatttaaaaatattttctaaaaaatataatttatagatgaaaaattgatgtcacaaacatttggttgattagaaattcctgtttctcatttatgtaactccttctccctttcatttttcaatagtaagagactatcatagttttacattttggaggtgcaaatggtttggactattcaatagcccaaatggtcaaatggttttgggctattgaatagcccaaatcattcactgtgataaggactttgaatacagtttgatttatttttgtttccttgcttgaaatatattttacaaatattttcagtggacattcatcaacttagttcattctccatcttttctttgccttgacagagctctcaatagttgatgctaaatttattaaagtagatgtaaaaatctaaagctggatgtaaaatttagcatgtgatagtaaattttaatatctttagttttctggcatagtgttggcagagatgttctagatctatataaattaatcttttgatatttttctagatccatgctgttgaatgtggtaggcactagacacttaggatttttaagcatgtgaaatgtggctcatgggtctgagggactgaatttttaattttaatgaattcagataaccacatatgggccagtggctactctattggacagcacagctcaagtgagtcatttggttgccaaaggcttaaactttatcttaatgacctggccaacttaacaacgacagcaaaaataaaaatttaatggccatctgtttacttcatgctagggatatcacagaatatttaatttttactatatgcaacaaccctataagctcctattttaccatgaggagaccaaggcccagtgagcctaggtaacttcatgaaggtcatagagctagtccacatctttgctccttctgttttgccataagatctaatttttgttcaaactgtaggatcaattattatgttgaatggctctcaatttagatttgtctgactttttttataattaggttgaggtttcccaatattttcatcaccctaaaatgaaaccctgtgcctgctagcagtcactgctcctcccacaacccctggcaaccacttacctactgtctgtctctaaagatttctctattccagagatttcacctaaatggaatcacgcaccatcttagtctatttgggctagtgtaacaaaatatcttagactgggtgacttataaacaacagaaatgtatttctcatagtcctggaggctgaaagttcaagatcaggatgccagcatggttctggtgagggccctcttctaggttgcacacttatgaagtcttactgtatactcagatggtagaagggatactctgatcttttcagccctttataagggcacttatctcattcataagggctccaccctcgtgatctaattacctccccagggcccgcctcgtaataccatcatattggggattagattacaacatacggattttggagcgaggagcataaatgttcagatcttagcatccactgtatggtcttttgtcactgtgttctttcatttaacatgttttcaaggtacatccttgttgtagcgtgtatcagtgctttctttttatggtttactaatattccatcatatggataggacacattttgtttattcatttggttgctggagatatgggttgttatcatttttttgttatggtgaatagtgctgctataaacacccatacataggtttttttatggagaaataaggtttcattttgtttgggtatatacctaagagtgtaattgatgtgtcatatggtaactatgatatgtttagcatttctgaatcgggggtagtttctttttgataaatgcgattggttcttcattccttctggtagtttctgtctagtagtgaattagagttacaatggagtatagattcaggatgataataattaaagaacaatagtgtgtctggtactctccctaaattctgggttaaacatttaaaaaatgactaatacttgtttttggattttggggcatagtgttaaaaacattggggattaaaagaatgcatgacagtctttcctcttatgtctttcttcttacatttgttctaaaaacctatacgttggttggtcattatatataaagtggcattcccagtgtaatctagacaatgggaatccacagactgttggtagaatattggttgaaataacagtctgcactttgagtaagtgttaaagatatcagggggaaaattcacgaacccaaagcaagacaataatccctgtaagtttatagcattttcgcaggcctcatattatgttcagaccccaaagggttagattatatgcttcctgctgatttgtctgcaagaaacagcagaattttaaggtagtacagcttctttttgttcaataaatatacgtttcttgctgaaatgacagaaatttgaaactacttttaaaaaatatacatagtttaataattccatgaatgttgccaggaatgatcttattaaaaatagggatatgatgaatttggcccgcaagaatattaccctgaaacagtacctttggttaaaaaagaaaaagcaattctggtataaaaatgtccattcttttgatattctcctgatttcccctgttttgtcaagcttatacaaataatgatataaggtagaaatgaaggaaagtgtccaagaatggtacaaagggcggtgggaaagttccaagtaattcagaaagagctcagcagtctggggtttttggaggggatggaatcctggagccagggaatgcttctctctctctctctctctctctctctctctctctctctgtgtgtgtgtgtgtgtgtgtgtgtgcacgcacgtgctcatgggtgcagattttttggattgactccaacagtaaaagcacgaccttattaatttggactccactaattagaaaattactgtgaaatggataaggattgagcttaaagttaaatagcattttctgagaaattaatggcatagatataaagtaaatgtttgacctattttggagaagataatggtttacagtgcttctgtaatgaaggatccatgcataatcattttagtaacagttattgaacgtgtagaatgttgagaaagagtagtgtgatggctaagagcatagattggagcatcacaccccctggggtcaaatattggctctaccatttactaattctacaatttgctaaatcaaatactggctaactcaaatatctatttactaactcaagtatctatttactaactcaaatattggctctaccatttactaacctgggcaagttacttaatttctctcagccccagtttcttcctctgtaagatgggaataataatattgcctacctcttagctttgctgtagagattgaatgtattaatataaaaatgcttagctctatactcggtacctgataaatgtaacattaagtggtaactattattactgtgttcctggcaccctgctaagtgcagtgagaagataaaagagaatttctggtgtcaaaatgtgacgaactaacagataaaataatgtgtattgatatatacatacaatatcagtgtcatacagtacaaataggtacatattttctgtgtagtttactgtttataaactgtattcaattcaatgatctttcagaaacttagtttgaatctcttcaaatggtggaaaaataagcattttctataacatgctctgtagctctgacttttccttaagttccgaatgactttctcctggttggattggtttagtgaagtgtgactatttggccctcccatggaaatgcatacactgaccacatgtctcaggtgaatggacccatcaggagggaatggtcttgtttcttgaatacctttttgtggcccaactgcaaagcagtggctcctgagtcacaggaggtagaaactgacaaaaccatggagtgcagccactgtgtgaattgccttcaaccatgactgcttggcttttagagatggaacagacattcgtcatatggttattccccagtgattctgaaaacttttctgccaaaatgttaaggcactggtgaattgagttctatgtctgctgcaagagtcctgtggaaattcttgagagtctgaaatttgcctaatgctttttctcaaactgaaattaaaagccaaaacaaaacatcttttgcaaaatatctattgctgcccttttttctagcttcatttctattttagaagtgtgttgagcagggccactgtagtgtacaactctgagggacactattcatagacagcttacgtaaattgcaccctctggaattttgagtacgtgatctacatagccacacatggaggtccttgtgccgaattgtttgttagttatgttcatagaacctgttgttacaagttctttggaatatatgctagtcttagtgatgaaattgggcagtgactgggtatggtctttaagtctacatatttagataaccctgtatttaaccacatgccttctgtgtctggtggcattaacccaaattctcagtgttatcatcaagattattatgacatgccttgtcactgtaggtcatctggtgactagtttttaacgggtttctaatccttgtgtgctgggacctcactaagcattcttcacttttgagcctggcttgtgttattacagccactgttgctaggactgattcttctgttgtcacttgaaggtctaggaggttataaatgtattgaggcttgtgtgcaaaagttgctctatctcatacagcaaggctggctcaattcatacggtgccctacccatgtagcaagggtctctggagcaaatgtaacagctgcctagtggtagtcaaagaactccctgcattacaaaaggattaaatatgctgcttgctagagcttgtctggcaggagcttcagagtccttccagggagtaaaaacaattatatttcaacaaaggagtaagaaaaattggcacgtccctccatgaggtcacttcactttggaaaaagcatttgtgtgctttattttaaacaactttgtcaatactttgaggaacactttcacatgtttggaacttaggagaattggtatacaacaagtccatcagtttaaaccacaggcatttagaactgaaagaaattctggtatcatttatcatgagctcctcattttacaggtgacagagtctaaggccctgagaagctaagtaacttgtgggaagtcacagagcccatgggtgataagaagtgaaccagcacccaggttatgctgtgccagtgaaatacaagtcctgctttgctctcttgctctcttgattttctcccctgaggaaagtgcccttggcaaagccagagatggggacatttaaatggggacatttaaagaatctgttgcctttggggtgattttcatttgaatacttcattggcatgatagtggaataatgcttatggaataattcctctgttaagaggaataaccttgggcagttagttaacctctctgtgcttcactttcctcctttgtaaaatcacatttacttcctcacagaaatgcaaggatgctatgagttcacacttgtaaagtacttgtaacagtgcttggcacagggaaggtgctatgcaccatgagctgttaggattatgagctggaagttgccttttaattttttatagctcatttataagagaggaaatatttgtagaaaggtttcatcatcttgcttgtattgctttttctcaagaagaactcaagtatgacaagagcagagactttggtaccagataaacatgggtttgaatctgggctcctccactttctagctatgcaacctgatcacctcatgcccctgttcagtttactcatctgtaaagtggagatgtgagcatgtactttactgtgaaggctaggggaaatggatgtgaaacctagctgtagcacacaagtattttttgttgttgttgttccctttgcgttgagtggaatgtctacacacactttggggtgattggaactaagatgggaacacacacacacacacacacacacacacacacacacacgtagagttctgttacctccatgtaggccacccccttctttcttaccaactttgggaaatctctctccatataaaaaattacacttcacttcatgtgtattgctttgaactatttaaaattgtttattacatattcacactctctctcagaaattgagtggttgggaaaacgttaagatttatttatcttggatcaccctgtctttcatacggagggtgtcgtagatacttagtaaggaactgctgatgttaatggatgagtcttagcacagtgagcagggagagtggggctcctgccagtatgttcacaacctgcattctccagttcttcccctccttcagtgtgttagtttatgcctttgagctctgaggagaaaccattgttttcttgtctccatttttctagtgtgagaaactagaaatattcccatgcactgaattgttactagcaaaatttctgcttcaatattttggtcatactcttctatttagtgtctctctcaaaattcattgcaaccttcagtcacctttggttttaataaaacaaaaacagatttttcttccttttaatggttcaagagctcctcgataatgtttgcattttaatagtacctttactttggaaaataggaattgctttgcaaaaaatactgagttttcagtgaaaattaattacactataaatctgaaagtaatattttctaatacattttctgtaactaaattttacacttttcacatattttatattttccttaaaaactttccaaattgttgtttttttttctgagtgttgcttaaaaatcatgtttttgcaattaaactaaagagcttctgcacagcaaaagaaactaccatcagagtgaacaggcaacctacagaatgggagaaaatttttgcaacctactcatctgacaaagggctaatatccagaatctgcaaagaactcaaacaaatttacaggaaaaaaacaaccccatcaaaaagtgggcaaaggatatgaacagacacttctcaaaagaggacatttatgcagccaaaaaacacatgaaaaaatgctcatcatcactgaccatcagagaaatgcaaatcaaaaccacaatgagattccatctcacaccagttagaaaggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggattataaatcatgctgccataaagacacatgggcacgtatgtttatagcggcactattcacaatagcaaagacttggaaccaacctaaatgtccaacaatgatagactggattaagaaaatatggcacatatacaccatggaatactatgcagccataaaaaatgatgagttcatgtcctttgtagggacatggatgaaactggaaaccatcattctcagcaaactatcgcaaggacaaaaaaccaaacacggcatgttctcactcataggtggtaatcgaacaatgagaacacatggacacaggaaggggaacatcacactctggggactgttgtggggtggggggaagggggagggatagcattaggagatatacctaatgctaaatgacgagttaattggtgcagcacaccaacatggcacgtgtatacatatgtaacaaacctgcagattgtgcacatgtactgtaaaacttaaagtataataataataaaatttaaaaagaaatcatgtttttgctaatagtatttaaaaagcactcattcggccaggcaaggtggctcacacctgtaatctcagcactttgggaggctgaggcgggtgaatgactgggtcaggagttcgagaccagcctggccaacatggtgaaatccagtctctactaaaaataaatttaaaaaattagctgggcatagtggcgggcgcctgtagtcccagctactcgggaggctgaggcaggagaattgcttgaacccaggaggcgaaggttgcagtgagctgagattgtgccactgtactccagcccggcaacagagtgagacactgtctcataaataaataaataaataaataataaaaacataaaaaataaaaagcactcattcattctttagttattttgccctctatggcaggtactgtgctggtttctgtgaatatagtggtgaatgataaacagttgttttttgcccttgaggagtttagcagaaagcaggaaaatatgcaatggatagcaaacaaaccaattaaaaagcaaatccccagtaaggctgtgagggtacagtttttaacctcagtttcagtccgggttattaattgaaagtgcaataggagaaatgatgatagagtagcttttaagtaatgaggggaagttctttcaggtggtagcagatccctgaagtcttctctcctttctagaaattcaggcatcagggaaaaagaagattttggaaaggaattttctagtgtatgtaatacaggagaactacacatttaaaaatttctgcatttgcagcccctaatagcaatagttagaggagtagtagtattccataagtgaattataccttggctgaagtttgagtaattacaaatgtagactgggaagttgcttcatttagcaaatcagttctgatatagacacaggacttatctcgataaaatcatcatgcttcaggatggatgtacacctattttgggacaccaaaaggaactataggtgtgaccatagcactctgtttagtccttcagtggccttttccactgctctcacatccaactcagtagcccagcagagttccctgcctagtccctgccttcccctgcagcctcatcttctgccagcccttgtcctctgatgtacttccattgcccagtaataggtggttactcttggtttccaagtgcttcatgggaccttttgtgtttgcatccctgtacctgctattcttattgccttgaatacaacgttgcttggttaacttcttgttttgtttccaggcccagctcagatatcttttcttaagcaaaaactttaagacagtatttcataaactctggatcagggttaatgttaaaaaatatacaaaaattttatttttatcaggctgtggaagtgattctgattctctgccagggttgtgacgctgcagctttccatgaagtacttcacaagtaggtatgctgtagaaataagtggattcacaccagtttcccgaatgagacatactatagccctttttggatgacttgttgcacatgtgggcatattaacagctttgagaattagtgtagcaaatactttaactttgatgcagtacttctcaaatttatttgaccgtgtaacactttggtttgaagatatctgtcaatatcttgagaaatgtctgttatttcacggaacatagtttgggaaaatgttgccttaaaacatggttttggttaagaagaggcggtatcttaggaaggaaggtcctgaaagtaatggaaacaccaggcaggttttgttcctctttgaatggattccatgacatcgtttcagtatttcaatatttacttcattttcagtggagagtcattaaagccattgctgtcctgattgccacatagtccaaacacaagaaatgcacattttgtatcgcaatctctttcaataattttttatttgaaaattttcaaacacatgcaaatgtagagagaagaggacaatgaatctgcatatgcctattacccagattcaacccttagcaaggttttgccatattctttatcatctaactttttcttgctgaactattttatttttatttatttatttacttattgattgatatatgatagttgcacataataggtataaataattttggggtacatgtgatgctgaactgttttaaagcatagccaagaaatcatgtcatttcactcttatagtcatcattgtacatctttataaaaggggacattgcctggtatgacctcaatagtatttttgcacctaccaaattatagcaattccttggctaatacccagcccgtattcgagttaaaaaattgagatagaaataatataccatgaaatttattcttttaatgcacaattgggcttttagtgtattcacaaagttgtacagccatcaccactaattccagaacatttttattatcctaaaaggtacctgtactcattagcagtcactccccatttttttctccctccactaacatagtttctgcatttggattttgcctcttctggacactatgtggtttttctttactggcctctttcatttagtttaatgttttcaaagttcatccatgttgtagcatgtatccgtacttttttttttttttgagacggagtcttgctgtcacccaggctggagtacagtggcgcggtctctgctcactgcaagctctgcctcctgggttcacaccattctcctgcctcaacctcctgagtagctgggactataggcgcctgccaccacgcccggctaattttttgtatttttattggagacggggtttcaccgtgttagccatgatggtctcaatctcctgactttgtgatccgcccgcctctgcctcccaaagtgctgggattacaggcgtgagccaccgtgcccagccagtactttctttttatagctttatattccgtggtagggatagatcacattttgtttatccatccattagttgacggacatttgggttgtttccactttttggctattatgaataatattgttaggaaattcatatacaagttttcatgttgatgtatgttttaatttttcttagtgggtttgctaggtcgtatagtaactatacgtataactttttgcggaactgcacaatcattttccaaagtgattgcaacatgttatatttctaccagcaacttacaaggtttccaatttctccatatccttaccaatacctgttgtctgtttgattttggccatctcagtggatgtgaagtgacatgtctttgtgatttttatttgtgtttccctactgactaatgatgttaagcactttttcattggggtattagctatttgcatatcttctttggagaaatgtctgttcaaatcctagcctagtttttaagtaggttatttgtctttttactactgagttgtgaaaattctttatagattctggttgttagtcccatatcagataaatgagttgcaagtatttctctttgggttgtcttttcattttcttaatgttatactttgaagtacaaaagtgttaaattttgattatgtccaatttgtctattttttcttttgtttgtatttttcgtgtctaatctaaattgttgtctaatctgagatcagatagatttatctctttattttcttctgagagttttatagttttaggtcttacatttaggtctttatttgagttaatttttttatatggtgtaaggaaggactcgcattctttttttttttttttttttttttttttcaactggggccttgttctgttgcccagactggagtgcaatggtgtgatcatggcttactgcagccttggtcttctgggcccaagcaatcttcatgcctcagcctcctgagtagctaggaccacagatgcgtgccaccgtgcctggctattttttttttgtttatttatttttttttacaatttttattagagacggggtctcactgtgttgctcacactggactcaaatgatccctgctgcttggcctcccatgcttaggattacaggcatgagccagtgtgcctggcctcacacacttaaaagtagaattttagcttcagttttcagggtgatctagaaatattgctgttttctctttgcctgcatccacttgtgtacctcatctgccatcccatctcctcctcctccattcttaactaaccatgacataatttattagaatctgtttgcgtagtaggtagtagtgcaatcagagtctatgaaaggacaaagtctctattaccaacataattacattcaattaagcaaacaaccaagttgtaatggatatctgctgtttctgccttctgtgccccctctatttttctggacgtgggacttggtttgctctttgtgaaactccctacccacagtttagtctacagactgaccttgctcaaggagtgggcaaattgcagtgatttggccaatgaggattgtgtctctggagctacagtggttgtttcagagatgtacacagacccaaaaagggtcatgagagagatacctataattagtgagaaagaaaactgctgtagcctggaatattgctgccttaccaccagaaagtggtgtctatttatagaaccaacatgaagaaacgtgagccaagagatggagagagacagattcttaactatcaattaaacagctggatctagctgtgcctgaagcttagactatttctggaccttttagatacatgagcctgtacattcctttttaggtttgcagctgaaatagttgtgactgttatacagatctagtggttggaactgagaacacaagatataagaagatattttctgcttttgtggacttgacaacctaaaagtgagacagacagacatgagtaaatgaataaatgacaaatgcaagaattgatatagaatagattgacagcacagaggcaggagtgggtaactattgaggagggtttaaggaactggaaaaagtcctcaaaaaatataaattctgatttggggttggaagataaatttgcatttactttgtttttctgtaaacaacaaaactgatttttccacagtagcctgtgggagttattttcactattttatagtagttggatgtgttgttacactctaccattggtatgactataccatggcacttttctactagttatgcagaggctgtaggaagtaggtatagcaggttatataatttgggaagtggcattaagtttttttagaaccttattttattcagtgtattttcgaatgagtttccagtatggtattttgctttaagttgacttaactctgtagacttgggatcatttagttcaactaatttatttcatggagaaggtattgtagcctagataggctaaagaatatgcccaaagtcacataggactgaaactataatcttgatttctttatccttagtggagtctttctacaatttcataccttctgtttgaggctttgtgttagactattcttgcattgctataaaggaatacatgagactgagtcatttataaagaaaagaggtttaattggctcacgattttgcaggctgtatgagcatgatgccagcatctccttggcttctggggaggcctcagggaacttttattcatggcagaaggcaaagtgggagcaggagcagacacatcacttggcaagagcaggagcaagagagagtgatgggaggtgttgcacccttaaacaaccagatcctgtgagaactcactgtcatgaggacagcaccaaaacataaggaatccaccccgcgacccaaagacctcctcccacaggcccagcccccaacactgagtcttacatttcaacatgaaattcgggtgggacagatatccaaatcatatcattctacccttgccctccccaaatctcatatccttctcacatctcaaaatacagtcatcccttcttaatagtcccccaaagtcttaactcattccagcattaactttcttaagaacaaaagctggtgggctttacagtaaaattgctgaggaaaaaaaataaagaataggggaggtttttatgtggatgagctctctgtttagcaagttgccagctggatgtcttcatcattgtaagtttggtgccccggctctcctggaatggctagttagatggctcccgtttcccacccagatggtgctctctgtgtctgttcagtcaggtaggaagttgtgatgatcgtgcagattgtcagcatacctatttccagcgttcaggatttccaccatactgaatttgagatcaagtaatccttagaagccatagattcttcctctcaggagatgacttttttttttttcttttttcgggtcttcattactgagccaccatctcccttctgcaaccttgataagaaggttatttaggttcactgtagcttgaataaggttatcagaagcaattcagaaaatgttaagatgtaaacaaatgaaagaaaaaaacaaaactaaagaaagaattttttttccctaaggcaaaccaatgttaggtcctttgcagtggcactcaaaatctttatataggacagcacagaagggaaatctgtgtggcagtcgagatggcttgtcttgatgtttcattttgatagcaagctcgtatatttttatcttgtatgttacttggggtggctcaatagggggcatttgatggcattgtgggagaaagggtaatgccctccactttagcttatatatcaccactaggcatttcttcatctctctcctgatgctcaatggaattgtttctaatgaattttatgactgttgtggttatgaaacttgcataacaaacaagcagttccttcagcatatgtaaaaacagaaactaaatcaatatggtataagctcactaaaagtttgctgtttaaaactgaggatgccttaaaaaagacaatcgtgtttaagcccagttgcaaattattctgctccatttggagtctaggaaccatttgccagaacttcaggaattgagtttctggccagttatcttcgcagtagtgaatgtaatttatttgggggatgaatgaagcaggaagaataacttttggagttgcctggagttaatgtggaaaggtgactggacagaggtgaaatctgagtaaagctaagagaggagaatatagaatatgaagatactgtattctttttcttgggtaatacctttattgatatataattcatatgccgtctaattcacccattttaagtatacaattcagtagtttttagtatattcacagggttgtaaaaccattaccacggttttagaacattttcatcatttcagaaataatccttgtgtcctatagctatcacccacttacgtgccctccttgccttccagctgtgagcaactactaatagcttttctgtgtggacctttttaaaaaaacacatggagtcatacaattacaatatgtgattttcatctctggcttcttttacttagcataatatttacaaagtttattcatggcctatgcatcagtgcttcttcttctgttttttttttttttttttttttttttttttttttaataatttggtctcactttcttgcccaggctggagtgccatggtgtgatcatagctcactgcagcctcaaactcccgggctcaagtgatcttccttcctcaccgtcctgagtagcttggactacaggtgtacaccacaacatctggctaattttttatttttagttttgtagagatggggtctcactatgttcaccaggttggccttgaactcctgggtcatccacccacctcagcctcctaaagtgctgggattacaggcctgagccacctcgcctgggtcatattttttaaatacatttatctagttgatgggcatttgggttgtttttacctttcggctattatgactaatgtagctataaacatttgtgtatatgttttactattacagaggaataggtcagtggggaaattattctaagatactggacacattttaggttgccataatttaaatgctggttgattttttttttcttttaacatagaacagtaaatttactagtaaggagtggagaaaaaatgatttcacttcagtttgtggagctggaaattttcaactggttccattctaaggaattattaaattagtttcctcatacacagttctcacattcttaatagctttccatgcctaagggataggacttctcccatcaagctgtagggctctatggcagtgtttcttaagggtcagggaggagcagtagtagaggaaacaaacatatggatatacttcagtgtgttaggtgccgttataagggtaccaaagattggggaaagaagagggagtgatgctttcatcctggaagggtcaggaaaggcatcacttcacagatgtggccacattcaaaactgaatgggaacctgcattccctccctccctccctccctctgttgcccaggctggagtgctgtggcacaatcacagcccacccggtggcacagtcacggctcactgcagcctcaaccccttgggctcaagcagtcctcccacctcagcttaaaattggttaagtctattaagcaatttaaaattggttaagtctattgctcagagacacaatagatggtgcttgttaacagtattttttctaggagtcttttgacttcagtatgataaatattccaacacacatcattaccctaagaaaagtttataagtgaataatcacaaacctatggttttgtaaatcacaaaagtataatttcatgccttatttgttgtgcaacatatccttactttgctttcatagttactgctgattgtaccattaagataatggagtactgcaactgatgcatttttaagtattctcacctccactgacttgtatcaaggttaaaacttatttttcatagatatcaaggacctaataagctgagttaacaacttgtttatcactccatatgtacacaccacttacagcttttgtggagtgttcagttgtgctgattgcattgggatgaatgtattattatggaaacactatttgacgtttgggagcttaactaagttgtcttggagactctagttctatagtgagatagtctattgttcataatgaaggggacatcaaattgcacagaaattctgaatgagtcttaatgagagggctacttttaaggataaaacactatttttaagaatatgattatctatagcgagaaaaaaaatgcagcctttgaagcacagccatgtattaattactgggataggagtcaactagagtaggatcattaaggagaatctgtattgttgaacctctagctggtggaggtggctgggggccagttgctgggattgtcagagtttagatgagaagtttcagcttcagtaaatcttatcagtcttgagagaggatagccatagctaaagacaatcagttagggaaggtgggaacacaaattcccctagaagagtattaaaagatgaatttctgcagatgtagatatgttcattgtgagaagagaaatgagctatagacgaacctcagtgcttaatttgcttccatgattatatttggaaatgggaatgtagaaacaaaacaaacttagatttttagatttagaggtttagggaggattcccttttcagagggctgaaaaataccataaaatgcataattatggttgatgtaagcatctttttccaaaacagtttggtctaggcagtttaaaaaatggtaactggaaaccacagtgacacccttgcctccccctgcaaactggccactccagacctcctgggacaggccaggacaccacctcagcacacccagtctggctcagcctccaaacaggcacttttctcacctctccttccctgcctggacaggagcaccacaccccaaactgaaggtggagctcagctctgtccatctggaatattttgacatatggtgtagaataagatctaaatagtttttatttccccaaatcgtcaatttcagtagccccatttattaagaatagtttttttcttattatgtggtagttggctatagttaagacagagggccagtttgtatggctcaacaacctggatctcattagtgctgagatggcttagggttgggaatggttttgaggataagagagcctggaattttgcccactcaacctttcttttccatacatttaacctttcctatatagtagggatttttttttcttcctccaggcattatttttcatttatctgcatgtctatttttgtgccacagctgctgttttatttgttgtagcaatattataacactttcttataactggtatagtctggcctttattttgctttcaaacttcttaaaagtattttcatttgtttgaatgctttgcttttaaggtctgaatataggatttttttttcctaaatgaatgctgtcatagatcatgtagagctttttttcttgaaatataaatttggtaattgcaaagtatcatcaacagttaactttggctattttaaagttgataggacggaatgtgctctataacttttaaataaccagccaactctataagactttataaaactttaaaacaccactttcttgaatctcctttagaaatagaaacaatttaatacatctatgtattaataatttgttctcttttctgtatatatgcaaacagatatacaaatgggctgctttctaaatcagttaagtattggcctcctttccatgatcttagagtaatatgattcaaggatagcagaaacatgcaaaactgagagaaaacctttcatggcaactaaaatcttgcttctgcttattgatttgtttatattttgcttacttttacaagttatttcagattgcttataaaagtccattttaataagacctaaaacagtcaaggcaggaaagaagaaaactattatagaagaggaggggatggcaaagagccttcaaggtggagttagcaaactacagttcatcaagaaggcagtcgggagaccatcctaagaataatcattatgtagattcattcatttgttcagtaaatatttattgagcacatactatatgcctgtaatctcttaagcagtgaaaatgcagtaatgagcaaatcagacacaaatccctgctttcacaatcatagaggttgcattttagtggagacagtaagcaaaatgtttagtctaaatagtatgttacatagtaatagttgctaaggagaacacattaaagcaggaaaaggagataggaggtattgagggaggctttacattcttcatggagttgtcaggaagggcgtccctgagaaactcactttggaaaatggccggaaggctgtgagggagctgtaagggtgtcaagggaagagtgtacctggcagaaggaatagcaaatgcaaagaccctggtgcacttataggaggaagttgctggggagaggttgggtggagtgagggaggagagggtagtaggaggtgggtcatggttggcatctgcaactccaggaccagtcttagatgtttcatttttttttttttttttttttttgagccagggtctcactctgtcacccaggctggagtgcagtggcgtgatctcggctcactgcagccccaaccttttgggttcaagcgatcctcccacctcagccttgggagtagctgggattataggtggatactaccacacttggttagttttgctcgtttttttggtaaagatggggtctcactatgttgcccaggctcatctcagactcctgggctcaaggggtcttcctgccttggcctcccaaaatgctgggattacaggcatgagccactatagccggctcagtcccagatgtttcaaggctcttcagagaagaaagagcagggcaacagctaaagccaaagaaactagccttgctgtactttctacatgtttattcagttgtatatcaagttttttttttttatgtgtttggagtttctgatagcttgaagaatgaagggaagtaatgatgtatgcaagtttaccatgtctgttatatttaactttgacatagaccattttgaaatcttagcagatattttaggatgttcttcaaaatttgatacatcactgtttattttggaagcaaataacaaaagacttccctggatcgacttgtcattacaagtgcttagacaaatacccactaacagagtattatactatatagactggtaagttccatggttcgtagtcttgtttaagcaatcagagtgataaatcctgaaatacaattttctgacattcacctacctaccaattccctcctaaatttattggttcctgtaaaacttactgtgaaacttgagctacttgtaatagtttcatactaattttcactttttccaaacaaaggtgccttaaagttatgctgccaaagtcttgtagtaattttctcactttcttattgtgttgcaggctgttaatcggcttattttaagaaaatagagagatgtttgtaaaatcttggtttcagttgtgttcttaaaatctaacctgatagtgattttactgaggcctcttttgtgtattcactaaaggaagaaaacaccaaatcactttgccttttggaggtgatggagaagaatacataatatgttttcctggaagctgttttttttttccccttgtgaataggaggaggaaagcctaccagctgtgcccgatgcatttataattaagcctctcttctctgaagttgatgttttggtgtctaaaatgacttgattttttccattttagtgacatttacgaatcttatccctttgtttaatggaaaggggaaatgggagcaagtgttacaattgtcaggtctctgtgattgatgccttagtgccctgctctagggcatgtcgtttctttaggctgtcaggaatgggttaggatgatgcccagtggtgccagctgtgtggctgacaggagctgggccactgagttgcctcttcggcagagtcaacatttgggccagagagactgcgactcagcgatgagtgtaaacatttgtttagtttgaatgattaggagcagaactggtcttggttattagctgattgtaagaatcaagtggagcaaagccacagcctttgttgaggaacagtactgtaagaggcatataacataggggctttaagggaagcccgcttatgctcagaatttcaaatgaagccacagcgttggaggatgggcggttggtgggttctccaagactaagcagagggaacagcagaggaggagagagtggaagtgctttatctggcccccttggctgatgcttggggtgaaggcaaagtgtttggtcgctgagacctttcccagtcacatcagctggcacatgagagaataaacctgacccaaagctttagaggagaagaaacaggaaaaaattaccacctgtattatgatttgtttgtgttcgtctcttccactagactgtggatgtcctgagggtgatgtctgtgcttattcattttatatcatcagtgtttattgaaatgaactgaaaggtgtgatgaattcctcctttaaatgtgccattttttagcctcttcaggttaagggtaacttgttattccggtatgttgtgagaagcctcggtgcataaccttttcattttttttttaaaatagaggatttaatgaagaaggattgcacaagagcagagtgtagggtaatcaccatataaactcagaaatcataattggttcattgttcattcattcattcatcagcactagctattatttgctaggtcctggggatgcaaatcatgacataaaaagttccttaagaaggtgatcacatacttctgtatttgagataagaagaacaagagaataattatccaccttaaatcagtagcctacaaaggaatcgtatcaggaagagttgcaaagagagttggaaacaattttgttttgttttattttcattttgagacagggtctcactctgttgcctaggctggagtgtagtagtgcaaacaagtctcacttcagcctcagtctcccaggctcaagcaatcctcccacctcagccccccaagtagctgggactacaggcacacgccaccatgcccggctaatttttaaacactttttgtagagatgaggtcttggtatgttgcccacgctggtatcaaattcctgggctcaagtaatcctcctgcatctgcctctcaaatgctaggattacagatgttagctactctacccagcaggaacagttcttaaatctagctcagagataatattgtgtgattggcttaaactgtattaactgattgcaacttgaattaacaaaataatctgagttgcatatacaaacaaatactttaaagcttatttaagtttttaaataatttacctgaagtatttctatgtgtgtttgataataatattaatgacttactagtgtaggtaatatactgtctctttaataacctgtaatgaaaattatccctcaccaaataaatgtatattttgtcaagttgtctatcatatattccttccaagaacctctagatgcaccagtccccaaagcagtttattttaaaagagacttacaagtaatagtacagagaaatggagagcctactgctataatttttttaacctcttaaaatattctgcaaattgtgaatatgctggaagtgctcttagtgactccagtagttttattgaatcaaaagtagtttactttcttagcaaatcaatcaatttttgctggcatagtacagctatgctgtatgatttcttgtataagtcattgaatctgtcatttttaagaatgaatttttaaaaatgatcttttgctatatagatttatagtcagcataggctattgaagaaactgtctcagagcatggaggatgaatgtctccaactcaaaaatgtgttgtggctctcggagactattgtcttcattatctttctcctggtgctttagatgtaattaaaaattactatgtgtaatcaagtataaggcggttataatagtattctgtttttgtttatatataaatagaatttttgtttatatatatgtttagtttatatatatttttcgtttgtatgtatatccctgtaaaacctttatggtagtttgaggactaaataagacatgtctgcagtaagataggagtgttttggaggatctgagtttctttatattgtgaaatattagctcagctaatgatattagaaggacatcagtttatatctgcctcggacttattgacaacctctttgagatgaatttaaatttggttgtatcattagacatagcttctagtatctgatttaaagttactcagtttagtttaatgttatattgggtcttcaaatattatttggtataattaaatttttgcattcataacacaatttgaatagaagagcaccagtttttcattgattggagaaataaaatatagcatgaataataaatttaaagtcatgatgtaaaagaagccagatgagaccctcaggtcagatagaatgagtttctatttgtcttgctctaaaagacactgtgttggaaaaatctattgggtgaattaatcagattccctctgcaggctcttcataacttaaggcagtgaatagagttgcatgtctcgttgtcatcacatatcagatatgcataatatgtagcgattcagatcagctgcgggagtgtttgggcgcttttgttcctttgagtcttttaaagtggaaaagaagtggcagtgcataaaagttagctccagctattattattttattgacctgtttcttcctaatggaaacaacattgtgatcacaaattagaaaatgaaagaactcacttttaatggtttgaaacttgtagggcaaacaagattttggccatacgtggatgtactttagaacatggctatgtacacattttccaaaaactctgttggaaaattaaagtattttttaatggattctgtaaagagacagatagtacattgtggagtttatatgtatttgaaaatatggatagtttgatttattttacaagagtgcatcaaggccagagttttaattctcctcttatgttctgttattcccttttgatgtgcatatttctgttttttatgaaatactttaatttagacttaactacttggtacacacgtttcaaactattatatatcgcctggcaccagatgtttttgctttcccgtattgttggtctattggaaaacagggaggctcttaactgaggttgcctgtaaacttgatcaaatgtcactttaatccctgtgtacttttggcaaactgagagctatttaggaagtacttagttcgcttgtttgagacaaatatttccattacaggcttggtggaggtgactccatttaggtgtcttctagacactgtaactgacctccatttaacagactcatgggatgaacgggtcctttacattctctctgagaacatactgactggtggtgctcagctgctctctgggatgcctgtgcactcactgctgcttgcactgtcaagctgaatgtttatgcccattgtacttgtgtttgtaataatataacaattaactgataaaatataagtgcataaaaaagaatgtggctgtttctatgaaaaaataaagtaattgcattaaaaataggatacaggtgttactaaacttttttattgactcaaatgtaggagagacaactctatatagactgcatagatttaggagacttcagccctagtgtctttaaatcctccccttatgaaacctgatactggaatttgtagatgatgctttggttatggttaatgtggaaaaaatagctcaattcctggaccatcttcaaagaaaaattcttcactgcatttcaaaagatacttgagtgaatgtccatttataagaattaagttaactgaaaattttaaggtatattttataatttatttttatgattcaccattttaagtaacatttttgctttgtccatttactagtggtatccactgcattaataatggtggagtattattttacatcctttacctgtatctgcattaattacctgtatctgtttatgcactgagggtgtatttgagcctcattactttgttattttcaattacctagttacaggtcctgaatattaaagtttaccttttcactatctagtaagaacgtatccagtaaacagtaataacctagaaaaatctttaagggaaaatgtataaatatctaaaaaaagacttgacctgtttgtgtagaagtaagctaagtacattttaaaactttttctttggaaataatttaaacttgaaaacctgtaagaagaatgcagagaatactaaaatatcctttaccactagctttgttattttttatcaatcaatcatctgtcggtctattgtgtgtgtatatagataggtagacatatagtctcttttttgaactatttgaaagtaagttgcatataagatagtatatatttcttagggataaagatatccacttacattatgcagtgcagttatcaccttcagtatgtttatacctattcagcatatctgaagttatcaacctcagatacgatacttattatcttttatatggtttgttttccaattctgtcagttaacccaataccaccttttatggcttctgttcacctcagtgcagaaccaagtgtagaatcatgcattacatttacttgtcatatctttttagtctcctttaatttggcatagttcttcagccttcttctatatttatgaattgacattttaaaatataggtctttttaaaaatggaatgtccctcatgttatgtttatgtaatgtttcctcttgtttagttttaggttatgtgttcccagtgggaatgttatgtaactgatattgtgccctcagggtttcacatctggaggcacatggcgtccatctgcttctcagttttgatgctaattttgatcatctagtcaaggtgttagtcgatttctttatgctattttttccccttgctactgtgggcaatctgtggggagacattttaattccatacagatgccttgctcctcattaaaatatttcccctagagttagcattcatcgatttgtctttactgtggtggttacaaaatgatgacatttccctccaaattgacccttggccttctcacgtgcaagatcccctatattttctttctttctttattcatttatttctggtgtgaacttacagattcctgttttcctgcaatggcctataattaattactgtttttaaagataattttggtgctcagattatctgaatgggcaaataggaacctcttcaagttggctcctatgtcttagtgatatgcccaactattttagcaccttcctactttgtgacataactagattttacaggcttttattttatgcttttgtgcttcagcatttccccatggaccctgattcctctgcatggggaatgctattagaaaccaaattctgggctgggcacagtggctcacacctgtaatcccagcactttgggaggccaaggcgggcggatcacctgaggtcaggagcttgagaccagcctggccaacatggtgaaaccccatctctactaaaaatacaaaaattagctgggcgtcgtggcacatgcctgtaatcctggctactcaggaggctgaggcaggaggattgcttgaatttgggaggcagaggttgcagtgagtcgagattgtgatattgcactccagcctgggcgacagagcgagactctgtctccaaaaatccgcaaaagaccaaattctgggtagatgtgttcattggtactgggaatctgcttttagggcctttgagcagatagagctagaaaatgtacgtgtgtgtgtgtgtgtgtgtgtgtgtgtgtgtgtgtatgcattcatatatacattcacatgcatgtatgtgtatatatgcacatgcatgtgcacatacatattttaaaactgtgtccacttataaccttaatttgaatccatccctgtagaggttttttatttctcccatggtaagaaccctaacttgcaacgacttcaatatatttacttgtttgctaaaatctatattatatctaaagtactttcagaattgttgtgctgtagcactacaaaatcaaacctaataaaaagagtttagagttatttatagttctcttcccattttgaccaagaatgttctccaatcaagaatactgtgttcataaacttccataagttgttcttttattgtatatatttaatgtgtacaacatgaagtttttataaacatatagataatgagaaatgattactacagtaaaaccaggtaacatatccatcacttagcagttaccttcttcttcatggcagtggggctatattacacatttgaaatacaatttggatttgtttgtttactttcagttttattccttcttccccatccttgttgatttaactttattttttgaatgtcagtaacagtaacatgtttcaaaaagtcaaactattcaaaaagatatactcagagaagtgtcacttcctctagtgtcctgtccagtctgttcttacctctccaccctccatataggtaaacaacttcaacagtttcctattgtagcccatactaaaggggaagggaattaagatctgccttttgaagtgaggcatatcaaagaatttgggtacatattttaaaaccatcacaccgtgtttatggttctttaaaacttacctgtctgtccgtccatccatccatccattcatttatccatctacccacccatgtatctactgcacatatatatgtttccttgtttttaagagctgattgtattgctaggggcagtaatctttgcctttcatatatatatattcatattttcatatatatagtgaatatttttctaattttccatcttttaaatatgtatatgtttttatgcatagattttttttttttcatttttagggaatcatcctattatggtttctggttttggggtatgtttataaaagttttcaccattctaatatgagaaaaatatttacctatagtttcatcttttatatttacatgctttaattacctgaaatttattttagcataaggattgagtaggaaattcatcctctcttttctttcacattgctttctggttgtctcagtagcatttattgaataatccatcttttccccactgcttcaaagtgttgccattatcataaattattcttaatatatgcttgggcctgtatctcaatgatgatattatattatttgtcttttcctgtgtcagtaccaccctcttttatttactgaagcatgataatgtgcttatcatacagttagtcttccagtaaacattagaattacttgtttcaaaatttaaaacattttctattgagattttgattagcctggcattgaatttatttaatttattatatttctttagagatagagtcttgttctgtcacccaggctggagtgttagtggcactgtcatagcttactgtagcctcaaactcctggactcaagtgatcctcctgcttcagcctcccaactagataggactacaagtgcatgccatcttgcccagccaattaattttttttttttttttttttttttttgtagagatgaggtcttgctttgttgcccagtctgcccttgaactcctggcttcaagtgtgtgagccacagtgcctagccagcattgaatttagaaattaggaagaactgatatgtgtaaaatattcaagtcttactgttcaaatacaagttctctctccagtcattttccttctgttccttatttacattttctagtttttctcatatagatactgtatatttcttattaatatttattacctgctgcttcatgtttctttttgttgatattttgattgtactttttatttaactaaattttctcttttagtattggtacataagaaagctgttttattctacatattgagtttaacaaacagcgcagcatagtgtgtgtttttggacaagttacttccttcaatattttcatctttaagatgatattgtagctacttcataagaataatgagatgatcttttaaagagattaatacatagttctcaattaacaaatattaattcttattatgatgatttttagttttctagacgttagtctactgaattttcttttgtttccagtagttttttcagttaacttctgtggtttccaaatattgagtcatttatctctaaataaatatttagccttctttttccaattagggaagattttacagtgcctctcaaaaggcagtttaattcagcgagaagaagtcttggatcattaccatgtcagctgcctttgactttttgatgaaaatgtcagccatgttctaatgagaatgaatttggggaattaacttatgaaaaatgaattatacaatatagttttgtttatttcattgagaagctcctggaggacatggtctgtgttattcctgatgaccttgttgaaaattgaaggacactattatcttagtaaaagaaaaggactctgtcttaatcctcactgtatcccattccctatcatgagtactggcaaatgttgtcaactaaatgaattaaccagaaagcataatatagagtgcataagatgaaataggagtatttctgtgattttctaaaagtaagattggcggaaagtggttaagtccaaattcctaccagtggccattaatcctgagataaagatttgttgggagaatcaatggaacttttttttgtctttgatgaaaagttttcatatgttaaacattccagtgtgcttaaagtgaattttaagtgagtaatgtggttcaattatattgtatgagcaagagaagatgagaaactctaaccaaatagcaaattgtttgtgaactaaagaccagagaggaataaaagacttaaaaactcattcatgtgactgcctctaatatgtgaatacatgatctagttgtgattgaattttttttttaagcagcagctgtgacttatgcaacttagaaatgttaactttcaagtagatcaaatcatccacatcagaacagaggggtaatttattcaaaaaaagatctccctattttctaacccatgatttgagtgggctgtaaaatgtaaacatgagaagtagggagatttgagggatacgtgtagggtagccaaatatgttcttttttcttaaacctaaaaaatcatcctcaacatgagtctattatatttattaaccgagcagagttaagggtctatttagggctggtctaaaagttaggccaagaagcaggtctgaacttctggacttttgggttgaggaaggctaattaaaacaagaactgtgagaaaaagctttctttagaaggctacgaagggtgagtagggttttggtttgatagaagatggaaaaggagggctttttgaacaagggaaaaagatggaaacagtagtactgaaaggagaaataattaagggatatgaagataataatggatctagatacatattaatgactaaatgtgtaatgagatggggaaatggggaagtgatatgctaggttttcagagggtcttgaaaacaaggcagaaagttttcatctgtgatgcttttgggtaagagtctccttctcaccccccaagaaggatttcagttatttaaaacatagcattttacctttaaaacctgtttacatattttgaaagacatttgaaagagaaatacattatattaatcttgagaaacaacttgtagtataaaagcaatttctgaggtaccctgataaataaaattgtggaatagtggcctctttcttttgatgatgatctaaagcaaataggaacagttgctgcagctgaaagtgttgataactgctgaaggacagagaagacagccaataaatacttgatttaaaccacaagatttgacaagtgagaaatgtgacttagaattatgatttcttttttcctcagtgtcacctaaatcaatacgaataatattagaatgacaaagtataaagtaaaaggctaaggctctaagggaagtattaggggggaagttcaagagatccaggttggactgtggttatcatagcagtcagaacacacattcctatgacctgttcctacatctaataaaatgattgtttcagagatttctggtggacactcaatatctggttttgatgcctgagatcagtcacagaccagtgaatacggatttctaatggcagtcagtattgacacctgagaaattaaataggaaaaggaaatataaaaggaaaaagcccgtcatcttacgatcatattgaagaaacttaacttgatgatttaatctttttctcttagggtcataattagcctttgctatatgtcagtatttttaaattgcattattcaaaatataataatttctcttttttaaaaaattgttttttattatttatagggcaaatggaaatgacttaaggatgcacgttaaagcacctaggtagtaattaatgggcaatgacagtaagaggtattaacaaaaaactgctgctaacagattattacaaaagtaaactagaaaagatattccgtgacatatttaaagtttattatggtaatgtaataaaagctgtcatacttagtgacctagtgggagaatgtcccaaaacaggatttctgatagagcaggcactataatctccactggtgtagtcagtgctgacttcagagacagtttggaacagcgttcatatgtagaaacaatatttacaatatgattatattactctgcccacccaaaagccataatgaattttcagagtccctcccttcccttttctctctcctttcctctctcccacccagcaaaataactgtgctgtatgagactttgtgttcagcattgggttggagtggttagtaaaccagaaagaacagtccctggccctcccacagtgcttgcctttgtggagcttgagctctgtcctccaccgctcctccactgtcagtacccttagttttcagacaagtcagcaggcagttagaatacagtatcaatactgtagttgtaggtatcttgaattctggtgctcaagaataagcagatatggctgaatgtggttgaagaggtggaaagagacttgtggagctcttaaagggatttgtgtttactttcaggagccatagaaagaagataatggtgctggttttaatgattaatttagcttatttatgattttctttttatctggtacagattagatactattaatacttttatttttatctgttatcaccagggtcctttgttttatgtatggactgaagggctattcagggaggttgggtgtgggtagggaacctcttaagattgagcaagaatggcagaaaatggaggagagggataaaagaggaagggcatgaatgaatgaaaatgaaaatgtttaattgaactgtgtagtctgtgagcccttggtctcctttgaggagaaaaagaccgaaggcatttttacaattagatcttctcatactaccccagggaaaaccattagcccagactagtttagctgctgactagaaatttgttccttggggaagggtaagaaatacatgactgttgtgaacagactgcttttatatttaatgtttataaaatgagtttccataatcctatatctttccataattccagggaattttgacctcaaaatagcatttgaaaaaatgtatggaacttaaatactttgaagacataaaacacatctaggacttaataattgtttgccgaatagatgaggaatttgaaagtttgtaataaactgcaaattatttggaaatcattctttgatgatataacaggaagggaaattattgggctttgagaaaatttttatagaatttcaggcttcatgatcaacgtaagagacttacattacgaagactaactactatattgatgctcaaacttacattttagtttttgcttacctttttaaaaagtaaatattttcttctgtgtacttaacaaactgcattagaaaaatctgatcatttgtactaggcataatttttgataaagtagtataccatcaaaaattgagggttcacttctttagactgtaaaccctataaagcagacctcaatctacttttaatgctctgaaaggtatattaggtaagtttgcttgatgtttgctgtcttagaagaggcaggttgtgtgacacttaagtgtgtgggttctggggccaggctgcctatatttgaattgtagctttactaggattccatttggtggcctttttagtgccccaggtttcacatctgtaaaatgggattaaaaatagtacctgccttcctcaagggattcttgtacagtttaaatatggcaatacctgtaaaatacttagaaatacccattattatggtcaatattttactattaacttctttcactatgtctgtgtactttttgtttataaagtattattaaataaaataccacaacttaatttatttcatcttagcaggaagtttctttagaagcacgaaagattgtgtttataacagtattcagtataatagtgtggtttctctcatattgagccagatggcgttctctagctacagaatgaggaaccctttagctgtgtgtcattttatgagccgcaacatacattaatttaaaataaaattattatgaatttaaaaattgatatatagcaaatgtagagaattttccccatggttgtaataaaataatttttgtatcatgatatgtaagagcaaaagaataagaatgaaaacaattatacttctaagcattcattttgacaaagattactttagaaagtaagcaaattaaagtaaaacagaataaacaatgataagtttaattagaaatgtgaccaccattcccttggtgctcagttcagacttaagtcctctatttattttgtattgtgattttctattttattcttactcatagtaataattacttgaaaatattttataaaaacattaacatatactccctgtttggtcacacaatttggtgttttatggagagaaataattttattcacaaatatttattgaacatctagtgtgtgtttatctcagttgtggaccatgagggtacaactgtggacaaaacagtcctgccctcccggaacttagccgtgaagggaggcagataataaagacacaggtaaaatttgtttgtatgagggtggtaagtactgtggaaaaaaaataaagagaaggggggtataggaaagtttgtcattttaaataggatggtcagggaagacttcacagaaaagatgacttgtaggcatagacttggaggccatgaagaagtgacccatgaggctgcacaggagaatggtgtttcaggcagagagaatggcaaggaggctgttgtggatggagaatagtaaggggagagtagtaggaatttttcagaaacacgagctacattgcacagggccttgtaggctgctgtaaaattggcctttattctgaatgagatgggaaaccattggaagttttcaggcagagtgaagtgacgttgcttccatttcaaaaagatgactttttcagctattctgagaagaagacagtagggagtagcaggaaaccagtgagaggcacctacaataatctgcaagatgatggtacatcaccaccatccaactacggtggctgcactggagacattgagaaatggttggatttttaattcattttgaaggtagagccagaagtatttgctaacagattggatatcaaattagagttatcaaggcattgagtctgaataatttggaggatgtaattaccataagtgaggtttgggagtgctgtgaaggagttgatttcataattgttgtggggcaggagataagcagttttatttcagatgagtgagtttgagaggaaaggtgcattttctacatacataagttgtcctattccaagtgtgtgctatacttaaaggtataaaaaataaaggaaaatgaaatatggtgtgctccaatctgcgaaatacatatgttttgcatctgtaattgttttaaagatacatttgattgcaaatatttgacaaccagtatttctagcttttcttcttatatcgttggtccatcgaatgcttctttttctgtaagacaagagcgtattttttgtgtgttatattggtttggttttcagacagatatacccagatattccattacatttctatattccaaggacttatttttcaagtattatcaactttggatggctgtgtgtttatttcaaaatgatatcacagttgcccaaatatttttgaaattctgtttttgtgttaattaaagaattagcttataagccactctggaaaatcagtcttgtaggagtttttaatttttatatattgacttctatacaacctttgctttgacatactgtacaccgatatcccttaagagccaaaaaccatttacatgccacgtttgttttttcagctgtcagcagactaatgatatggactaagaagaatgcatgagggctctgcctggtggagactatgctggcgggccatgatggggtcttcctgttctctgcttcctgccccaggactaggggaggaataaattatatatataatttatttccaaaggatacttttaaagtaaatgacacatattgttatatttgctaaaatgggctattgtggttgggtgtggtggttcatgcctgtaatcccagcactttgggaggctggggcaggtgacttccacttttcattatattttgcatagaagttactgcattggtctgatgagaaagaaaaactgctttaaattcaggccatttcttccatcaagtaaaaaaaaaaaaaattctccctggagtaaagctttttgccagtagggttctgtagcttgtgggatgtactaggaaaaggtgcacaaaaatgtgaagcacatgaatgaaagaatccgtcttttagcctgtgtgtgaaaagcctggtttctttttcatactgttataggaagtatttcagattttatacatatttgcttttttccattttgaagtggttgctctgtgtattcttcccaaaggtatttaaaatgagaatacttctgtggaatgtaaatattaagattgatgtctaaaggtcatttttaaaatttaaaacatctgctctccttcatacttaaatatttattgaacagaagttgtataagctgatgatgagtcttgatctggaatagaccctagtctgtgataccaacacagatttgaatgaagcttgccaaggttagcacctactaggtaagttctaccagctgggggtagacatcatcagaggtttcctcatttttccataccttgtgtctttataatgaatagcttatgcaggcatctttgtttttgcctttccttgtaataccacacatgcacggctgtgttgttgggaacttccaggaaaagcttgttcaggtaagtagagcgggagagcagaaattgaactaatttgtactaccgagtaactgtgctgtgttgcttctttgtccctagatccaattcattggcctcagtggattctgtgctcctaagtcccagcgacagaacatctacttagtcattgatattgggccttctgcctttgttggaaatggttgctctgtgtatttatattctttgttcattcatcgtaatgatcctgtttctagatcctctctgatttggtattaattgtaaacttgctgagcagagaagttgtttaagatggctctaatatgacaccttggtccttgatttattttgctgctttttaaaatggacttatagtataaagaggctagtgtaagaaatatcattgaggaggcacaagtatgttgttggaattaagtcatttgggtgaggagataaaagaagatttaggtaggtcatgtaattaaagggatgtccatgacatgtggatgttcaagaggtgggaaggaaggaagactggatgactgtgattagagtctgcttcagggtagagagcttaccttttattatctttgtgccttagggcttggcactgtgcctgatgtgtaggtgttcattatatgattttgtgaagcagtcaaagatggaataactatcaaataagatgttaagagtaatctctaaggttaagaggaaaaagtaatgattacattataaatactaaggaaacagaagcagcaaagaggaatagaaggcaaataaggattttaaaaaaacagttaaaacatacccatttaacttgaattgaatgtcgtttgattacaaattaaacgtagtaaactgacaatatgtatttgatattaaacttctttacagtagtaaatattaggtattgaaatcaagcctattttttaaccataaaaatacaggacttttaatatgccccttgtctagaccaactgaactttattttactttaatttgaagtttgtattggataaaatattttggtatcttaataatcagataccagatttttactaattaaaataactataattgaattttctttttgaatattttaccattcaatgtagtattaacatttaatattataagttaactgataaactgcatgcataggaatttgtgtgcattaattaaggactgtcatgtaagtgttcttaaactgaagagttaattgattaaaaattgaaaatattcaaatgagaacatgctgagaaaatatttcatgggaaaatggatcaggtgaaggtttgtgagcaagaaactatgaatgccttttaggtgtgaatgataagggattaaaaatcatttaagacttgtatgcttatatatcttatctgtgtgtggatctggaacagctaagctgctacttcaactaagaccagacatgatatgtgagttatataatcttatgtgatcagaataattcttcccaaaagaaattttgattgctgtttccctgcttatgacaccctgttgcctacaagatgacactcaactcaggcgggcacacaggacccttcatgattgccctttgtcttgctttcagccttatctacacttcatctttcacctgtgctccttccttgtcccccactttccccagatttcttgtagggaattttctgtattcctttaaatatgttgtaatattttctacctcatttatttgctcaggctgctctttctgccttgaaatcccctgacattatgaggtcctaaaaatataacttgaaaaatatttaatggtttctttggcgtcataccatgtgtattaaaagtaataaacaattgaaatgtatattctctaccttggtaacaatgggtaagagtatagaaatgacttactcatatattcattcaacaaatgtttactgagcgtctactatttaccaggcacagttcttggccctggagatttgagattgagcaaaatagacaaatctctgccaccaaggaacttttacacaagtggggatggcaggcagataataaacggatatgaccaggctgaatttctgaggaatataaacaaaagcaaggaaaggggaaaaacggatgggaggtgggtgttgataaatggtcagggaaggcatttctgagaaggtgacatgtgagtgtagatgtgaaagaagggagggagcaaaccatgggaatatctggaggaagaatgtttcaggaggagggtgcaacagccttgagtatagacggcttagtgttcttaaggaacaggaaggagttcatggtggctggagtggaatgagcaaagggtctgggggagaaggtcagagaggtcgtaccttgctggtcctggttggggtgtagcaatttactccaagtcagaagctctttgagcttttgagcaggatggtgataattaaaaaaaccctgcctgttgtgtagaatgtagactgcatcgggaagaagaatgtgagaatagctgcagaaagaccagttaggaggctgtggtcatcacctaggtgagatgtgttggtcgcctgtattaggatgggagcagtggagctgctgagaagtagtgggatttaagtatgttctgaaaggagagccaagggaactagcttgttggagtggatatagggtagcagagtacaatcaaggattctgaagtttttcactagagaaatttgagtgatgtaaaggtaggctcatattgagatgggggaatatcggaaggaggagcaaggtttttgagaggttatggaatcaggaatttgatttggttttgtacttcttcttcttttttttttttttttttttttgagacagagactggctctgttgcccaggctggattgcaatggcacaacctcagctcactgcaacctccgcctcccgggttcaagtgattcttgtgcctcagcctcccgagtagctgggattacaggcatgcaccaccatgcctggttaatttttgtattttggccaggcttctgtcaaactcctggcctcaagtgatccgcccacctcagccgttttgtacagcttaagtttaagattcctattatgtatcctaaaggatttgtcacataagtatttggatatgtgagtctgaggatgagggaaaggtaggacctggaaatacaaaattgggaaccctcagtttactgacggtacttaaggaagaggttaggataggagtcacctaaagagggagtgtaggcagagatggcaagaggcccaaggtccccatcctgggacacatgtctttataggttgggaagggaagagtgtccagcaaaggattctgaggaggcagagccagtgaagtaggaggaaaactacgggagtgtggtatttggagtcaaagtgaagaaagagtttcaggaaggaggaggtgatcaattgtgtcagatgctgctgagaggttcagatgaggtctgggaattgcccactggtattgccattgaggaggcttgctgacctttagtggagtggagaggatagaaatctgattaaaatgggtttaagaatgaatggactgaggaagtggaaccagttgggatcaactcctctttttgaggaattttgatatgaagaggaacagagaaatggagtagcagctgagagcggttcagaatcaaggtagatttaaagtaggagacaactttggaaataatgatagttttattccccttttcttctttgttaaaaagaagacatgacttacctgaggaaattcttagctttaatatctacagtcgctataacatgagaaaattgtcattgaacgagatagcactttttgcattgtggtgctaaaaaaaaatctttatttttgtagagatggggtcttgctgtgttggccagccttgtcttgaactcctgtcctcaagcagttctcctgccttggcctcccaaagtgttgggattacaggtgcgagctactgtatttggcctaaaaaatcgttttataaagcatcagatttcagtgcagttacaatgtgctttcttcctttagcttttcggatgttacatagtgcctttgaattatatggagctgaactgccccatgtgagattttctataaacctagaagtaatttcagaataaaaattttacacaattatatgtctgaaacaaaattggtgaaagttctgttactctaattcttgtagaatatctaaatagtattaaaagaatcaaataacttttccaagtaattccttccacttaaaaaaaagtgttgcggccgggcacggtggctcacacctgtaatcccagcactttgggaggctgaggcaggtggatcacgaggtcaggagatccagaccatcctggctaacacggtgaaaccccatctctacgaaaaatacaaaaaattagctgggcatggtggcgggcgcctgtattcccagctacttgggaggctgaggcaggagaatggtgtgaacccaggaggtggagctttcagtgagctgagatcacgtcactgcactccagcctgggtgacagagcaagactctgtctcaaaaaaaaaaaaaaaaaaaaaagaaaaagaaaaaaagtgttgcatgggtatgtcaattaaaaaaagtacttaaagaaaattagctgattcgtgctacttgatgttttacttgatgtttgttctgataggtaggattaattctacttaaaattatactgttctggtactacattttataagtgtttacatgctcattttaatttcctgctaattgcaatgatagcacaataatgaattctacctataaattacattatctactattaaaatacagtttcttggttgtgacactttatgctactccacaaagagggaaaatacttttgtaaatgaaaggaagagcagaatggtggtgggtttttctgactggtatttaacatgtggatagattcttcatacatagataatatgcatcatgggtgagtcaccaaattttaataagaaaaccaattatttgtgtatattttgaaagatgatgcctcataattttattcctcctttgatcagataggacattttgtttagtaaaatttcagaagacagattcctgcttcctgattggcatcaattatcttacaacacccccaatttttttggaaatgtatgcctgccaactctttatttgaagagttatttgcttgctttggcaaaattgactcttgatgagtgttcccctcttctagcatttgctactcactaaattttcctcgtgtgtgctgatggtggtaaaaactcttgtcacctttctaatctgtttggtaaaccttatctttgatacttcattatgtaaccatgggttctcagttctctctcgactcttaccctgcagctttgtagttacaaggggaaatatgacagtgagaaaggaagaaaatccacagagagagaagagactgtgcactgaactttttcattaaaacttttataaactataaatagctcctttcacctttagtcaaaggaaatatcaagaaggcctgtagggtagctccctatggctgtttaaaaagtgtttgatttttatggaatagtgcaaaagcaaattgcaaagtcaatagaaacaggaatactggagaagaattgacaggaactgataaaattaaggagtgactgagaaaatgagtctgacagcccatggctgatacagaagaaagtgccagactgatctgaaccaagagaaccaagacaagtacaagccctcctgcagaagtacaggacccaggatgggagtctgtggttcctaacagcttagtgcctgatcacacttaaacatacattatgcttatcactggattgcaataacgcttgctttactgaacactattctaagtagtttgtacatcatttagccctgcagcaaccctcttaggtataggaactattctaagtattcccataagattggtaccttgcccaaggcttggatcaggaacacagatttgtctgatccttgagtttacattattcttaatctagctgttctgcatctgactttatgttgaagttagtgccccagtgcacctgtttatatggcttcatctgtgatgttttctctttcctccttatcaaacctgttttaaaccttagagttctgagttaaataaccttggtgggtgtggcaggaaatctctgaaacaaggtggatccatgctgcattgtgattccttgcattcaggtggtcctgccagggctgcaattactaggtgcccttagacggaactagttatgatggggtcaggcagaaggtacctctgtgtttcatgtgagctgaatctttcctaaatgattaagagaaacagtggttattgagggaatcatgtgcttcaggggaggactgataaaactaagttaatctattaggcctttgtattgtgataagtaaaactttactttccctaaattagaataaatattggggagaggaagagagaggtgtaaagatggtctccaagttcctggtgactagctgttgtaacagtccccaaagctatatttttcttaacataggtggaaaaaaagtttggttgtctgtgtccagggcaactaggaaaaaatatgtctctgtcgccaggctggagtgcagtggtgtgatcttggctcactgccaccaccgactccctggttcaagtgattctcctgccttagcctcccgagtagctgggattttaggcatgcaccaccatgcccagctgatttttgtatttttagtagagacggggtttcaccatgttggccaggatgatctcaatctcttgacctcgcagtccggccaccttggcctcccaaagtgctaggattacaggcgtgagccactgtgcctggcctgataaaacacatctttgaaccatatgttcaaaccgtacttggagtacttggcagagtacttggagaccctggagtccatccagataatcttctaccagaggggagaaaagaacctttattcataaaggttcaaattacagaaatcattcgaatcttctaggctgtgctcctatgatattacaaaagttctttgttgaattatcaaattacatccatatatagataataactctggtgctaagagtgatcattgccagtctgtggatatacatgcatctccaacccccagcattttacttattgaattctctgtgactctagtattcagaatttgattacctaaagtgaaaatctgccaattttgcctgatctgtcattctgaggccttctcaacttgaactcccatagtatttttctcttaccttttctatgacaattattttcatattatatttatttgtataagtatctgtgagagcagcagttgtgtctcgttcatctttatacctcctgtagtgattaatacaaaactcaataaatggttggtaaatgaatagaacacagaaaaaatctttcagtcgtgaaatacagaaaatgtagtttactttacaatgtcttcttagcactttctttacatattccacaaatccctagtgtacttctttggctttttccaaaatcccctcgatattacttgtttaatttttaataaccctttttccttcgtggccagaagcctttaaaggtcaggatcggtgcaacaaaccactttcagtttcacattttttatcacatttcttagctacttatgtgtggcagtatttaccaacaatttgtaggtggtatctataaggatagtcagtttatttcccattaggtactgtgcctaaaatttgagcatgtgttaccacagcaacttggatgtctggttaaactaattggtcaaagcattcaggcttcctgcaagttcagataactgattagtagctaatgttctatggctttcctctataaattataagaataaaaatgttaatataataatactcaatttagtacaaatttttatatagttaagtgtgtgaagtagctttgtaaaaaccttgactgctattaaacccatcctttcctaccattatataagttaacatctatcttgtatctccctttcctagagtttaaaacaagacatctattaagttatttattctacttctggtgttagtggttcacagtagctccgtatcctttctgtacatgtatccccatgggtaccagcactcttgattataaggagctgaaaatcaacttgaagtggctaaagaaagaaatagatttattgggaagagaagtattgcaggatagaaacaagagctgaacaactgcgctttagaaagtcaggcatccagcagagctagcacctcagcgggtgctatctccatgttatcagtgctgtctgtctctatgctaccctcatctcctaattttactacctgatggctttagggtctgagttgagcttctttacaggtcgagagacactgccactggctgcctctaagcgaatgctttctctgctttgctaccatcaagggtggaggggaggggcgcaactgagctctggctgaaaaagtcccagggaaggattactctaagttggattccttgtctgttcctggataaggtgcagccctccttagactgcagtggatggcgtggggtggaaaaaccattccccaggaagagagaaaaaatgtgctggccattccaaacaattcggttctacttctttttaagaaacaggaacctatcctattttaataaacactcagggaaagcattccacaagggatggcaaaaaggattcgactaatatttgggtgctgctgttgtcactatgttaccgaatacaaaagggttgcagagtaggttaaagcatttcagagttgttaatatccctgtgacttatgcatgtttgtagtgaacctgatttcactctcacccagtgatactgaactgttaaatgatctatgatgaatcttctttagccaaaagcctttttttggttttctttctgttattgaagagcgatgcacacatggttttggaatgatctaaattatatcagtattagcttgaaaaggcaaatactaaaacaatgccacaggaaagtcaattaaattatatagggatacacattttaatttcagtttttaatgtcttcagttggttatcctttatttgtcctaaatatttattgtcgaatatccagcactgttaaccattctttcccaagggcctgcttcctattttatttcttaggtgtatgtagagtgagacaaaagaagtatattacttaacaaatactttttatttgagtattttcaagtatgtactacataagtggcaaaggttttctagatttaaaactgtcaaatgtaattaaaaattatttctgtatgtttatttggcaggctcttttaagagggttttcttccttttgagattttcctaatttttcaaactaagtgaaaatttggaaagctgggacaaagtccctaaaagcaataaaactcacttataacccccaactagaaaatatgttttctgttgttgttgttgttttgttttttttttccttttcagagtttattcagaaacttaggtaagtttttgcaaatgagacttagcttcttaagcagttttttgatagtcatgggattgtagcctctgtcctcaatggcattttgacaccaggaagagagaaaatcctcacatcttttctcagtgccatttgcctttcttcttgatgctatcccaaggattttatgtctgccattgaggtcttataatttaattcacatttctcagatcatattagtgctatacatttggaactctgtgatactgttatttcgtggatgtggtcataataaaatcacttttacatccggatcttctccatgctacacacttgaggcatgacaccacatcagaactccagttgtgtttctgcttagggtgtaaaaatgaaaaactgtgccgtgcccatgtgaatgcccatgcattttagatatcacctgaataaataagtaataaatacataaatgtgcatgtatatgtatgtagaaaccatatgtatggttgatatatagaaaaccagtatctgttttaatgcagacacaagtcttttgaaacaagggtttgtaattgaattaatgaggaagcaaaaactgagatgcagacaaattattatccaggataatttgaaacaagggtttgtaattgaactaatggggaagcaacaactgagatgcagacaaattattatccaggataattgagggcatacaaccaggaaacacaacatgtagggatgaggacatttatttcataaaaaggagtaggctgagccagcagcggtggtgcacacctgtaatccctgctctttgggaggccaaggagggtggatcacttgagcccaagagtttgagaccaacctgggcaacatggcaaaatcctgtctctacaaaaaatacaaaaattagctgggcatggtggcatgcacctgtggttccaattactcagcaggctgaggtgctgagtgggaggatcacttgaagctgggaggtccagcctgctgtaactcataatcgtgccgctgtacttcagcctgggcaacagagtgagaccctgtctcaaaaagaaagcagtgccctgaaatcagatttttttgaaagccaggcaaaaataagatttttaaaaaatgatagtctgcatctaccagtttctgttatagagtcataattgtcaactttacacgctgcttcttgacaaccttaacaatctgaagttcccttgctatagctctagctttggattttaatttccaacttagatgaagttcataacaaaacattttttcacctgaacatattttctgcagttcatagggatcagcacaggatttatctttagccaagacatgttacagcatccattgtatgcaaaattgtatcagcaatgtagggaatgcagagatgaagaaaatgtggcatgtatgtgtgtttattagaattgtgttgtttttattagtgttctggatgtgtaggttttgaatggtcttcctcaatatcattttccacataagtcctttggtttttagggtgtaatttaacagaatgtaaagttttgctgggaacagatttattgggttgtgatagaatcacctatgtttattgataaagttagttcttttttcccctacagaatcaagaaaacactcaaagttgtataatattaggaggaaaatctcaacattgccatgcaatgtcgtgcatgacatatggataggtttggtattgtggttaagacatggctgttaaacattcagtttaacagattcctccagaatttcacggtgttttgggaaagtattttagataagtgacatttcttcaaatatatgagattgtaagtagtgagtgacatcagaagagaattaagtcataaagtttttagggttcacaaaaaggttggggtttaggcttactaaaacaaaatgaacatttaaaaatcaataacatgaaattttaccataaaaatttacaacataaaatagattactaatatattactaaatataatctattttaaaagagaaagtatttgctagggttatatggaattataatcatttgaaaagcaacttatttttggaaaatttctgttttctttattacttttgaaaataaatttataattttttcctttcttttagacttaaaagttttaatgaagctaattcataaagtagctgattattatagttagattcgtatatataaagtactcttttcttccctcatatttaaaattttcttagtgtttctttttccttgttctgttaaaaaaaagtgttttcccttcacaggcttttggtagaaaaggaaaaaaaaagataaagatagaaaaaaagtaattctctatccctttcttcagttcttttttccaggttttaaaaaattgtttggccccacctgtccttcagaccctatttatgtgaagatcagtcatctggcagcctcttgtgtctgagatagctccacgaaggctgacatgaaacaagggtttctgagtactgcagagcctgtggagtaaggcctacatgttttccactcaggagaaagttcatggttctgctttgaacccacctgttgactcgagccattcacaccctcttctaataagcctgattatctagttgcccaatacggggatggctgaggaagcctgtagcaagaagactgaggagagtgtggtgatattagaaggaagaggcacatatagggccataataagtcgattttgatgctaaaaagagaatgaatcataaaaatgaagcagaagaacacttagatgtcagattattgagattaggagccagttggccctgtatacctactgttaaaccccgagggctgctgctgatgtttataattggccccatcatcagttgaagattagattgtgtttattataatctcttttaaaagtcagggaagtgcatactactttttagaatttaaaaaagtctcatataaagacaggcatttcaaaggatcgatttttgtttactcacaaaaatgacctagtagatgttagtcttgtttttctctctgtccactgagattgtttttacaagcctttttgtctcttctctttgaagctataatttttattttaacctctactgttgttcttttatggcatagtttcagacatctcaatggcctctaataaagatattcttaacaccatagattgtgaatcctgtatgacataatgattaatttcctgcagctttgcgctctccctgctctctttacttctgctttatagtcagacttggtgtctacatgcttgttgagactattattttcccctacccattcctcaagctacccatccatttccactctacatatgtccacagaatttgtttgaacttctgtcatcagcaactcttcttactgtttatttattcagcaagtactgagtgctgtcctaggggctggggaaacacaggagaacaaacgagaagtccatgctcttaagcagtttacattctagtggggaaggaagacaaacaaagtaaattaatgaacaaaaacagtgtaatgtgataggggagggaggagcaacagcagaggaaagccagagaaggactctgaagaggcaatacctgaggtccaactgagtaatgggaacaagtcagccaaggggttatctgggaagaacattctaggcagagagaacagcaaacagaaacattcctgagaaaccagctttgaggaaaagaaaaattgtccattgtgactgaaccatagttggatgagtgttgtgctcagatccacttggtcagtgggtgcctagggtgaacagaagtccttcccgtccaggtctcagtcagtgactgatcagcccagggatacaaaagcctggccctcttgcttcaggggagactaatgctgggtgtagtttttgtctgaggccacattcttccttggcttttcccctccctgtcctgcctccccatttcttttcactgagggcactgcccccaataaattgtaagatctgggcccagctctgtttctaggaaaccctgacctaggcatataagcaaacttttgatctatcatctgagctccagacccttagacagctgcttgtgcaacatgtccacttggatgttcagagatacctaaaactcaatgtgtaaaaaattgagtttataatagtttcctcttttcctcaagcttgtattcttcctgtgttcactggtttactttatgaaccagccttttacctagttatactagagaattcagtatagattttccctttccatagacttcatgtccagtcactcagcaggtaacccatggtgaatgcctcttacctctgttgtttttccacccacattttcatggctttagttcagggccttgtctgaaacactagcttagcttcccaagtggcctccccacttcccttccttcacctctccaatccatttctacaccattaccctgtcgtaagatgaaaaatctcatccagccactcttctgcctctagtcctgtagggcttttctattggataaaatggcaacttcatataggataaaattcccaactttttagcatggcttacagggccctttctgccctggcattgagccacctttcttctgagccttcgcagtggtgaccactgtgagtatggcttggttatttcctcatacagcttccagtttcaggcttcatgctattccccaaatgtccttcttctcctgggtagtactggaagcttcagctttacgttacctcctctgtgaagtctttttttgagccacctaaggaatattatttatactgaatagagcactctcaaaatactcatttcagtgtattataatcacttgctttatttctaatcacttaaggcattcattgaatgcagagcacatggctcttcacattgctaggcacattagcacgtttgctgaatgaatagatgaaagattaaaggagaaatgttactgtgtttgttggtttttatacaagatatcttagtgaacacaaacattgtacgaatgttaggggaaaggggattgcctaagaagaacctttagccctaaaatttggagttgggaaattcattaattttttaaatgttaatttaatatttgctagatgcctagcattgtattatgtggtatttaagtaaattttgaaaaatgcaattggcgtgatttatcaagggccttaaaatggggaaaatgccaacagtacaagagagttttatgaggtggtgtatgattaaatcttgaatgactcaaataagaagtgctgttggttctggaaaaggtgtctttgtgggctggagggataaccaatcacaaaaaagtcaggttcttgaaagacctgttgaagtctattctgcaaaaatgatgctcatataattcaatagttttcagatattaaggagatagctttctcttttgactttgttgaagatgaaagtatgtaatatttgtatttgaacaataactttttaaaaagattttacatgagcttttgtgttgtaagaaaacaaagttgaattatcttcacagtgtcattcaaaatgatgaaggtgaagatagtttgcaagtgggagaaagaagagatgattcatttaaaccaattaggatgtgaagggaaaacactttgcctgaggtttctcatcatcattgtataccctagtttggggagctttgggaatatcgaccacttatcattgacacagtagttaccgcctcttgtaatttttaaaatacgtgaatatttacaaggttagatttcatgccttttttatttcttgcctaaggtatttctcagttgtattgttgtatcttaatctaatttatgtccttttgtgattctgtgtaccgaggacaggaactcctttaaaaaagagtggatcaaccactctcctgtaggggtcgctatgagagtagcagtctggcatccttcctttgccgcctagcaccttgtggcatgacttggcacaatttgcctaagggttgtgagatctggcttgttttggtattttatttttcagaatggtatgagctctaagtccaccaaaaattctgcaagctcataactatgcattcttttactttggttctgtgtatgctgcatatgctgcacctgtgctttttttttttaaccacatatttggtgcgtggttattttagacttctcatcatactccatttgcatatgacaaatatatacacgtagacaccattttagcagcttttgcagcatgcatgatggtggctgaaacttggccttctataggatcccagattattatttaatggggttgtcactcaggacacttactggctttctccagtgctcttaaaaaattgaattgagcatgatgaggtgcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacaggcaagtccatcgtgtttggaaaaaaaaattagattttttggagaaaataattgagctgttaaagctattgatactgaatgttagcatgtcctttgagttcttctcaacagtttttggtcttattccactgagattagcttctcttaggggatttctgggcttttttttttttgcttgcttatgcatccccctctcttggttgtagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacggtaagacagagcatgcttaaaattacaggaggggttttaatttggagcatctcggcaagtctgaatcctgactcactcatttacaacttaaaaaggattcattttatgcatgtcattttactcacttccttctatttaactgccagaaacatcacagattgataaagggggtatttaaattagagactgactggaggttactcatgggagagtcttttgaggctcccgaggctactgcttgtagtttgtaaacaccagtagcagtgataagatggggaaaaggtttaacgactgcttctttgccatatctgagtcttattccttctgaaactagtctttatttattacagctgaaagagatcttacatttttttttgcctggctgtgcttggctgaatgccctctgagtcaagcaagtgaaggacgagagactactttttccatttgagtaaactgatgtccatgaatttagctggattggatctgagtagaataaatatctctaatatattagagacctggggcttcctccctgctcatcctatttccttcctttttggatcacagaaatacacctgctttaagtgtgtactgctgagcagaggtcagtgtgctggtattttgcatcattacacctgtagtggttatgcttttatgtacagaagtgataattcttcgtgcagttctgcgtgaagtgccagctctaatagtagactattagcattttggatgctaatggagaacccctgcattcatgaaggaccgtggtagcagacagcctactccaatgaggcttacctgcttgtaaagcagataaaattgagagataggaatgtaaaccttgacgtcttcagagactgaatttttgtttcctttgttaattgtcacacagttgacatatttgatgtggcgggggtttgaacttgaaggacatgttttaatagtgttcaaagtgagattaataacattacttagtcctagtgactttatatggatccacctattattatataggtgctgaatgttaaggatgtcagcatttgattttttgctttaaaaatattccacttgtgtatagtttaattaacttagtactttatgtaaaatgtagatggtgaatgttaaaaaaatcagtagcttgcatgttggctattatacagaactggcatgtagccagttctgtataattttgtgacataagtaaatttaagaaagatcgcctgattagttgataggctaattgagagaaatatgggtaactgttgtggttcactatgagtaaatttctttaaatggtgcagtgcttctgtattcactcaactatttactgttgaggttggacattgattgttgggagtgaatatttggattttcttccaaagatagatcaaatttacctctctttttttttaaactttttttttctgtttggaagatgatgcgccctgtgtttactgtttctttttctgagaatcttgtgttttagctattcatatttttacctttactttgtgtgagttgtgaggatttttttttcatcctgtgacagaaggaattgtaagtttgcgaaaagtaatttttaaaaagtagagcaataacgtgactgattttacaatcatacgatatttctctcattctgcaaatattgattagccacccactatgtgtaaaacattgtaagacctgctgtaaaggaagtatggatgaaacagtacattttcctgaagaagcttagatatagttgtgttagtattttcccctggaatacgccccattatactttctcatggatagtcagtttggtgctttttaatcctctccttttaaaaaagcattttttggttaaacatttttggagtctgttgtgtaatagtggtgagtaaaacagatctagtcctggttcttatggaacttatagtctactatgtttttttttttttttttcaattgagccgagggtctcactatgttggccaggtttgtcttgagctcctggactcatgtgaccctcctgctttggccttccaaagtactgggattacaggcattagccactgcacgcagctacagtctacttttaaaaatatttcaaagagaaaatatgtggcaagtttttttttttcattttggtagttatgaaggagatattgtatgctttgatattttttattgtggtgaaatatatataacacaaatcttgccattattaccatttttaagtttataattcagtggcattagatatattcacagtgttttcaaccatcaccactatccatttccagaactttttcatcaacccaaacagaaaccctaccctgctctcattaaatagtaactccccattccccttccccctgcccctggtaatcttattctactttctgtgtctgtgagtttggcattctaggtacctcatagtagattaaattgagtcatatgtattttttcttttgtctctgccgtgttttagcatgttttcaaggttcatccatgttgtatcatgtatcagaatttcattccttcttaatgcattctttgatttttatatgggatagacagcagtttttcctcatatgatgacatgaatcaagttcctatatggacatcgtaataaatactttagatatactaaaatagcctatgggaaagggcaaggaataaggaatagaaatgcactgagaggaagagttatggatatattatatattattttcatatatttatctatggatgtattataattgagatgctaagattttcacatcaattctttgctgatagcagcattcagctgaaataattggaagctgggccatggcttttgtcattattaacatttgaatttcacccactgtacttgtgtctcctttctctattttacttcataagcaaagactgatcatgttgaggtcttcttacagagtcagagactcttagagctggcaggtactttagaaattgtgttatttaattggttcattatcattcattagccaacgtgagagggaaactcagtctcctgctgcccgccatgggccttcttttactccccacccctgttttcagtggaaacaaccagaaaaccccaagtatcctctgagtttgacagaaatagtagagggtgtaaatttgatgccacattaagaagttttccgttggatgaggtaagcctagcttcatcaatacagctttctgtttctcagatttcttcctgatactgcttccataaatccagatggtttttctgaggggaccctttttagaaagccaagttaaggcctcagtgctgttcatttattttctgtcgaccattttgacagttcttacactgggtcagtcagcagtttatatccatgcttttaactcactatccaggggacccaaccatttatagaggaagaagattcaacatagcaatatccaatacctgagtcttcccaaataagcctgctccttcttaatgggtcttgctttctatccccctaactgtttttctgtcctcctaactgtttttctgttatggcctgacttttattatgagactaattcagaatcagattaatcaaatgcatgttaaatttgagtggtaggtttgtggggagagagggaagatgggccagaaaaccttaaaccagtgagcagttattttgcacagctttggaagtactttttttttttttttttcatcaggagagataagagagaatggagagaaatggagagaattgcagataaagttgttttttgtttacttctctcatgatgtaagtcccaggggacatgtacgaaagacaatacagtggtcaagagcttgtgctttgtattcagagtcctgtaatcaatcccatctcctgtgtttattttctgtgtggccttggacatgttacttaattcatgtgtgcctcaatgtaaccatctgcaaaattgagataatactagtcacctttcttatgaggttgttgtagagattaattgggaagctatttttaaagcatttttatagtaatttatgtaataagagctcaacaagttagccatcatcatcattgtcatctcatctagaaatccttgatttccatctcttttctatcagctgcattatatcttgcccaagatccttctgtagtttgactatagagcatatgtaattatttcttagtgttattgagtctgagtggataaaaggaggatgtaacagaaagctccaatatcctgtttatcatctggcagactttggaagggtaaatgttctttagacttacttttcggcccagttgataacacatttgccccagcagcttattcctcaggtaaatgaaatcttgctaaaaatacaaagttgacagtgaaacgcttctggaagcactggggtttgttttccggtgacagacaaacagcaggatgtgtgtatcccactgctgtgctctattcaccttgcatctctcaggcaggatttggtattgacttttctcagctacaggaaaggtttacagaactggtcttcatgaaatcagttaggagtgttattaatgggttactgtcaaatttattattgctgaaattttggctctttataatagatgaatcaattgttaaagcaacattgaaagatacttccattttctcctcaaaggttcattgttcccagtgttcctcttcataagctctgtgtggttagtgacccatatatgattctctgaaaatgttaagagcttcaaaagtcaattctatattgagtgatgccctatattttcctgaacactttgatggagtttgcatctagatttattttataagaagaaaaacattaaacttttaaactttataacatcattcttgacatcaaccactaaattattatccaagcactaataatacatttatattttattaaaaagatggctattgtagatttggagatgtatgttgtatttatatagccatctgtttcggagtaagaagatagtacacaattttatttctcctttagggaaggaatttaaaaatatttataatctttatttttaaacgctgttcatatggttactgggggaaagaattcagatcctaaaggatcagtcatatctccagtagtgttttctcttcagttttcatgttttaatgttattgcaccttctggatgctgtattttacatgagggacagaatagtgagctacagatatttgaaaggtgtagacatgaaggaagaactggcctggtttagtacaaagaagccaggggtggtttagtgaaactcaaaagtgaaaacaaacagaattcagaaggcacttgagactgtcttttgcacggcctttgagacaagtgagcttctgcagtccctgtgatgtttaaaaatacccctcaaacattaagcatatgtgtgtataggtagaaagcgtcctggaccatattattgatttcaagtctatgaatctgagatcagcctcttgtgtttattagtggttagtgcttctgacatggtagacatttttagtttttaaatcagagtagttaacagtcagtccccttcgccagcttagttcatactgctatatgttgtggagtcctttggaaatacactctgttttccccttttcaggtagaacccaaggcaaaacctaaaaaagaaaagctatatttaaacctgtaaatcctgtgggagagggagaaaaagtttttatttgcaggaatagacctttttttttttttttttttctagagtaagagttttaagggaatagtgtcttgatgaagaaactaattagccatgcagtgtgagccactgtgtagcttgatttttctattttgtagagaataggtattccatttccccagtgcagctatgggaattttgtagattggaaaacgctgtgttttgtagaatctcaaaacaaagtcacccgcttgctctgcttggagcttctcatctcttgtgtcccatttctgagccctttggctataaatgttttgttgaggggtggggggaatatagatatcaattttaatatttcacctcttaacacgtaccatttggtcgtatgatatgaattctgcactcctgactctgtcttttttccatgatggcattttaaccagcatataattgtggatgtcaactggaagtcagaaaatgtacataccttcttctttctcttgttgacctttttgggatatttaatgtttttagtggaaacagtgtctgaaagacatctcatctggcttttcacataatcagagtaggatttaactggagtgggaaatgttcagttatgccatttgggccaaagactcccctcacacccacaccaaaggaggacctgttttaggatacatggtactcttcacaaatttaagttccttttcaaatttcttttctagatcctgaggtgacttccttctaagtttttcctccaaagctaccaaataaaccctagtaagtagtaagcaaagcaagattctgaattcaattctacttaggataattttgtagtaattgtttttatagatatgatggctagcagcaaaacaatgttcctatattagagacacatacatctataaatttctatgcaggaagtaatgtcatatatgctgctataacccatgtatattctttcttctctactcatcactcattccaattccatggttgtttaaattcataaacatattggatgtatattattgcacattttatttcagagctgaaaatatattgagttatctgataactaccgtgaacttttgagataagtttgagtaaaatatgttaccgaaggagtagtaaaatttttatcactcattgtacacagagactgaaacaaattttccctctaaatttgccctctctacaatcacaatctcttattggaccataacagcagaatatatcattacatggtttagtgcaccatgtctcaaatttcaaggtgcacacaaatcacccagggatcttgttaaaattcagattctgacttggtagaactgcagtgggtctgagatcccagtgattcccgtgctgccagtctgcaagcagcaaggggttaacttttccagatgaaattctggtcacaatgctaactacattctgaaaaacttatacagacaactaacaatagggctggttgttagtaattctacccttgctatgagtgctcattaaaaccttacgttaaatttatcattatgatttggacaaaatgaagaagtataggcatcaaaatgaagaagtatagaagtcaggaagtataggcatctacctatatgagcctataaacaaaactgtatctcatctgaaatgtgtaattatcacagaagagaaagtgactaaataaaattattttaacaacatataccaaagcttaagcttctggaaagactacctaatattccataatagaattagcaaaacagttatcaagcctattgatggcaagcattgaagtccagtaagggatgtaacaaaactacagtcactgaagcagcgtaaaggtcactgaagcagcataaaggaatgtggtgtcctcaagagtcctccattcagcagtgtccactagctgaggaattcaggatttaagtgaaattgggtcagatgccaaagaaaccatgtagtagaaaaataagcattttaaaactaaatcgcaatgttagacattgaattctgatgaatggaaacatctggtgaagtgttttcatgactggaaaatatctcaactcagaaggtaccttgtttttaatgtagtttctcaggactaatttttttagtggcctatttttagttaaaggggaaagcttataattagtaaaacaatccatcattgagtaaatattaacagaactatttcatgcccggtcttttgtgctttgggaacactaaagaaatagaagatatggtttgtgtgctcaaggtgtttacactctggtcatggaaatacaaacacgtgagaaacagtgctcagcaaagacggagctccccccaccccaccaaaataaaccaaacacttgaaaacaaattctacagtagcttatataagaatatataataacatatatttcagtaacaaattataaaatacaatctaaaaatgatgtagttggtagtgagggcatttttggttgtgacagtgacaatgatataagggcaggactagcatttagtacacagaaccatggttgccagatgctctacaacgtgtactgctgtggaaatgctgcacccaaataattttcagccaaaatgcccaggatgccaccactgagaaacagtgccaggatgtcagagttaaggaaaatctgaaaagactggagacattaagagaagtgtatacatggtatgtacctgtctttgtcctttctaaatcctaaaattctaagggaaagtggaacacaaaggaagcacaaagaagtgaatttatgtgtgagactttactagttgacctatctaaaattatttaccagctgcaaactgctgcctaaagttcatagtagaacattagagctaaaacagatctgtatcattttacagatgagaagactgagatctggggaatttaagtggcttgtcttgaggcacttagttctgacttctatgggcagtatgtttgcatgtatattagataatgttctgaaggtgactttaggcaagatcttggttctcataaaacaaagctgtaagtaaaaaacacattcttgcatatatccttctatatgtgtacatatctttgctctgtgtagccactcttactgccatctctgtgtatacacacatacatacacacgcatactattagggagaaaatagagaagacagcaagcaaagagaggaaagcatacttttagatttgacagatttaagttatagatgaaggcagttatcattggttatgattctagtggcaatgattctaattcttcctacctctctcttctacccaaaactcttgcacatctatccttaatagctgaaattacttttataagggagaaaacttgttgttctgtaacgcttaaagttcagataattctgggagaggtagtactacgatttaagtgctcaaaaacttataaatgactgatgatttttttatattgggagcagattttgagtaggataaagccatcaggccctcctggggtattggacaaagggaaaaaaacaaatgaaagaggttgtcaagatttttgcttatttcatagttttgcattggacctgtgatggatattcctttcatgaatatcaaaagagcatgacctagctacagcctgacgcatgatacatatttgctgtgggttaacctggagtcttttaaaccaattcttttccagtgtctgccttcaactaacagtgtggagtgaagtagtagagaaaatcagactctgaacccagtaaaatgctgatcaccagaaaatgggtgattcaaagggacaattttcagaccgaatgaattcacttgaaatgaatgccaaccttaactgaattaagctgtgctctttcaaatccactgctgtgagttcagtagacagttgtctggattttacatagctctaagctagaatcgtaggtcaaattgtgacttttggagcctcatacactgtttgaatttctaacaatttttactcaggtttgagtttgccagcaaatgaacaagttcctgttaataatgagtagaccaaattaatcgcttcagatgaatatccatatgtgtgggtgcatctcaaagcaagtttgaaattctagcttctattgaatttactggaaaaaaaagtttattttggtatttgtgatgatttcttctttttatatgttttcgaataccaggagacatccctgcttatgtgatttttgttacttcagtttctaaatggaacaagtagtatgaaaaagtacagtcatggagaagactattcttagttctcattgatattagaatttctgtcttgttttcacacgatactgatagcatagctgtctactggaatttgccttgggcagaggtgccaaagatattttcttctggacccatgatttgggaaaaccatttttaacctgtggaagttccttattttccacgagttaatgaacaaatctttactggactcttcaagaggagattcgaagggaaaagtactttagggggctataaaatgaatataagacagtccttgccctgtggaagagataatcaggttgttgacattaaagtatcacaaaaagaataattacagtctaaggtatgcaaaatattggagcagactaaattcactgaagtgaattcttaataaaggattggtccgagtgggtgggatttaatcaacaagtgcatctaggcaaaggcaattttggagacaagtcatggcttggtgggaggaaggttttcaggctgagggcggtaagaaagcatgtgtgaaggacagtgaagctgacggacagtgcgtagaatgtctgagggtctcctgtatccagaatgttcacagctcatggcctttgtatttggccaagtgcccacatctttaagaatgtatgtagctaagaaatgtaattttgaaaaccaatttgtttctatttaagcattgtttactgacctaattaaattcccttaatgtcatatactaatttagtgtgactgattattttgacatattctagatacttttaaacaaagaagacatatgtaaatgtaatgattgcaaattattaatatattactatacttattaacagtgtgggtttatgtaatcttattattatttctctattcttttttatacctttctagggttatagatctacttatttagatttcttccagggagttcagtaataatattttttgtgtctttttgggattttgtaatctttacaggaccacaagtaaaagaattccttctcagaacagccacggttacaggatctgagttattgactgttggggtcctggatgcttttttcaagtcagagattcacatctgagtcacgggttggcagttaagctgagttttctttttaagggttaaatttcatatgtattattaaaatttaacttctttaaaaaaatgctttccacactggttcacataggttttctttttaatcttgtttatctccaccagatgtgtactttgtaatacgttgcttaggcaacatcacctgccctttagcctgttgcattacatccacccacctggtctgctgccattggaacatgctgtgttgcttttctttctacactcatgctgcttggaccctccccacaggccctgatcattcattcctgtccttgatacagttccttggtactttttttctagcacttcttggcttactcacagttctgtatcttaaaatcaaccatattgtattatattcatacttcttttatattatagctgccatttggcctttatagtaacttttctcttttgaaatcataatgaactcatggtctttcagcaactcatcttgttctatttaaccatacttttatttttccttttgatgctcgaataaataatcacagtttgatcgttgggagctcctttaggcagattcctttgtccttctagcacgatccctgacatttttgaaaggatgccagttttctggtaacagctggatgtttcctggctctttcacacttcctgcactgtgaactggaatctattactttccaaagatttcttcctttccttactggagaactggaacataggccaaaatctgggcactaggggtgcacatgaaagttagtagtggataaaagggctactgtttggtggttggaagagtctgtgtttttgaggtttgggttctcagtgattttttccaatttgacattccgtacttctgtctctgagtttttttaatatatgaggttttatcttttactaagaccttttactgcactgaccataagcattttgctgtgggcagaaagattctatttggggtgggaagcatttattcagattgctgacaagttaatataagcattcaactgaagacttgtacgcaggggagtagcgccagtgtatactgcgtcctccagagccctctttcattgctaagacccaggctgctcgcttttctcttcatgcactctggatacttaaatttattctaagagctctcctaccctccccttttctcccctcttacccctcttctcccttctcccctcttacccctcttcccccttttccattttctctttcccttcccccaccctttcccctttcccttttccctttttgagatagggtctcactatgttgcccaggctggagtacatggagcatagtggcacagactctgcagctcactgcagctttgccctccctggctcaagagatctgtccacctcagcctcctgagtaggtgggactacaggtgtgcaccaccacacccgcctaatttttatatttgttttgtagagacagggtttttccacgttgcccaggttggtctcgaactcctgagctcaaatgatccacctgccacagcttcccaaatgctgggactacaggtgtgtatcaccatgcccagctaagttgattgttttctacttttattttgtagtttgctagtagttagcaaaaatggtaaacgtgaaatgtttaagaatatttatgggaaatattttaagttgagaaccttgttaaattttttttttctcaaaaattagggaaaggcggccctcttctgtcttaatgatagaatactttagagatgttggtttttcacaggtgcatagtttccactgatttttataattatcaactgtgccatagtcagatccattaaatgagagactacctgactcaaagtatgtattgtaaggccgttaaggcatgaagatggagagaaagctgtactttgcagtagattctgtaacagtttctcttgcttaaattgtataggttcagaaagccatcagaatttctaattggagttcctctgtttcctgaagccaacaaatgactttttttgctttattgtattttctagaacttaaaatacaatgttaaatcaaagtgtttgtgaaagtggatgtccttgaattttccctgtttttaggtgaaaagcatgtagtttctcagcattaagtatgatgttacatgtaattttttggtagatgctctctatcagtttgaggaagttttactctgtttttagttggttgagaggttttattgtgaatggatgctgaatttatcaaatgcttttttctgagtctattgagatgatcatatgatttttaaaaaactgtgtattaattgcttcataacaaattatcccataacttaacatcttaaaacaacatacatttttaaaaaatcttagttcctatgggtctcttgcagatgctccttagctggctcagggtctcttatgagagtccagtcaagcaggaagctggaactgtggttgtccctgaaaacttgactcacaaggttgtttgcaggccctagtctttctgcacaggtgcctctccacagggctgcctcatggcatggcagccggctttccccaggtctggtgatctaagaggggatactcaaggcagagagagcaccaaaatagaagaaacattgttcttacaatgttttctcagaagcggtatcctatgatttttgccatattatatttatgggatacaagtcaacaaatgcagcccacactcaagagctggggattacataagagtgtgaatacttagaagtgggtgttattgggagccatgttagagactgcctaccactgtattttaaaatggtgaattacagatttgtgaatgttaagccaaccttgcattcgtgggattagtgtgacattgtcatggtttactatcttctttatatattgttgcattcaatttgttgaagatgtaccagtaattttttgcatctgtgttcatgagagagattgatctgtagtttccttacaatgttcttgtgtggctttggtattggaatgacactggccttataaaatgaattgggaagtatatcctcttcatcagtattttgaaagggtttctgtacaattgaagtcatttcttcctttaatgtttgttttaacttcaccagtggtgccacctggccctggcattatctttgtggtaatgtttttgaccacaaattcaattcctgtcatagacacaggcctattcatgttatctatttttttttttaactgagtgagctttggtagtttttgtctttcaaataattggtttcatctaagttgtggaatttattggcacaatgttgtttgtagtatttgtagaacatctgtagtgatatcactgctcccattcctgatagtaatattggcgatgtatattttctacttttttttccccttatctgtctggctagatgttcatcatttaaaaaaaacttctctgaaaaccagcttttggttttattgatttttctttattgttttctgttttctattttatttatatccactttcttatttattatttcactcttcttatcttggtttttatttgctttatttatttattttttttttagtattttaaggtggaagctgaggttattgctttgagacttttcttcttttctctagtcatttagtgttacaaattttcctacagctaaagtactactttagctgaatctcaccattttcgtattttgtgttttcatttttatttagtccaagatgctttctaattgcctttctctattaatttagtcatcaactattttctgtcatccttatcttttagtttctattttaagtaatttgatttcaacgtgcccttacatttttttttctttcaaattttctgtgtttgcagttcattgacttctcaggcccatgtatttataatttaattgctttagtgatgtgggtggtttcttatttactgccttcatgtccttaagaagagcacaaaaacccttaaaaatattgcatgctccaacatacttgtaattcatttttactttttgatcatgactagaggactctgccttgagtcttttaaaaatatcttcagctgttttctcacatgctaaaaagtatgataatatttttctcatttgacttagttagaattcagcctgtgcttagtagttgagacatactcatagggttgatgtttaatgattaaaaactttttgtttcaaaaacttgaaatggcttattttaattatacatgcttttctactttagtggtttttaaaacattacatatgttggaatatttattataaaattcacacaagagtgtaccaaaaattgctaatcttgcccgttcaattccacatgtctggagatatctgatgttaatagtttggtggtgtgttttcctgtatacttttcaccatgctcatacactcacaaatatctatatctatgcatctgtgtctgtatttatatctgtatctgtctatatctatccatatacatagccgcatttataccccacatggagtcattctatacatattagctctgtgtatctgtgggttctgtatgcacatactcaaccaaccacggacccaaagtgtgtattcaaaaacttcgtatttttaccttaacagtgtgggcttttcataaatatcttcggtttttctgcttttgatagcatatagggatgtgggaactttttataagaagaaaagcattctaaaaacaattttatttagagttatattttctttagagagaacaattaaattagttagctttacagacaagccagaggccatcaaattattgaataaagacaacaaagtctccagagtatcgggagaatgacaggcttagaactaaagtaaaaagcaaggagcaaaaatcacagagactgaaataaaatgagagggtggggaaggctgggtgagaagagaatgggtgaagaaggaagaagaagggaaggaggtggaggtctagtggaataatgtaaaccaaattttgaaatgaatgctttttggtgtttttcttttacaatgttatttctttttatccattagctttgaaataaaggaaacccccaccattgtcctcagttcttcagtatctctaaccattagctccattcattccaatttggagatgaaatcaagatggggacagattttaagcatacatattcatgcataaaacttttaaacaacataatgccctttccttctctagcctaggttagctgcttacacgatgacccatcagttaatgtccatctgatttgcctattttttgttttttaaattaaggctagttacccaacctcttaatgattcagaaataaaccacttccagtcagatggtaaaacgtgtgacagagttcaagaatcatgttagggtactactagcagcctgggccttaagtttctcattttagaggtagattttttagtgtaagctctagtgtgagatctaagtgtaaacacaatgattgtgaggatttttttgtactgtaatttatgctgatgcagcttttagaatgtgggctttttgggtatttcctgaaactgaaattggcatgctttctagagttatatattggcatgtttagtgatattaaagttgcagtgaagagttctgaatttaatttcttcttttctcagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcggtaagtgcagtctttttgtttatcactgggtaaacagaaggaatagccttcttatgatagcatgcggtgctggaagacagcaggaaactttatcagtgccttattatgcattctctcccagggtggttgaatgttttggaagagagagagcaaactatatatggactccttatttataagcactaagcaagcaaatgaatgaaatgattcaacttatttttggaaaaatcatttttcccccttaattgtttctagttagaggaatttataattaaaagtcttttgtatttcaaacccttggagaggttattgaactttactgtgtaggcagtaaggatagttttgaaattagcaaattcacaaggaatttcattgcagaataaatatcaaaatttgttcacttgcgttaatccagttttttttgggggggtactccaccagtctttctcatgtgactctgtaaagtgacaagttgaagttcttttccaggacaaagccctgtactgaatggaaaatgctggagtagaaatctgtgtagggtagattcagtaggaccaaaggaaagaagagaatgtccagaaagaagtgttagagggaaacagactttagatataactagtgatttacaagttagaaaggaacacaccaagagagaatattctctgttatatttctattctcaaatacattttttcctactttttggcttaaattaatatacattatttacaattgtatgataatgtaaattttggtcagggaaaccacaagtatgctatgaataaatttccttccttgcacaacttcttcattttcttagttgtcattgtctacttttccttcattcaaattaagataattttaaacacaatttgaggcctgcaactatatgacaaaactgtaaaatgcctccaaaacaaatcagataatctatcagtttttctcccccactgagattgccctggcagttcttcatagtcctaatttaatatagattggttaacctctaatcctatagtcataaggcgtccttttctgagaattttttcctccttttttaatgttaaatacccattctctgggttacatgtctttcttgttcttggtttatttcattgttttaaagtacatcctcgcagtagcttcttgagaaagggtgatggggggtttgtcatatgactatgattttatctgtcgttgattacttgattaataatctggccaagtatgtgattttagtttagaaaataattttttcttagacttttgaataccttgttttattgttttctaggtgcctagattgtattgaaatccctagactattctggtttcccagttcatcctttatctgctttttttgtttgtggaactttctaggactttcttttcatccctggtgtcatcctttttcttggtatcaatgggtgttttcaatttttgagttaatttctttcagtttcaaaaattttcttatatgtttatttaattttttgtaatcttctcttttacgataacatttttattagttggatgttggcattattggattgatcttctagttaccttttcttttccctattattttaaatcttttttttcctaccttctgggtttttttaacttttaatttttaacccttcaattggatttttaattatactaatatttatttccatgaactctttcttattctttgaatgctcttttaaaaagtatcctgttctatttcaatgaataacatatcacttcatatgtttctgaggatacaaaatgtagcttggggaattttttttccttttacatattctctgaattatttctggatttcctttgagtttcttgtttctgtttatttgttttggtctctgccttacctgttgagatttttggtgggtctatgtcatgcctcttggagagaaactgttggctgtcagtttatgttatgagtaatgtactcagaagttgattggaagctctgtgcctgggtggcttgtcagttggttggcttcagcatagggactcttggtgaagacctagtcgttttatttaagtactctcaaatgtcgctgtctcttgatcttgtttttgttactgggtgtttctcacaaaatggacttacccaatttattttttttaggacatataaacctagctgtcactattctgagatgatcaagaagggactgaggacccttcagttctctatgccaactttctcatgatttttttttttttcattcggtatgactcttcaatctgatatccactctgcctggtatccaagccccagttgaattctctgattcaacctcttcagagaataaatctctggcgggactaggaagggatagggggctggccgagggagactggggcaaagacctccaccttaaattcactccaactaatcatatcatttgtagccccaacttgaacttcagcttccagtttgtgagtatttttgggattctgaagtatgaattgacttatttcttactggcttatgccttggatcatgtaggtatcaaggtttttttttttttttttttttttttttccccactcatcctaggcaatgtgacttctcaaccatttgtgtcctgtctttacatttttatttctatctcgtctctagtgttctctttactcattttgattgcccttatgggttttaattttagtattgttttagtatgaattggtaagggggagagataaatacatgttttcaagccatcaagtttcactggaagttttcacagtttctctattgtattttttagtttctttagatcatcttgggcttaccctttcctggttcaccctgggatgactttttttaatatatattaggtcatttatattactttgtgtgggaactgctttgctttctttttattttaggaatttttgcttcaattcaatgtgccctggaaaaatgtcttttctcttaccttatcaaactggaaatggcttcgttttctctttcagcaggatgctataatatcctgtttttttctgagtcctttctgtttgctgcccttttaaaaaatatattttttctttttttaaaattatactttaagttctggggtacatgtgcagaacatgcaggtttgttacataggtatacacttgccatggtggattgctgcactcgtcaacctgtcatttacattagatatttctcctaatgctatccctcccctagccctggtgtatgatgttcccctccctgtgtccatgtgttctcattgtttaactcccacttatgagtgagaacatgtggtgtttggttttctgttcttctcttagtttgctgagaatgatggtttccagcttcatccatgtccgcgcagaggacatgaactcatccttttttatggctgcatagtattccatggtgtatatgtgccacattttcttaattcagtctatctttgatgggcatttgggttggtttcaagtctttgctattgtgaactatgctgcagtaaacatacgtgtgcatgtgtctttatagcagaatgatttacaatcctttgggtatatacccagtaatgggattgctgggtcaaatggtgtttctagttctagatccttgaggaattgccacactgtcttccacgatgattgaactaatttacactcccaccaatagtgtaaaagcattcctatttcttcacagcctttccagcatctgttgtttcctgatgtttcaatgatcatcattctaactggcgtgagatggtatctcattgtggttttgatttgcatttctctactgaccagtgatgatgagctttttttcatgtttgttggctgcataaatgtcttcttttgagaattgtctgttcatattctttgcctactttttgatgttgttttcttttttctcttgtaaatttgtttaagttctttgtagattctggatattagccctttgtcagatggatagattataaaaattttctcccattctggagtttgcctgttcactctgatgatagtttcttttgctgtgcaggagctctttcgtttaattagatcccatttgtcaattttggcttttgttgccattgcttttggtgttttagtcatgaagtctttgcccatgcctgtgtcctgaatggtattgccaacgttttcttctagggtttttatggttttaggtcttacatttaagtctataacccatcttgagttaattttgtataaggtgtaagcaagggatccagttttggctttttacatatggctagccagttttcccaacactatttattaaatagggaacccttttcctattgctttgtttttgtcaggtttgtcagagatcagatggttgtagatgtgtggtgttatttctcaggtctctgttctgttcattggtctatatatctgtttttgtaccagtaccatgctgtttttgttactgtagccttgtagtatagtttgaagtcaggtagtgtgatgcctccagctttgttctttttgtttaggattgtcttggctatgcaggctccatatgaaatttaaagtagttttttccagttctgtgaagaaagtcaatgatagcttgatggggatagcattgaatctataaattactttaggcagtatggccattttcatgatattgattcttcatatccatgaccatggaatgtttttccatttgtttttgtcctcttatttctttcagcagtggtttgtagttcttcttgaagaggtccttcatatcccttgtaagttggattcctaggtattttattctctttgtagcaattgtgaatgggagttcactcatgatttggctgtctgtttgtctgttattggtgtataggaatgcttgtgatttttgcacattgattttttatcctgagactttgttgaagttgcttatcagcttaaggagattttgggctgagatgatggggttttctaaatatacaatcatgtctctgcaaacagaggcaatttgacttcctgttttcctaattgaatacactttatttctttctcttgcctgattgccctggccagaacttccaatactatgttgaataggaggggtgagagagggcatccttgtcttgtgccggttttcaaagggaatgcttccagtttttgcttattcagtatgatactggttgtgggtttatcataaatagctcttattattttgagaaacatcccatcaatacctagtttcttgagagtttttagcatgaggggctgttgaattttgtcaaaggccctttctgcatcttttgagataatcatgtggtttttgtccttggttccgtttatgtgatggattacatttattgattggcttatgttcaaccaaccttgcattccagggatgaagccgacttgatcatggtggataagctttttgatgggctgctggatttggtttgccagtattttattgagaattttctcatccatgttcatcagggatattggcttgaaattttctttttttgttgtgtctctgccaggctttgctatcaggatgatgctggcatcataaaatgagttagggaggattccctctttttctgttgtttggaatcgtttcagaaggaatggtaccagctcccctttgtacctctggtagaattcggctgtgaatccttctggtcctggactttttttggttggtaggctattaattactgcctcaatttcagaacttgttactggtctattcagggattctacttcttcctggtttagttttaggagggtgtatgtgtccaggaatttatccatttcttctagattttttagtttatttgcatagaggtatttatagtattttctgatagtagtttgtatttctgtgggattggtgttgatatccccctaatcattttttactgtgtctatttgattcttctctcttttcttctttattaatctggctagaggtctatctattttgttgatctttcaaaaaaccagctcctgtattcagtgatgttttgaagagtttttcctgtctctatatccttcagttctgctctcatcttagttatttcttgtcttctgctagcttttgaatgtatttgctcttccttctctagttcttttaattttgatgttagggtgtcaattttagatctttcctgctttctcttgtgggcatttagtgctataaatttccctctacacactgctttaaatgtgtcctggagattctggtatgttgtgtctttgttctcgttggtttcaaagaacatctttatttctgccttaatttcgttatttacccagtagtcattcgggagcaggttgttccgtttccatgtacttatgtggttttgagtgagtttcttaatcctgagttctaatttgattgcactgtggtctgagagactattatgatttccattcttttgcatttgctgaggagtgttttacttccagttatgtggtcaattttagtgtatgtgtgatgtggtgctgagaggaatgtatattctgttgatttggggtggagagttctgtagatatcatttaggtctgtttggtccagagctgagttcaagtcctagatatttttgttaattttctgtctaattgatctgtctgatattaaagtttcctactattgtttgggagtctaagtctctttgtaggtctctaagaactcgctttatgaatcagggtgctcctgtattgggtgcatatatatttaggatagttacctcttcttgttgcattgatccctttaccattagtaatgtccttctttgtttctttttaactttgttggtttaaagcctgttttatcgagtgcaacccttgcttttgttgctttccgtttggttggtaaatattcctccatccctttattttgagtgtatgtgtgtctttgcacatgagatgggtctccttaatacagcacactgatgggtcttgactctgtccaatttgccagtctgtgtcttttaattggggcatttgacctatttacattttaggttattgtattgttaggtgtgaattcgatcgtgttattatgatgctagctggttattttgcccattagttgatgcagtttcttcatagcgttgatggtctttacaatttggtatgtttttactgtggctggtactggttgttcctttccatgtttagtgcttccttcaggagctcttgtaaggcaggcctggtggtgacagtgtctctcagcatttgcttgtctctaaaggattttatttctccttcccttatgaagcttagtttagctggatatgaaattctgggttgaaaatactttccttcgagaatgttgaatattggcctccactctcttctggcttgtagggtttctgctgagagatctgcttttagtctgatgggcttctctttgtgggtaacctgagtcttctctctggctgcccttagcattttttccttcatttcagccttggtgactctgaggattatgtgtcttggggttgctcttcttgaggagtatctttgtggtggtctctgtatttcctgaatttgaatgttgtcctgccttgctaggttggggaagttctcctggatgatatcctgaagagtgttttccaacttggttctattctccccgtcactttcaggtacatcagtcaaatatagattttgtcttttctcacagtcccgtatttcttggaggctttatttgcttcttttcactcttttttctctaatcttatcttcttgttttatttcattgagttgatcttcaatctctgatgtcctttcttccccttgatcgattcagctattgatacttgtgtatggttcacaaagttcttgtgctatgtttgtcagctccattagttcatttatattcttctccaaactggttattctagttagcagttcatctaaccttttttcaaggttcttagctttattgcattgggttaaaacacgctcctttagctcagaggagtttgttattacccactttctgaagcctacctctgtcaattcgtcaaactcattctccgtctggttttgttcccctgctggcgaggagttgtgatcctttgggagagaagaggtgttctggtttttgtaattttcagcctttttgcgctggtttctccccatcttcatggatttacctacctttggtctttgatgttggtgaccttcggatggggtctctgagtggacatcctttttgttgatgttgatgctgttcctttctgtttgttagttttctttctaacaggcgcttctgctgcaggtctgctggagtttgctggaggtccagtctagaccctgtttgcctgggtatcacgagcagaggctgcacaacagcaaagattgctgcctgttccttcgtctggaagcttcatcccagagggtcacccaccagatgccagccagaattatcctgtatgagtttccgtcggtccccactgagaggtgtctcccagtcaggatacatggggttcagggacccacttgaggaggcagtctgtcccttatcagggcttgaacactgtgctgggagatccgctgctctctttagagctgtcaggcagggatgtttaagttctgctgaagctgcgcccacagccgcccctttcccccgttgctctgtcccagggagatgggggttttatctctaagtccctgacttggggctgctgcctttctttcagaaatgccctgcccagagaggaggaatctagagaaggagtctggccaccagcggcctttggcctggccttgctgagctacagtgggctctgcccatttcaaccttcccgatggctttgtttacactgtgagggtaaaaccacctactcaagcctcagcaaaggcgattctcccacccccacctagcttaagcgtcccaggtcgacttcacactgctacgctggcagcgagaatttcaagccagtggatcttagcttgctgggcaccgtggaggtgggacctgccgagccagaccacttggctccctggcttcagccccctttccaggggagtgaacggttctgtctccctggcattccaggtgccactggggtatgaaaaataaactgctgcagctagctcggtgtctgcccaaacggctgcccagttttgtgcttgaaacccaggccctggtggcctaggcaccggcgggaatctcctggtcttccggttgcaaacactgtggtaaaagcacagtatctgggccagagtgcactgttcctcccggtacagtctctcatggcttcacttggctgggggagggaaatccctttaccccttgcgcttcctgggcaaggcgatgccctacccagctttagccctccgtgggctgcaccaactgtccaaccagtcccagtgagatgaaccgggtacctcagttggaagtgtagaaatcacctgccttccgtgttgatctcgctgggagctgcagatgggagctgttcctatttggccatcttgccagcaaatcctgtctgctgcctttttgttctctcccctgttgtgataagaaggggtactttattatgtttttgttttttttttttttttttttttttggtagaaaggttaatttccactggattctgaattgggcagaaaatggaaacattaacactttttgcataacgccattttacatcccctgcagcagtgtaaagatttgatcagttaattcccatgggaagcatgggaaaacaagggagccttatagacacgggtgttatttttaacaatgcttagaggatgtaacaatgactgataagcatcaaaggaagaccctgtttccttaagggtcaccatgatttatgtcatacttttattttatcattatttcttttaaaatattagttatcttttataggctccaagagtagagctgaaaaggaaggaaaatgtgatagaagtgtggcattgcagccactgttttaatgaggaaagcattgttttttggaaatactgtggtagaaactattttaaaatatcatgccttcccagccgtatacatctatatgctcttcacatacaggccattatatattaggagccttgactgaaatcaaggaaccaagaatgccttgacctcagtggccatcatgctaatgtaactggctgattggtttttttcttcagatagtggcactttaaaattcacgcaaaatataaagaatgaggttttatttatagtggtatattttaagagggtgtttaagaggtttttaaatttgtttcagatgtatattgagtgcccacttttcctaggactagttcctgtgtggtgtttaataccgtcactgatgtgacaaaccttccctcccctattcctgccacctcctctaacccagctgtgctcctcagtagctgcagttcttgggagtactacaggagatttcctgtcttgctggaccaatttagaagggatttcattgagttatgctgtcataagctgatcttaaagagggcatattttcagaaactcatatttaggttaaggtcctctctacattccacaaattgctccaaatttacctcttttcatcaccataaaaatctatatcccatgataggcaggcctaatctgggagatgtgggaggagggtgcaaacctgcaaatgagagtttcacttctgtttttagatacttgttcttaaggtgtggttggtgtgtcatcttggcgttacttcctcttctggggagtggaaaattcccagattagaaccaagcccccttgacaggttgttaccatgtgtggtgtttggatccatacctctgcacagcacctagatctattttataaccaagttacctatcaatgatgcattaccttagtgtggctgtaatagggctatcaatgctgggtgataaagcttgttctggagatcaaaggcaaaataaaaattagcccagtcaggtttgactttaaatccttatttaatggagtcacgtggttctgattgaatccttcctctctcaccctcatacccactctcacaattacagtataatgtgctggagaagtgattctccattgtggttttcctcaattcagggggtactcaacaatcttaagcaaggggttatgtgtgagggttaaaatcagttttcaatgaagtcagtatgaagctatggacattcttactggatatcagggtatcattacagtgaacactgaagtatactcatgaagtttataaaaattgcagttcagacacccatccttgcttctgtgagtggggtttcaatagaagatagaccgaagcatgtttaatatttcctctatgtgggtgagggttaggactctgtgtgaatattccaccagtgtaatagtaacaaagaaaataattctcaattctgataatcttggcttgaattctagttctgccagtaactataggattttagatgagttactttatttttccagtctataaattattcatgttcaaatggggatagtaatagaaccaacctcatggtggtattatagagattaagtttatgtaatacatataaaatgattagcttaaggtctgatacataattacttgatattagctagttgttattattattacacagacaatgaactagagctgtcaagggttaagaacacctctatggcagggtgacaaacattgttcagctggaacattatgtgcacttttcattatccatgtcagtgttcccctccgctggcccagataattgacggttctctatacttttattcagttttttaaaaaagtgttaacatcatctcattaaatttcacatctctatgcagttagtgtctgttagaaattgctgattagccctctgtatttccacgtctctaaagtggtatctcaagcctacactctaagtagggaagcgataagcagagaatagttgtcccataaagctgtttctcatccatccacacacctgacatcaaaaagccaaagataatgtttaaggttgactacaccttggtttgatccagtatctttatttaaatgtgatgatttaataaagttgcaaggaaaaaaagacaaaggactccactttaattataaacaaaaatctctccttctgaattattcttttttttttacttatttgatgggaagaattttattattgacctctttaaatatttggcatttggattctttatttatgtgtacagtaattacagatcagaccatttctgcatacttaaaataggagactcactttataagaatctaactctcaaagcggagactgtctcttagatgcatcctattccataggactgttgttttgtagactaggaaaagttttagagagaattacatgcctttgattcttcctatggagtcagcatgattgatttgtaagttacagtgtatttccacaatgtctacctgtcagtttcacagggcagataatattgatttttttaccacaaaatgtggcaaagtattaattttctgccattgtagtgttaacagaatatagaatacaaccgtagcagttaatgcatccaaacccagttagttagatagactactttgtaccattggcatcttcctttactaaatctttcttgtgaatgaatggagattgtttttattaaaattttttttgtttttctaatttcctcagttcagttttttcaagtagtaagtttaatatggtctatgtcttaaaaataactacattaactcttttatacaaaactatctatgtagagtgaatatatcgtttttagaaaattatttgtgcctttccagaaagagaaaattttggcttcctgttctcttgccaagtggtgactgtgtcttatacttactctaagtagtcattagcagtttatctcctaataagaataaaaaggtaattttccgctgctgtgtttttctttaacttagattgcattcattcttaaaggagcacaaaagcaaacacacagacctctcattctgattttaaataatttagagtggaactgtgaacacaatattttccccattgaagatcattttatactgaagtttaatataggtttttaaatttctatttaaaacttgggctcaggagggtgatggtaaagtgtgacattcacaagctgtttcctggtgatgaaaaatgcatgagaacataacccacacaggactagtcaggcgactttgaatgtaattttccattaaattttacttgatttaactcaacacatggtttgtatcttacaaatttcttgaagaaagaaataggtggtcctaagtgaatgtaatgcctaaagagctcatcattgtaatcatagtttaaattacgtggaaccaagttaaattcctaaaaaaaaaaacttacaccctctcctcccttcttctcctccgtttctttctatattaatttttgaaatatctttgtccttcatatacatatacatatatatgtgtatgtatgtgtgtgtgtatatatatatatatatagagagagagagagagagagaaagaaagaaagagaaagagtgtgtgtgtgtgttatgggctgaatggtgttcccttaaaattcatatgttgaagtcccagcccccagtacctcagaatgtaaccgtgtttgaaggtaaggtttttaaagaggtgactaaattaaaattaggtcattgggtgtgaccctaatataatatgactggtgtccttgcaagaagtgtagagacaccagggatcccatcaaccagagggaaggccatgtgaggacacaagagaaggtggccatctgcaagccaacgtgagaggactcaggagaaacaaaccctgccaaaaccttgatcttggacttctagcttccaaaactgtgaacaaataaatttttgttcttgaagccaccaagtatgtgatgttttgttatgacacctctagcaatccatacatatgtataaaataaacccttgttatttggttcggattttttctttaaacactgttaatttgttttctcatactgagtgctagcaaaatttgtgctgctagttttgttttcgcatactgagtgctaaatgggagcagattacttagatgactttaaggcaaaatatttaattgaaattcagtgtatggtcttgggcaaatcggtgtttctgggaggttttcatttttatatatttatattagagtaaatgatgccgacagtgttatgtagctctaggagctctgattttgtgagggcaagaattctatttttggtctatatttcattataaaattagtaatcgtggagcttgaggaggaattgaccccacattgaatgcttggttaggaaatgggttactattgtgtccagctgtgcagattgagtacttgactctgcaagttttcttgaagcacttactaattttccagcagttccctcaacatttgccacagtcattcttccattgaaggtgccactgtctagagataggctggattaatagttgagactctcagagatgaacttgtttcttctctttttattagcattaatgatgagtgagagtagttgcctgataatacctcctcagtctgcacagctttaggctaccttgtgctgtatacacctggaaagatctgactttagattttgcaaaaatctgtttagttccacacataaattaagttctttttcattacacagaatgaggaaacaacctcatggaagtttatgtgcagtgggttgacttcaaccattgagcctttaggatatttacaggtgaattgggtagtagaaaattttaataagtacctgttttctacaatctctgtggcattgattttaagcccttaacatttggacatatttagagacatatttgttattgtaaggattaacataataggttactattttatggaagagattagtatctaaagcacaaatgcttgttaataactgccaaatagtagaagttaggtggtttcctggcttgttcttgcatttaaaagtaatggatcaaatatttcaccatttaatatgaggtttgttacaggtttctatagaaataatattgaatttggaacctttcctttgttactaggttacataattttttgattttatttcagatacacagtatattgaattttaaaaattgtttttcaggatttttctcttatgtagtgaaatatattagtaatttttttgaggttgaaccatttttgaattcatgaaataaatctcatttggccatggtatattattcttgtagtacatttgcagaaattaatttttaaaatatttcttagaatttttgctcctacgtttgtgatacttggccttttgtttaattagttagttaattttggtaatggggttttgctagttaaaagcattttatatttttatgctatctgcttcatacaacttagtatatctgtttcttaaattttagtggaagtagcccttagaagattgtatttttaagattaattctttaaatttattctgtttattgtgtcttagtttttttgtattttgcctaagtcaatttgggtaattaattttttctagaaagtatgtactaaattttgaatattttggtataaagctgttcatagtgttccaggttaattaatgaaaacaaaaacattcgttcttaaactgagttatgttctctttgtatttccagtgtttatttagttctctttttaatgagactttccagataattatctattttaatggtctttacaaacagcatttggttttattaatcatgtttataatacttttgtcttatattttacagatatcttttattgtctttattaatctcttcctaccgtgttctttgttgcttcttttctagctgccattaaaagtctacgtcatactgctttattgttttctattatatgcatatatttaaattttcttttatgtattggtttggctgcatgccataggtcttaaatggtcatgctctcattgacacatatttatgaattttaagttttgatttttttaaacccatgttattaaactattcagctttaatttttttattaaaaaaaaccatttattgtgtatatttaagatacaaagattcagtatcccctatcggaaatgcttggtacggaggtattttggctttaagatttttttggattctggaatatacatgagatatcttaggaaggggaccccaagtctaaacattaaactcacttatgtttcatatatagcttatatgcatagcctgaatgtaattttatacaatattttaaataattttgtgcatctatcacatgaggtcaggtgtggaattttccacttgtggcatcatgctgatgttaaaaaagtttcagatttttggaacattttggttttaaggtttttggattagggattctaacctatatagcgtggtggtatgggatacatatagatagtaaaatgattactgtagtgaagcaaattaatatatctatcatctcatatagttacccattttttgttgttgtggcaagaacagctaaaatctactcatttagcaggaatcccaaatagagtacaatgttgttaattatagtcttaatttctaatttaattgcattgtgttcagaaaaagcaacttgaaatgtttttgcaggtttcaatattgagctcatctttgtgacctaatctatgattttttttggtgaattttagatgtgtgcttgaaagaatataaatatttgaatacatatattaattaagccgctgtttctagtatttgagccccatatatcccttaattattagttacttgcttgctctgtcgattagtagtgtatgcttgtctttcattatcacttctttctcactttattgctaccaacaattgtttgatacatttcaaaactatgttatttggcctttactagtttactagtttattagacttcttggtggatttttaacattcattttttatgggagatattaatttaatctatttattgttttgtaaattctgttttgtctgctatcaatactactataggtattattttaaaaaatgcttactgggctatattttccccttctttattttcagatttactcttttttaatctcttcttaatagcatattgctagattttctttgttttttttattttttaatctgagagcttttcctttaataggggaagttgattcgtgtatgtttattgtaatcattgatatgtttggatttaactttattctttttttttaaattatttatttttattgatcattcttgggtgtttctcgcagagggggatttggcagggtcataggacaatagtggatggaaggttagcagataaacaagtgaacaaaggtctctggtttcctaggcagaggaccctgcggccttccgcagtgtttgtgtccctgggtacttaagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctatacagacacggcaaccatctgatttctcaatcttttccccacttttcccgcctttctattccacaaaaccgccattgtcatcatggcccgttctcaatgagctgttgggtagacctcccagacagggtcatggccgggcagaggggctcctcacttcccagtaggggcggccgggcagaagcgcccctcacctcccggatggggcggctggctgggccgggggctgacccccccacctccctcccggacggggcggctggccgggcagaggggctcctcacttcccagtaggggcggccgggcagaggcgcccctcacctcccggacggggcggctggccgggcagggggctgacccccccacctccctgccggacggggcggctggccgggcggggggctgacgcccccacctccctcccggacgggggctgacccccccacctccctcccggacggggcggctggccgggcagaggggctcctcaactttattcttattttataaaattttacttagcatgctttcttattgaatatgccttctcctctaacctctcactccttaccctcttcctctttcattgcattttttttccattcccctctccccaatttgtttgggatttgtataccttatttatatcaatttactgattaccttttaaaggttaagaaacatcctaaaacatatgcatttggagtttcaatctgtatctgcaatatattctgatttattcaagaaagctcagtgtgcttttatttctcctttcctactgttccttgccttttcccccatcactccaactacatcttatattgagataattttttgtctagatttttttctgtgggtaataaaattgttgtgtttccataattcacttgagggaccgtcttgagtatagtattaattatgcaaaattatttttccttttaattttgaaaatattgcttaactgtctttttgcaccgattacaatctatgacaatatgcttgctgaataatttttctatttagatgtaacctctccctgaagttttctgggagagttctgttcagccattgagcttattacttttttaacctctgaggttcaagcagttctcctgccttagcctcccgagtagctgggactacagacttgtgccaccacgcccagctaatttttgtatttttagtagagatggggtttcaccatgttggccaggatggtctcgatctcttgacctcgttatctgcctgcctctgcctcccaaagtgctgggattacaggtgtgagccaccgtgctcagcctatttaaagttatccttacctttgcagtgttaacttgccttccaaggttttagcttatctgcccactgaattttatccatctctttcaggatattgattttcctaaaatgatttgtgatttttggttgtatactcatatttgtacttgagaatcactgtcagcttattttattttctgtaaattttctctactgattgtgtgaaagggattacagcttgggggatggggagacattgctttttctctgggtattggctatttgagtccttgctctgctcagataccacactctaagctgtctcctgtgcagatgcctccacagcttgcttgggaggacactgcagtctcaactgtttatgtgttgattagtctcatgttcacctagaggttcttgcttcttttatttaatagtcttcccctacatggtcaggcttttctctgaagttttgattctgattaccttctttcagaattcttcaaaatttctgattagatattggcactcttttttgttttctgcttctaattctgatttattgtttttgaaaaataacttttaagtcatgatgggtattttgggcgggaagaaagtaagaaacatgtattcaactggccacataaaatcccaataaatagtgggagtcagaatcattgcccacatattgtgtgttttttgataagtgatacaggtgtatattcaaaagtagtgttcaagcccaacttgaagaatacaagttctaaacttctgaagttggttatttataaagtaccacaaatattagcaactttttatgaattatatgtatatttatattggaataaatctctttaataagatatttttcattccttatataattatcattttctaatatgctttggtattacccttttatataatagcaacagtataataatagatcatgtcttattgaaatagaaggtgaatgcttctccaccatggaggacaacactccccttttcttgttccatagttaaagttggggtgggagttgagtacaataagattgatgaggtcactctctcttagcattttttttggtcctgttgggaagtgacctgtcttaagagttgttttgtggcagctataccttaaggattgatttatgtatatataagagagttccattttgtattagtgatagctgagtgatacatcttctgattatctgtttgaattatcactaaaaggtatcagaagagtacctttatataactgaatattataccatcatgatttacaatgggatacagtaaatattttcagctttgtcagccatatgatctgtattggaactacagctgtgttgtagtttgaaaaccatgaaacaatatgcaggtgaatgaccacgactgtgtttcagtaaaactttatgaacactaaaatttgattttcatattattttcacatatcatgaaactttattcttgttttgctttgcttccttcaaccattagaaaaggtaaaaactattctaaacttatgggatatacaaaaacaggtggtgggctggatttgacccatgggccacagtttgccagctcctaatttagaagatggtataataacatgtaaagtgttcataattgattgaataaaaaaagggaggggcaggtttaaaaacagtagatatagtgcaatttcatttatgtaagaaagcaatcatcagcttacagatagcactggaagaacagctatcaaaatattaacagtggtttcctggttagcttatgggaataatttcgttctacattgtgtttatttgcatttttttttagttttgtatcctgtttattatgttgttttgaaaaataaacatgtatgccagaaaaaacagttatttaaaaagtgacagagaatctgtacatttttagcaaaatcagggtatttgttgttaattaatttgatacaatctgttttgtttaccctgtgcttcatttttagccaacaagtcccaaatttggaaaagctgactcatatgaaaagctggaaaaactaggggaaggatcttatgctacagtatacaaagggaaaagcaagtaagttcattatttttggaatatttcacatgtacagtgtatctgccctcttattactaaatagcattttatttaaataattattatttaatatacaatagattttcctccctcacggtatccttttttttttttttttttggcaagtgtgtaaaactcattggaattggtgtaccctgctagtaaacagtttttcagactgttcaatttatttttctgtttaatgcgcctccccacaacactgctttctctttcaaaggagttggaaccgtctaatgagaattcatttccaggtgaattatgtgattaatttctcatagagatttagtgttgggaataggagtattgatttgacaatgccaaatatattggccattcttggggtctttttaagttaagcttttactccatctttcagaagtctcttagttaaacaaaatggcaaacttttctttttctttcttcctgtctgctttggcatcatgctgcatatattttcatatcgagaaacaactgtctcctccttttcttctttctctccattgctctctgggggtcagggcacagatttggattcttgaaaagcttgtcctcatgtgtttctgattgacctccttactctcccttattaattaaggacagagagttactgtatttagtgacatgtagttgtagataacttaatgcaatctctgcaacaaccacagaagtcacaagctttgttttacctttataactttaccaaatgatgttgcaaaataattttctatactgtccctgttatctcttttcaaaatctttatagaagataggacttttttgtctgagacagcatttcgccctgttgcccaggctggagtacagtggcttgataacggctcattgcagcctcaacctcctgggctcaaacagtcctcttgccttagcctcctgagtaactgggactacaagcccatgccatcatgtctggctattttttttaaaaaactcttttgcagaaacggaattttcctgtattgcccaggctggttttaaactcctgggcttaagtgatcctctggcctcggccacccaaagtgttgggattacaggcatgaaccactgcacccagccagattagaatattgtaacttaagtaattaaataagaagatgtagaagagaaaaattctctgaaggatcattccaaagacatagttggaaattttgattatgtgctaatttaggtaatcttaggattttcaggagtgtggtcttatatctgtttgttcatgtttcttaagtttagaagatgaaatattccttatcaagaaagatatgtaaggcaaaaatactgtgaagtcaaaagtaatagtattaattttgagagttgtaaaaaaaagtttgtaaaaatggtgcagggagccctcttcattccacacccgggcagatctccaggcctttggagcacccgcttgcctcgttctatatcttgagctgccccaccccttctgtccagagatcctggtatagcagagccttcttcactccatgcccagtcagatctccaagcattcaaagcacctgctcacctcatctggattggcaacctcagttgccccacccttcctttgcagacatccaggtgcaggaggggccctttctgctttacatccaggcagatctccaggcagttagagcacctgctcactttgttcagcatcctgagtcactcactcttcctgtgcagagaccatggtgcagctaggcctctgctccacacccaggcagatctccaggcatttggagcaccagttcacctggaatggcagcttaagctgcctcaccctttctacacaaaaactctggtgtagcaggttcctctctcctccatgccccagcaaatctccagggatctggagcacttacactcctggattaggagtttaggctgcctccacttcctctgcagagacttggggctaaggatgtttcccagcttcatgtttaggcacactctgggtgcttggtggctttctactggattctccatcagtgctggtgcttgtgcctgctatcaggggatgaccatcttgcctcatgcccccaggactgagaagggaactcagaacactatgggctccacagatcagcccattgcctaaggcaacagagagcatctccccataaataaggatcaagtatatatccagacacattggctgcagtaggttcttactgataagtgccatctactggctgtaggtcaaaccaaacagccgtatgtaaaagctgctgatagaaatgcatagggctatagaagcaaagccaaaagatcctacccagcattctctgcagttgcaacacagagggagtggggagaagggaaggggaaagaaaacacacacacacacacacacacacacacacacacacacacacacacaccaataatattacagagaaagaaaaagaaaaaatgcaatctgtacaaaaataattacaaaaattatagtgccaacatctccagatgagaaggaaccagcaaaagaattttgttattgtgaaaaatctgaatgtcttggcaccgctgaaggatcacactaactctccagcaataattcctgaccaaaatggaaactcagaaatgacagataaataattgaaagcatggattacaaggaagcttagtgagatccaagacatgattcaaaatctacacaaagaaacttctaaatcaatccaggaaatgaagaaggagatataacatcttaaaaggaaatcagtcagcgtttctagaattgaaaagctcacttaaggaatttcaatacaattgaggccggacgtggtggctcacacttgtaatcccagcactttgggaggccaaggcgagcggatcatctgaggtcaggagtttgaaaccagcctggccaatatgatgaaaccccatctctactaaaaacagaaaaattagctaggtgtggtggcacatgcctgtaatctcagctactccagaggctgaggcatgagaatagcttgaacctgcgaggcggaggttgcagtgagctgagatcacaccactgcactccagcctgggcaacagagcgagactgtctccaaaaaaaaagaaaaaaaaagaaaagaagaaaacagttgaaagcttcaatatcttagaccaagtggaagaaataatttcagagcttgaagaccaatcttcttaacccagacaaaaataatatttttttaaatgaacaaaatctttgagaaatatgggataatgtaaagtgatcaaaccttcaaattattggcattcctaagtgagacagagaaaaggtaaacaacctggaaaacatatttgagggaataatcccagaaaaatcccctaaccttgctagagaggtgaatatccagattcaaaaaatctggagaacatctgggagatactatataaaatgaacaccaccaagacttactcaccaggatgtctaaggtcaatgctaaagaaaaaatgttagaaagaaaaaagcaagatcacatataaagggaacaccattaagctaacagcagatttctcagaagaaaccttacaagccaggagagtttgggggcctgttttcaccattcttaaaataaatctcggccaagaatttcatatcccaccaagataagcctcatacgcaaaggagtaataaaatgttttccagacaagcaagtgctgagggaatttcttaccactagatcagccttacaagagatccttaagggtgttctaaacatggaaatgtaagaacaatacccactaccacaaaaacacacataagtacatggcccacagattctgtaaaggcactatacaatagaaactataatgcaaccaagtaacaacttcatgataggctcaaaatgctatatatcaatattaactttgaatataaactgactaaacctcacacttttaaagggcatagaattgtaagttggattaaggaaagaaaaacaagacctatctctctgctgttttcaggagacccatctcacatgtgattacacaagtaggctcaaagtaaagggttggagaaagatctatcactcaaatggaaaacaaacaagagcaggggtcactatttttatatcagataaaacagactttaagccaacaacaataaaaaaggagaaagaagggcgttacataatgataaagtgttcaattcaacaagaagacttaactatcctaaatatatatgcatgcaacattggaacaaccagattcctgaaacaattacttgtagacctacaaaaggacttagccacacaataatagtgggggcttccacaacgcactgacagcattagacagatcatcaaggcagaagaccaacaaggaaattctggacttaaattctacccctgaccaactagacctaataggcatctacaggatattccactcatcaaccacagaatatacattcttctcatttgcatttaggacagatgaccacatgctcagtcataaagcaagtctcagtaaattaaaaaaaaaaatcaaagtcataccatccatactcttagaccacagtggaataaaaataagaatcaataccaagaggatttccccaaactttgcaattacatggaaattaaacaacttcctcctgaataacttttgattaaacaattaaagcagaagtcaaaaaattcttagacataaatgaaaacagagacaaatcataccaaaatccttgggatacaggaaaaacagtgttaagaggaaagtttacagcactaaatggctacctaaaaaaattagaaagatcttaaattaactaacatcactcctagaggaactagaaaaacaagaacaacctaaccccaaagccagaagaagaaaaaacataactaaaatcaatgcagaactgactggaattgagacctaaaaatatattaaaaataaatgaaatcaaaagttggttctttgaaaggataaagatcaatagaacactaattaaaggaagagagaagatccaagttaacacaatcagaaatgacaaaggtgacattacagctgatcccatggagatagaaaagattgtcagagactattaggaacaactctatgtatacaaagtagaaaatctagaggaaattggtaaatttctggaacacataacctcccaatattgcatcaggaagaaatggaaactctgaacagaccaatatcaagttccacaattgaattaataataaaaacctaccaatcaaaaaaagcccaggactagattgtctcatagccaagttctaccagaagtgcagagaagagatggtatcaattctactgaaactattgcaaaaaattgaggaagatggacaccgccttatcatcgaggatgatgaagccagcatcatcctgatatgaacaactaggaaagaaacaatgaaaacagaaaactaaaagccaatatgcctgatgaacaaaaatcctaaacaaaataccagcaaaccaaatccagcagcacatcaaaaagatcattcaccacaatcaagtaggcttcattcctgggatgcaaggttggttcagaattcacaaatcgatacatgtgcttcaccacataacagaattaagaacaaaaaccatttgatcatctcagtcgatttgcaaaaaggctttgataaaatccaacatcccttcatgataaagaccctcagtaagctaggcattgaaggaacatagttcaaaataataagagccacctatgacaaacccacagctaacatcatactgaactgacaacagctggaagcattcctctacagaactggaaaaagacaaggatacccactctcgccgctcctattaaaacatagtaccagaagtcctggccagagcaatcaggcaagagaaagaaataaaaggcatccaaataagaaatcaagtgaaattatccatctttgctgacaatatgattctatacagagtctaaagagtccgccaaaaagctcctggaattgatgaatgacttcagtacagtttcagaatataaaatcaatgtataaaatccagcattatttctatacaccagcagcattcaagctgagaattaaatcaagaatgcaatttcatttacaatagccacaaaaaattaaaaggcctaggaaaatgtctaaccaaggaggttaaagatctctgcaaggagtactacaaaacattgctgaaagaaatcatagatgacacaaacaaatggaaaaacatttcgtgcttttggattggaagaatcaatattgttaaaatggccatgctgcccaatgcaatctattgatgcagtgctattcctatcaaactgccaatgttgtttttcacagaattagaaaaacatattctaacattcatatggaatcaaagaagagcttgaatatccaaagcattcctaagggaaaagaaccaagacagaggcgtcacactacctgaattcaaactatattataaggctacagtaactgaaacagcatgatactagtacaaaaatagacacatagaccaaaggaacagaatagagaacccagaaataaagccacacacctacagccacctgatctttgacaaagttaacaaaaataagtgatggggaaaggactccctatttaataaatgtttcttgtatagatggctgtccatatgcaggagaatgaaagtggatccctccctttcaccatatataaaaattaactcaagatggattgaagatttaaacgtaagacctcgaaactctaagaatcctagaagaaaatttaggaaacatcgtctgagcatcggcctttggaaacgatttatgactaagttcacaaaagcaattgcaacaaaagccaaaattgataagtgggacctaattgaagagtttctgcacagcaaaataaactatcaacagagtaaacagaatgggagaaaatattcagaaactgtgtatctgacaaagatctgatatctagaatctctgaggaacttacacaatttaacgagcaataaccaaataactccataaaaagtgagcaaaatacatgaacagaaacagacacttctcaaaagaagacattcaagcggccaacaaacatgaagaaatgctccactcactaatcatcagaaaaatacaaatcaaaaccgtaatgagataccatctcaaatcagttagaatggctattattaaaagtcaaaaacaggtgctgggaaggctgtgtagaaaagggaacgcttatacactgctggtgagaatgtaaattagttcagccactgtggaaatcagtttggagatttctcaaagaacttaaaacaggaactgtcattcatcccagcagtctcattactgggtatatatccaaaagaaacgaaattgttctaccaaaaagacacatgcagttttatgttaattacagcactattcacgatagcaaagctgtggagtcaacctacatgcccatcagtagtgaattggattaaaaaaatgtggtacatatacaccacagaatattgcacagccattaaaaagaatgaaatcgtgttctttgcagcatcatggatgcagctggaggccattatcctaagtgaattaacacaggaacagaaaaccaaatattgcatgttttcacttgtaagtgggagctaagcattgggtacacttggacataagttgggaacaatagacactggagactgctgagtggggttgctaaggaagggggaaaagggttgaaaaacctttgggtactatacttactacctgcatgacaggatcattcatatcccatacctcagaatcatgcaatatactaatatgataaacctgtacatgtagccccgtaatctaaaatgaaagttgaaattacttaaaaagtatttttttaagaaaatttgaatgaatagtcagcatgataagggataaaaaacaaaatccagaggactgttaataaccatattgcttgagaattttggaatgtcaaagtaatggtctaaatgattgagttaattttaataggggttgtgccccatattttaattttctttcctaaagaaaaatagcagtactttaccatataaaaattacttgtactaaatttagtgtcaataacatgataactaccctttattaagcaattattttgtgtacaatatagtacatccctttgtctcatttactcctcacaatgccgtatgaggtgggtcccattattgtcatcttcatttaacagtcaggaatcttagggcttagagaggtttagcatcttgcctatgttcacacaggtagttagtggcaaagtttgtttagctcattcccatctggtggcttgaagctatcattttcctaatcagtacaccattactgcttccatagtgcaagaccttggaaagatgtgatcctctctgaatattccaaatagttctcacatatactctgacttgttttaattatgactcaaatagaagcaaacactatttctttataagaaaacgaaccacttggaagttcctatccattgaagatgtgctcagctgatctccagatgtgttaataactctattaaatttttatcttgaagatttatttcaaaatcttggagatagttgaagaatttttcatttattatgcctgaataaaagaaagactttaaaagtacctataatctttgagaaagattgttctggacggttaatagttttcactctagtaggtattaatttatcttgttagcatttcttgagcagtttcaagcctcctggtcacatgtagtacttcctttcctccaggtggagaggaaagccattgcctagttacctgctttaagagatgacaggctccctggctttgcttgctttaaggtggctaagtcaggctgaagaataacagctacatgtcatatagcaggacttgagagctaagtttggtgtgtccctatagtgctatataatttaaatagccaactaattgttgggatccctgttccaatactcctcaccattctctcataaatgtctgcatcccacctgccatctttaaacataatcttttgcatcctccccagaaacagctctcattatcttgcagtgaagctgtctggcatttgtagagatacttgtgattttcagtttgtgagcattttacacatatgtgttggtttacaggtgtcatgtttggattttaccataagcttcattgtattagtttgctagggcttgaaataacaatgtcccacaatctgggtggcttaagctacatgtactttctcagttctagaggctagaagtctgaaatcaaggtgtctgcagggtaggttccttctgaggattgttagggagaatctgttccatgcctctgtcctagcttctggtggtgtgctggcaattttgggcattcctggcttgcaggtgcatcacccctcttgttgccttctccacatggcattcttccagtgtgtgtgtgtgtgtgtgtgtgtgtgtgtgtgtgtgtgtgtctgtgtgtgtctgtgtccaagttttccctttctgtcaggacatgagttatatttgattaaggtccaccctaatgatctcattttgatttgattgcctccataaatgactcatttcaaaaaaaaatgcattctgaggtgcttggggttagaacttcaacatatctttttgaacagttcaatccataacacttactagtgtcaaacctcactaacttggcattgcattcatgacagtgttgttctttttctgcctgtaatacgtgtcattcatcctttacctattggttctttttaaagtacaaacaaaggatatttatttgccccatcaagagatttgtgtaattcttttttttttttttgtttgagacagggtctcactctgtcgcccaggctggagtgcggtggtgcatgcagtcttggctcactgcaacctctgccgctgaggcttaaccgattctcatgcctcagcacccccgagtagctgggactacaggcacgtgccaccacacccagctaattttcatatttttttgtagagacggggttttgccatgttgcccagactggtctcgaactcctgaactaaagtgatccacccacctcggcttcccaaaatgttgggattacagacatgagcaaccatgcccagtgggtgtgtgtaattcttgattgtggagtagttgctattaggcatagtttagaagcttgaggaggaatagaaagtgtttttaattattcttgattcttttggatctcttatccatgtaggaacacatacactggagagaagttaactgagattcctatacaggtagtctgctttgtagtgagcttggcttctaacaaatggctggttaaccctgttcacatcaacatacaaaactcacaaatatgcttttaagaaaaagctttgaacttaccacattctcatatttgagtagaaagtttttgttttttgatcagtgttctccagatttcttctctgtctctctctctgtctttgtctttcactgtctctttgtctctctctctctctctctgtttttatgtttagatggggggtggcagttatcattacttctgactgctgactgctgatctctcttctggtttggttttctgattatgttctctcttctaaattcctgtagcatttaatataggattaaaaaattatgcatcgtataatactttggaaaattaaaatatatggcattttaaaatgtctttaattcagcaccttgaaatcatctttttacctctcagtttaccaaggacttctgtatattcagagatgtgttaatattttttgaacttattcaactagtgatgaatattcattgtattgtttataattatgccttttttatgctgtcggtgaaaaagaggtgactcagatgaggattctgccctcgggaaacttaatcttgaagggagatggtacaaatacataagtaattctatataaatgaagatgtatcaatactatattctatataagctagaacgtagtgagaaaggcccaggtacacagtggctcgtgcctgctatcccagcactttgcaagggcaaggcgggtggatcacctgaggccaggagttcgagaccagcctggccaacatggtgaaagcctgtccctcttaaaaatagaaaaatcagctgggtgtggtggcatgcacttacaatcccagctactcggaaggctgaggcacgagagtcactcaaacccgggaggcagaggttgcagtgagtcgagattgcactattgcactccagcctgggtgacagagcgagactctgtctaaaaaaaaaaaaaaaaatcgtaaaacaaaaacatccaggtaaaatggtgtggggtttcaaagggaatgaagagaggatgatgttgactaaagtattttaaatgttttctctccagtggccactgattgagtttagaagccacatctttgtgtgcttttaaatcaagcttccctcatcactatgtgtctttgtggaatccttggcactgttcccttttggggcttactccttccccccaagcaaatataatgagatattcactcattggttatcagactctccactaaatttgttgaactttgagggccttaagctaaaagtaaacagattcactttgattattgtggtagttttggttaagcaaaagtgttttgtttgagtattgaagtggaattggctttaagcaatatgatctgggaggattggtggtttgcttatgcaagggcacccatgaatacctggttgttgaaaataagagctactacctctcacaacctcaagacccaaagttgagacatagtgggacccatattctcctcaatgtactttgatctgctggtagatcacacctgagtcccccaggttctgcaccctacctcaagtagtgagtgggtatgagtctttgctctccctggggcagggtcctctcctttctttcctactgaatctagggggtatgtgagtctatagctgcttttgattttctcagacttcacatgccatttagaggaaaaacagcttgctctttgttctgcttctagaattggagtattcagactaagttgtcccacagatgatcctgatctctggtcactttctctgcttatgttcagtttctgttgaggtgaagatgccaaagcattacttctgcaggagcctgccaaagaaaagcctgcccacactggtttgtgccagccataaattgttatctcagaggtcaatgagaacaatgaaggaatttgctcactttatgtgacatgagatttatgtgattgaaagtgccaatcttcttttagcatttcatcctgccaatttgtgcagaataattgaacttgaattaaacgaccttataaattgagagactacaccaaaccaagactgaaatatactaaatacagttcaaagagctcttcaaaaccccaggagaaataggggggaagaaatgctattaattaaaacaagcagcagcgcaagaagaaaggcagcagcagttaaccaccttttcacaatatgtgagattaaagatgcagttcttactgcttgcactaaaggtcaagttcattgaaacactatcaggaggagtttgaagaattctagaagtcagtaatccccagatggaaaacactggattcctggttcattgaagctgcaatcttaagtgttgacacctagactgtcatgtggacttcagagtcctgagaggttacctgcccacaaatgggagctttctacaaagagacactagtctgattacattttacaagctctgctgtaggatgctcccgaggcccatgctgtttctccttaggtctgctctgacttcttttagactttgggctcttggaccaaagcttattattacagctcacttcaaagatcaagcctgtaactgcactatttaatcaatgaaaataacatcacagtataatacaatcagtgttagttttataatttaatgaacaaaatacagcattacaatgtataacaggataaactgagggaagaaaagctaacagagtaaatgcagttcacaatatgggattttccgatctgtgttccttcagatctgtgtataggtgaaagtttgaaaagtagggttcctatccttagctagtccaaggaggataatagcccacccaccaacatctgctaattttattttatttttaaaccctaaatcctactcaaattgcagattcagccctgacgtcctttagaggaagaatgcagacattagagtctggttcattggtacagctggtttcatttagcttgcagcagataaacaaacaatgcttaatctttttgatgaaagtgacagtgaggatattgtttaagcaagaagatgattttaattattagactaaattgtactggaataactttcctattagacagtgtttaaacgtattggcctctcttagccatgtttattatcaggttctttgatcatttggacaggagacgctcaatacaatcagtgatatttgctgttgttaaaattgtggtcatatgtcagctatgcccatctggtggaaatggaggcactctttggggtttttttttttttaaagagttagtgtagaaatgttcaattactgaaataattgaaagtcattatgtgaggactcctaaaacccctctcccaaagtggtttttgaggaggacttggggaaggatataattgacttcaggttaaagcatacccatgttcctgagctgctttattgttactgtcatccttttgtttaaaccaggatggtagggaaggagcatttctagtctaaaccagtggttctcaactagggataattttgtttgccaggatatatttgttggtgtctggagacatttttggctttcacaacttgaggagtggtggtgtcactggcatgtagtgggtagaggccagagatgctgcggaatatcctatgaatgaacaggacagtctcctgcaacaaagaattatttggcccaaaatgacattagtgctgagattgagaaaccctggtcttaagaaatgcatggaggcagtgtctgtttaagatagtgcattccttttgaggttgtagtaactctctactgtgttctgtgggctgagtgggccaggcaataggtgtgtagtggtgaacaaaattgacaggtcccctgtttttattaagcatattatccagtgagggaggcagaaattaatcaagtcagcagacagaatctgtaattgtaaattatgtaaaggaaaagagagctgaggaagaattaagaccgagagtagtgggttatgtatatttgcataagagaggggtatagatagtaaatatacattggatggatggaaatggaagccttgttgaggagaggacatttatgcataggtctgaaggaggagatgtcaccaggcaggtaaagagcaggcacaagagtgtttcatgccaggccctgaggtgagaaagagcttggtgtgttttataccaaatgaaggagctaattttattttattttttgaggtatggtaggactcatagttttctcattgtactgggatctgctggtgggtcacatctgagtccctccagggtttggcaccctccctcaagttgtaagtaggtgtgaatttttgctctctctgggatagggtcctctcctttcctcctactgaatcaagggggtatgtgaaaagtgagagagcacaaaaacaatgaacagataagttacaaacgtgacagatattaatacagacatatcaaaatcacttaaaatgtaattggtctaaagataccaattaaaagacagagattgtcagggtggataaaaaaacaagacccaactatattttatctatgaactatcctttaaatacaaaggtgcagattgaaagcaaaaagatagagaaatatatgccatgttaacgcaaattaaaagatagctggaaggcccggtgtggtggctcacccttataatcctagcactttgggaggctgaggcgggcagattacttgagatcaggagtttgagaccagcctgggcaacagggggaaaccctgtctctaacaaaaaacacaaaaattagccaggcatggtggcacatgtacctgtaatcccagctactcaagaggctgaggcagaagaattgcttgaacccggaggcagaggttgcagtgagtaccactgcactccagcctgggcaagagagtgagaccctgtcttaaaaaattaacatagctgcagtagccgtgttaatttcagacaaagcaagtacttctgatgattcagaagatcatcaagattaaagagaggcattacatgatgataaagagcttagttctccaagaagacaaccaactttattgtatacacaccaaacaacagagtgtcaaaatacgtgaggcaaaaattgatagaactgaaaggtgaaatggacaaatccactatggtggttgtgacttcaacaccactttgtcggtaattgacagattaagcaggcagagatatcactaaggattcgatgatctgatcagtactgccaaagtaaacaaagtggaagctgccaatatttcaaggcctggacccagaactggcacagtgctcctttcacctactcttgatcaagtgttcaaagagaccagatccaagcgtaggggccatagaccacacctctcaatgaggagtgtcaatgaatttgggggccgtgttttaaaaccccgtatagagtttggtttttattctaggctgaattaaatctttggtctcatctttgtacacagttctctcagctatctgttctgaacatatatttgctgactcctttttgggttaatttcattagattttagatctctccttgagaacaataaagacacagggtggggaacatcacacactggggcctgtcgtggggtggggggatgggggagggatagcattaggagaaatacctaatgtgaacgatgagttaatgggtgcagcaaaccaacacagcacatgtatacatatgtaacaaacctgcatgttgtgcacatgtaccttagaacttaaagtatacatttaaaaaaaggttctgtttagtataaatggctttgtatagagggggcccttctgtcctagtgtacctggcacagttctggtttatgcttgtcattttcatgattattaatagtgctctttttactctgaatactgtcccatttggatgataaattatatgatcatattatataatttttatttttctggaacttggtaaaatattttgccaaaaaccgaaatttgattggaatatgttattgtgggatccaactgagtatttagagccattaatgtcagtgaatctgtgggagcatttttgaacagtttatgagtgctgttgaatctgtaatgcagatttgtgaattgattttaaaagtttcgtgggaggttaatgaactttatgtacagttcttagacagaaaggtctggcaattagacatgatttttgtgaaataggaactaatcaatctaaaattcaaatgacctactcaggtgccttactactcgtaacataaatgttaggcttagagtaattcaagatagctgaaatgctggaaatgtgaaagaattaacaaggtggggtttgggtgaaattaggtgctgttagagctcaaagctaacaggttgcggtgtcagtgagttttagtcaaatgctcccagtctatttagcactggctcatacaaaggaagtatactgtactactagtaggaattgtaacaatggagagatggcaggtaccttaaaaatctaggattgcaatttgcatagagtaattcagtgcaagattgtatggtagacactgttgatgttggggagatgatctgacagaaaggaaattattttaaagatttcaggcgtaagacttttttttatgcttaatggttgattcttgagcaaatatgttttcccttccttctagagttctgaggaaacagacataacatttgcctgtataaacaaattctttgaatttttaaaagatatctgtctctagttcagaagggtctctttgggattgctgtgtttttaactatctctgttttcagggacttaatgatcctagagatctgcaagcattgtctgagctgagggaaaattgtaaacatcaggcactttggttaatagttgaaagacctgttgtaacccaacagagaataaggtagaagtcattcctaattggcctgatgggtgagacaggagagtgaattctcatgcagcttagcagtcagcataggtattgaaagacaagcccctggggaagcaagagaggaaccaagggcttttgttgtatgtctcatcaaacctcttaggagaaagaagagggaaattgagatattgagaaaccaaacaagtagtgttacaaatgaggcctactgggagtcccaaaggaagccagattcctaatgagaaagcaatggtctaggttaaacagtgacttttttattaaaaaaagttattttttttttactacttgttcttgagaaagtttcatggctaagtgctggagagttgagggcacctggaactgtgcccaaagcagagcataaaggattattaaattaaaagaatgtgtatcatctcagtgaaacagaagggatgaaataacagaccaccaatatttagagctgggcaaagagagaagtgaagaacagaggagagattgtctagagaggtggcgagaaaaccagcaaagtaccaaggaagaaagagagtttcaaagagcatggacgatgatgtcagatattcagaaaagtcaaatcaatgaatcctgaaagtaatttattacattttacaactaggaaggttttttttttttttaagaatgttaagggactggtggggatggatactaattattttgtgttgaagagagaatgggggatgaaaaaatgtagggtaaaatacatataagctactctttttagcagtgaggcagggaaagaaaagagaactagaagaaaggggagaagtgttttgtgttgtttcagttttaaactaaatggggaataatcgagtatgtatatagactatgacaaaggagtcagtagaaagagaaaaagttattaaggaaacacttgaagtatattcttgatggagaaatctgaggagctctattttctctgtcacttgaactttatttcatatgctccatgtaattggtcttcctgtttctttttctaataatgtgtagatatgaaatagctctttttattgtcggcttcatctcatttaggatctagacgtataagaaaattatccttcttaaatatcttttatttttattcatgttcttttgaaattcaggtacatcatggaactctctgtgtagcacatttgtttttcttctttgctccattttcttcattgatactagttgtgattttttttaatgacatctctttttttgtgaattttcttccttgataccacttctctctttgtaatttagagttatgaaataaagctactatttattgaacactccatttttttcacctgtgaaaacagggttaataatagaattgatttcatacagctgtgaagaatgtatgtaagcaaatacatttagtgtttagaacattgtctcacataaatgttcaatgaatatcagctacttctttttcgtttcttataacaatcctagaagagatttgagataatacaatttcccttattttacgggtgaagaaactgagacccataaagtttgagtaatttgcctacaatcacacagctaagttccagggccagaattcagatccagttagtccaactccagagctgagttcttaacttttaccattttttgtaaaacttcaaaatctgctttcttgaaatctattcttaccctacccttctgtcatgccatgactatgccaattgtaaggtccagggtcaggtttgagccccagccgaggtccgaggggagtgggtagatgggcagatagctgaaagaacactcggggggccataggcaggggaatatggttttattcagcagctctctcatcaacagctctctcacactgtccgcctttatcttggttgtctgctccggctccacagctcctctcagcagccagctctgccgctctggctgctcccacacacagctgcacggccagctctcccttgcctgcagtgtcagcagcttaactccttccctctgggcatgagtgtgagccatgtcgagccatgtagtaccctggctcccctctgtccatctgcaagatggacaactccggtactctctttttctctaggtgcaatagccaagccatgccatgccatactgacccatgctaaaccaagccccccatgcacagtgtcagcagggcaattatacctttaacagacaataaataatggcttacagccaagtatgaacttacacaaacaggttatttaacaagtggagtatgtgcctgcatcctaaactcactgagtcatgcaggcctggatgtctgccttggcctatttcttgaccaaagcacatccatgtaccttataccttccttgttaataattaactgtagggtacatagccaatttcttgcataattctcttattttccctctgtatccatgctgttttttctctctagtcatttattattaatattctccactgttctagtcaattccacagtgaaatcatagctattttccccccttgtttcacctaagtgatttgtgagttttggtatagtaggtgcctgcatgaaatagagcgctcactgctcaccttccctttctatcagatagatttattttggacaaggttttctattcctttgctgccttctcatgtggacttcagcccaagatttgatgggctccatttctcttactacctttttattcattgccatataagcatatgacaaacataactcctgactcgccagcacctttcaacccttttattcttctcacaaataacataggaactaatattatagtaagaactatacctgaaaaaataaaattttttctaatacgtttttgagtaaatcagaatctgagccctcttgagcctccacctgaggtatatccccagctcttgctgtgaatgtagttaagttttcaaaattgagttggggagacattgattctctcaacctgttgtgtcctttgaaactcttgccaatttttcattatctttgttctcatgtttttagtcacttccttgtacattcatatctacgtaggtatatttatattgtttacacgtatttattcacataaactgtcagatacaactttcttaaattgctaatcactgttgtgatgattgatgtgacctagactaacttaccattgaccctctgttaaaaaagggctcgtttaattagtaagacctggagagaaccactgtatttaaggttatttcatccaataaacgtggttttgtagaggatgtttatagttgtaaatgtaattattgtagctggcgcagccagatctctatttagagataatattaggagacacttaatgatcagcatgtatagttatgtttctctttctacttttcaaaaacttttcctggatttatatatatttgtgcacatgtgtgtgagtgtgggtgtgtgtatattacaaagaaagttcagagaggtagcagcgattatttttgaaagttggagaaagcagagttggcaggatgaatgatggccctgtgtttacgtatgtcattggtaacagctgcactgaaaagttgggcgtctcagtttctcatctgccactttcttactgtacttcagagttggagccattccattatctgaaatgagtgaattgtcctcttttttcgaatatccgatataatttgtattttctttttagtcactcaaaattggtgatttttatagtataccgattggatgcatatttgacaactaagcaattgtgttctctcacttagattcaaaatctgtgagttcagctgactaattagtggtctggatttttaaaatcatggtaaaacgaagacaataaatgatatgtttcctttaaaaatttgtgtatttgaaaacaaagataaaatgaaaggtaatcctatgtattataagcagactaagttgcttatctaccatggacacaggacattacttttatagtgtcgatttttgatagtaatttttatatagctacattccaggcttttttgaacaaaagagttaatgttaagaggcaaatggtagacagttactaatcagtgattaaaacctttgtttgcagatattttacatacaaaaatttagacatttatattcaatttacctaatttacagatatgctactcttaaaacacttctttttataagctaatatattatacaagccaaagtcctatttattttctgggctagcatttgtatctaaggtgctattatggaaggatgactactgatttcccatctgtttcagttggagaagagtcatgccaattgtattcattgctcattttgggtgaaaactgagcacatatctaactgcttttgagtatatgttgcccctgaagctaggtagtttattcttctaacactcattttcaacttaagtgaaaagcatatcagaatgctttttattagtgactgtaaggattgacacacacacaaaggagaaacatttaggaaagctgacttctgtgatttctttctcttttctttctttttttttttgactgagccctcattctgtcacgcaggctggaatacattggcaccatctcagctcactgcaacctccgcctcctgggtttaagcgattctcctgcctcagcctcccgagtagctggaattacaggcatgtgccaccacacctagctaatttttgtatttttagtagagacggggttttgctatgttggccaggctggtcttggactcctgacctcaggcgatccatccaccttggcctcccaaagtgctgggattacaggcatgatcctctgcgcctggctgacttaggtgattgcttacttattttatgaatggtcctatgaacagagaaagctgatgtaatctgtcctttgtagttgtttgctgttttagtcctcatttgagatagttggacttcattcacttctgaagtgtttattgaagccaacttgtgtgaaaggcatctatccaaggaaaagccatataaacatgaattttcctcaaagtggccaaattcttttttctcacgtaaaaggaaattagatttttttattagatgctagatttggtagctgaggtttaacattactgaatcgcttcttggttaagaccttgccagttggccttactttgtagcactaaacgcagcaaagcagattgctctatagaaaagggatgctaatgtcctgtttgatggtgatgaacacacatgtaattgcttgtaaagccctgaaagtagcttagatgtttttaacaaattgtgtattcaggttttcaaataattacaatgaagatttgctaccagattttgtagtatgtatgtataactataatagtgaagtcttggtcttggaattctaactttttagtatacttatcttttaagtatattaacgttatagtctgttctgaggtttatgtagtggacttaaaaactcagttaattgacctttattgggtaggattaaaaatgtatttttaacttctttaggtgaacattgttgattgttagcttttacttcactggttcttaattatcttcattcaaagctctactttaaaaaatgtagtaatacaaacgtggattgatgtccagcaagatcaaatatcacattacttaactggattaattttgcagcagacccagcatccacatccctctggagtctgctgtctttccccatatccttactgcttcctttgtttctgctctccaggctttaaatgtgctttgctgcctcacttctgcaactttgttcatgatagaccccttcacgcttaagtgacttgtgtctccttttgacatgcctacaactgatcccatcttcaaggtttaactcaagccccatctataccaggaaacttttctgacttctgacaagactatctccatgaccaaactttgtcaggctcctccaggccctcttcttaagtaggcgtcacccttggcccccatccttgacagcgctgcacagaccagttttagcaagagtcttgcttagtcagtctagagagaatcccctcaccctgatgtctgatcaccctgcctgcctcagtaagaatcatgttatgtccgcttagcaagaattccttctagccttgatgtctcctgttagtaattttccatccaccaatcccccagcctgcttctgtctataagtcctcacttgttctttgtatcctgagttgaccctaatctttctttccccatgcaattgtcttgacacctatcacaatagtcttttttactatttaaacaaggatcggaataattttttctttaacacttcttgcatgattcagttactgccttgcttggtatctcttttagttcctcatatatatgaacttattcttcagtacctgttgaaatgttacagcttcttttctcccagagtttggcgagcaggagggagtgttacagctattttactctcacagtttggtgagttctgagttcttgtcttatgaccaaaaggaatgaggtacacagacactggagaatgagtaagtcagagtagaattttattgagcaacagaaggaaagctctcagcagcgagaggggacccaaaaatgggttgctggctgcaagcctgagtctggggtttttatgggcttagaatggtcaaatatgtgctgattggtttatggataggcttgagaagatcaccattcagaaagagagatgatagtgtaaagaaccaattgggggctgaagtgaaggcttggcctgggaccaatcaggagctgaagtgaagccttggcctgggaccaatcaggggccaagtgtactgaacgagaatggacattgtcactctggtcactggactccatctggaactgatagtttggtgttcagacttcaaaatgtccttggcttgaaggtcgagtttcactgggaacccgttcctgtctgcctaggaatttgtctgcctcctattgctatcaacagtactgtaaatagatgctcagttaataaatgttacctgtgtaatgattggaaaatgttttggaacattccaatcaggctaaggttgatgagacaagactaacagatggacttttgggatagagatttgttgtcaggacatggagggtcttcaactgaacatttggatatagtctctgtacctgggttcatagagtaacatctgctagcagaattctcctgaagatgatttgattggttgttttctgtcactgtaaatagagcactcccactgaactgaattccagccaggtaggttctgcctccatgtgcctgccaggcctctacactgctttctcactcagtcttctgttgcctagctagcaagattgctttcaccaataaatcaaaatgcaggagccatgaaacattatgaaagaaataagtgttgggatcattttccttacaaggaaggtgtgtgcttattggaacttgaggcttcctgggtgatatggtttggctgtgtgttcccacccaaatttaatgttgaattgtaactcccaatgtttggggagggaccttgtgggaggcgattggatcatgtaggcagatttccccgttgctgttctcatgatagtgagtgagtctcaggagatctggttgttttgaaagtgagtagcacttccccctttgctctctcttcctcttgctccaccaagtgaggaacgtgcttgcttccccttcgcccttctgccatgattgtaagtttcttgaggcctccccaaccgtgtttcctgaacagcctgtggaactgtgagtcaattaaacctcttttcttataaacaaccgagtttcagatatgtctttatagcatgcaagaacagactaatacactgggtttctacttaagcccatccactaaaaggatatattattaaaccacagcgaaatagatgaccaattattaaagttctgtagaatgttgttcttgggaaaaatttacatatgaaaaaaacctaggaaatagacacacatgttgaagaatttaactctgaatagtaagattactattggtgaaaaatttttctgtactgaccaagtattctgccataaacatgtatcaatcagtgttataattaggataggacttattaatgtcattctaaaatatattggtttattttgacgtttgtaaagaatgattagttgaaaacctccaagaataatgacactactttcagattaaataatttgatcatgagtgtcttgaaagaaaaaacagttataagcagagtacttttgatgaacaaaggagtagtataagagtgtggactacacacctttcttctgtggttcatgctttaattattgcaaccccacagataacttaggaagtctgaccacctagatccaaattgtgaacctgcctcttctagttgtgtgacttacaacaaattatttagctaccctgtgtctcagtttctttataaagtgaagacagtggtagtatctatcacacagaggtattagcgtgattaaatgagacaatgtaaataaagtccttggcccagggcctgccgcatagtggatacctgaacatcagtgctagttttgcttttactttatttttagagacagggtttcactctgtcacctattctagagtgcagtggcaaaattatagctcactacagccttgaactcttggactcaagtgatcctcctgcctcagcttcccaactagctgaaattaaaggtgtgagccacctcgcctggctctatttttgaattaaagactgttatcttgattttaaatttattgactgtgtataaaaccagttcattcaaaatcaggctgatttgtactctggcttgcttggtaggttttagaagtaacactggcataggtcttctcttctcttctctcctctggcataggtcttctcttccctcctctcctctcctctcctctcctctcctctcctctcctctcctctcctcttttctttcttttttttttttttttttgagatggagtcttgctctgttgcccaggttggagtgcagttgtgcgatcccagctcactgcaatatccatctcctgtgttcaaatgattctcctgccccagactccagagtagctggaattacaggcgcttgccaccatgcctggctaatttttgtatttttagtagagatggggtttcaccatgttagccaggctggtcacgaactcctgacctcaagtgatctgcctgccctggcctcccagagtgctgagattacaggtgtgagccactacgccaggccagcacaggtctttcttataccagttatatataacgcttagaatttgttctttttaaaatctatttagctcttcagttatatatgaagtaatataaaacctgatcttcaacatgtgtaggtagttctttttcaactttatatttaattgaataactttttaacttgataatggtcttgcctataagacagttcattttgagtgacacccttatttttagaacagacctttagattcaggtaatcagtgatgccatatagcattgttctctaatccttttttgtcataaaagccttaaagtaaataattttggcttttcttgatattatttttaatttcattttgaatatattcaatggtaacatttcctataagtatgcaagtaatacatttttattggggaaaataaaaatcactcataatcctcttgtcttaatatctctctattactttcaccaggctactgtgaaattttctttctttattctccaagggcctttgcaggcaaccagaaaaagaaaatactcgcttaaaattgtggttataacttaaacttcaggggtgtgtatgtgtgttttggtctctattagaatgggtggagaagagtctgaactctgaatacccctgccttaatgaccctcgagggctgttttaattgtttctcctgctgttctaagcttcacttaatttcatatgactatttttgaatgcgacatgcaaaatctctagttaatactatttggcaatgagtagtacttggggactcctcagagcctcatggtggtgaatcagtgatgtgatttttttggtgcatctcatttcactgctttggagatgcttttttcatgagagtggaaacttgacttttcttgtgtgatcctgggtgtgtatgcctctgttagagaaagagggggcatttatgactctgctcaagaaacagaaacagaatgctttaaacacatctttggaccaagaggcttgaaatgctgtaaagttgagcatctgatttatctgcttttctttaatcctagctcatgcaatgattcattctcatcgcgatgctgtatatggcttttaaaacagaagattaggaatgaatgggtttgactttgatttttagatacagtatgatatgtagtatgtaagaattagcaagagtttaataagtaatcaaagattgaggaaaagtgataatatcaagaagtatatccatttcttttctgcttttctaaaacagtttctgtgggaaaaaaaagctactacagataaaaatctatttgaaatggcaacttgacctcagaatgagaaaatttgatttctctagaaatgtgaaatacaggtttttcaaagacctcagtaatgtgtttctccagacaagtgtgcttgaaagtaggaccagagaaaaacgaaaatacctcctcctccccctcccccttcccctcccccttcccctccccctttctcctcctcctcttctcattttccttctcctcctcctctccttttccttctcctcctcctctcctctcctcctcttctccttctcctcttcctcctcctctttctcccccccacccttctcctacctggcttcctccttccccttttcttccttcttagtttttgttatttggtgtttgtttgccttcacagaattcctttcttcatagttttcagtgtatgtgggtattatatggtacatgtggcattatatggtacatgtgggtattatgtttatgtataaaaactcatagagaactaattaacatagtaggtttcaaatctcagtatgtgtgaaaaatcaatctgaaaaactcataaggatctacatttacttattttttatgaaactatcccatctcatcaaacacggcccttctctagtaatttcaagagtatgtgtaaacaactactttttacctctgtggatgacttggagatttttcctgtgctttgccttcttttgatgtgtttggagttcttccattcctggtccttgataactttgccttacttttgtttagaatttttccttctttcatcattcattttggttgcttggtactttcctgtcttctctgttagctggtaatctcctcaagggctgtatgcatgttatttcttgctccacctggaacaattccttgcatctaggaagtatttctcttcaaagtcctgagaagtatacaacccatagccctaaaactccagaaggttaatgtattaaaatggatgattaaagtctctcaaaaccgaacaatcaaacatcaaagcagataagcacaagtcatctcaatgagagaagtggaagaattagaaaccgagtgtgagctcggctttaaagttcacacacacaggggtcatggggatagaaaggtcacagaagaagtgcaagcactcacctcctgatatcattgtttccagggagagttagtttcaggcatgaaagtgcagaacaaatgtagatgtgaattaaattaacaaatgtcttaggacatttgatagtactttggttctctttggagttctgattgaagacttgagatgactgttgcacagaattttaaagaaatttggagttgaaactgtttcatcactgtccgtgatctttgaggatctatgaaaaattggagaggcattagcagtcttgagatgtccaaacctttacagaagacgataaatctatgaaccagaaccgaaggaaatggtgtgacattccccttgcacgctcttcttgttcccccttctctaatgaaaatactgttccgatggtttctcaacaattagaaagcaaaatagtgacacgaagttagttaaaaaaaaaaaaaaagtcatacttaaataaccttaattccttgtttggatcagatttttaagctagtagacttgcagaacactgtagctattatatatctgcttattttaaaaatgttgctaaatgttcccagttatgttctggtagataagaggatcataggcagttggatgatgtgctgttgctggtggtggatctaaaacaggctgttcagctatacctgagagtagtaagttttccagtaaggtgctgtttcagtatctcttttacgtggtaaggacttggctcatttgtttaccactgagctttcaactatgaggacactcaaaatagttgaaaaacttttgaatgtttatagtaaaaaggcgacttcagttttggagagaccaggcaaaggaagagaggcagtgagaagctggtgttggaacctgaaggtttaacacaatgattttcagtcctggttgcacgttagaatcactgcgggtgtttttacaaatacagatgctaggactttaccccacaccagttaaatcaggggcagagctaggcattgttgtttcaaatctcctctggtgattctgatatgtagccaaggttgaggacctgtaccttgtcatctgtgcagctgcaaaagctcggcccatccctctccatgctttgcctagtgcacataggggcagctgtgccgagcagcagccaaaacagtagcctctattccactgcttccaagagactgccaggatggaatcctctgtgcctcacatcactgtgtcatatcccaggcactatccaaagtaaaaaaactccctgatcatccactatgcctcagactgcaccctcatatttcttcttcccttttgtttttaaccatttgcaagtatcatgtttcttaatgtgtgccccacactgtccctttcctccatcctttaggctctttccatgtgttctagatatagaacatcattctctgatcaggaaattcctacatattttctacctcttctctgagtgtttacttctgctttaacagaaaactggctgtctcttgcagtcccccaagtaactcataaatttatatgtctggcctagatttttctactgagatccagactcataaataccaatgcttcctttatgtctccagttggatgttcccagactaagatctttttcccaaacagaactcttgatacattttgtctaaatctttcatcctttaatttcactcatttcagtaaatgatacctacatccacttagatgctaaaatcaggaagtaatggagtcatcctttataatttccgtatcccaattcagtttatcctaacagcctgtttgttctgtcttcaaaataccattttccttttttcccattgctcttaccagtaccctggtgagaatagccaccaagtttcacccagagccccacaacagctttctgactgcccttccggctcccactgtgtgctcctgcaggaattctccacaccatagcgagtgagctgcagacacagaagttaatcatgctgttacccttcttaagatctttcagtgttttttgtatcagtcctttatgcagcccagaaggcccttcgtgatctggctcctgtcctctctagctcttccacccacacctcactagctctatccttcttcccccattttttctttcccttcctccttctcttctttatttttgtttaacacatcacattctcaccctctgagcttttgtgcaggttgttccatctgcctggaatgttcttggtttattcttttatcttccttttttcagcttaatcctttcctgtggaatgtaaaaattgaccgaccttccttccttccttccttccttccttccttccttccttccttccttccttcttttctctctcctctctcttttctctctttcttttctttctctcttcttttctcttttttaagacatgggcaactggacacggtggctcacgtctgtaatcccagcactttggtaggccgaggggtggatcatagtgagttcaggtgttcgagaccagcctggccaacatggtgaaaccccgtctctactacagatacaaaaaattagctgggcgtggtggtgcatacctgtaatctcagttactcgggaggctgaggcaggagaattgcttgaacccaggaggcagaggttgcagtgagccgagattgcgccattgtactccagcctgggcaacagggtgagactccgtctcaaaaaaagaaaaaaatataaaaagatgtgcatgctgtgttgcctaggctgaagtgcgtggtacaatcatagcttgctataaccttgaactcttgggctctagtggttccccgacctcagcatcctaagtagctgggactacaggcacgtgccaccatgctcaactattttttaaatttttgtagggagaagggattttgctgtgtggcccaggcatgtctcaaacccctggtcagaagtgatcttcctgccccagcctccctatttcttttatatagcgtgctgagattttcccttatcacatttataccaatgcatattgtattctttaaaaaagaacttattatagaaaataactagtagagagcatagtcataaacttccatgaagccatcacccatcttcaaacatgggcaactcatgactgatcatatttcatctatattcattccctgcaattattttgaaagaaaaccccggaccttatattactttatattagatttattttttgaaagataagcattgtgttttaaaacacatgacaatactatatgataacatgtaaaaagttaaatgttccttaatatcaactatacagtattaaaatacactttgtttgaatccagaaaaattgagtctatacattgcaatgaattgcagttacatgtcaatcttttagtccatgggttacccctaccatgccttttttccccttgaagttgatttgttgaagaaacagattaatttctcctatagagctttagaagtctggattttccttattgtttcctaatggtgttatttaacttgttcccttatgccttttaaataagtagttagatttagacttggtcagaatctaactgttgataatctactaagtgattatggttagcaaaatggtgatattcaaattctgtctttccgtcttcatttgttacatgcagtgcatctatagagaaacttcctcaaatcaactacaatatttaattatactgaggtacagtgtatatgaaagggtatgaaagggaaggaaaatgtttgatatattctgtatttagaaagttttaaagtaatgaaatgattctgtaataccctccaaaatgaccaattaggttttttatttcattttaaaacttataaatttatttatttatttttatttttattttattttattattattatactttaagttttagggtacatgtgcacaatgtgcaggttagttacatatgtatacatgtgccatgttggtatgctgcacccattaactcgtcatttagtattaggtatatctcctaaagctatccctcccccctccccccaccccacaacattccccagagtgtgatgttccccttcctgtgtccatgtgttctcattgttcaatacggtgtttggttttttgttcttgcgatagttaatgagaatgatgatttccaatttcatccatgtccctacaaagaacatgaactcatcattttatatggctccatagtattccatggtgtatatgtgccacattttcttaatccagtctatcattgttggacatttgggttggttccaagtctttgctattgtgaatagtgccgcaataaacatacgtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccagcagtgtaaaagtgttcctatttccccacatcctctccagcacctgttgtttcctgactttttaatgatcgccattctaactggtgtgagatggtatctcattgtggttttgatttgtggttttgatttgcatttctctgatagccagtgatagtgagcattttttcatgtgttttttggctgcataaatgtcttcttttgagaagtgtctgttcatgtccttcgcccactttttgatggggttgttcgtttttttcttataaatttgtttgagttcattgtagattctggatattagccctttgtcagatgagtaggttgcgaaaattttctcccattttatgggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggtttgaggtctaacatgtaagtctttaatccatcttgaattaatttttgtataaggtgtaaggaaaggatccagtttcagctttctacatgtggctagccagttttcccagcaccatgtattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtgtagtttgaagtcaggtagcatgatgcctccagctttgttcttttgtcttaggattgacttggtgatgcgggctcttttttggttccatatgaactttaaagtagttttttccaattctgtgcagaaagtcattggtagcttgatgggaatggtattgaatctataaattaccttgggcagtatggccattttcacgatattgattcttcttacccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctattattggtgtataagaatgcttgtgatttttgcacattgattttatacctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaaaatttaaacatactttatatctttaaattgcaggtattattttactaatgcacaagttgtctaatttgacaaatgggagcctctggaatctctttgacatgcctcagtcgtttttgtacttagatgttctgtgtctgtttccttggctaaactattggctccttaaatggggggacttgtctatattgtttatccttcactccacacacaggctcatagtctctccattaatatttattgaataaggggtgggatattaaaatttcattaagtgaaaggctgtcttatagaggaagacctagtttagtctttgtggattcagatcttgaatcagagagtaaaactcacaggaagcatttttgtctcaacataaggaggaactaaataatttgaatttttatagaggagttggggttccatgaaaatgttttagggactactttgatccaggcagtgagagtacaaggatagactatcaagccagtgaggatctttttgtctccttgggagcctggatgattactgaggttacttttaattgcaagatgataagaccctaaaatccttggttgacagattttatttttagaaaggtgcaaatttgggtggtttaaaattgctgaaatgtacataattttttcctatgaactttatatgccactctaatattatgtttctaaatattatgagtttgtatatttgataaagcattgataatgattaatcatgctttagtagcaatcaattctttttataggtaataattgttgattgaatatgcccttccctcatttcattaaatctttttgcattgttagtcacatcctaataaatagctgttatactattgttttattaatctttgggttttattcaaaaagaaattaatgtgtccatttttgctttggttggttgtacttttgaggttttactgaagaactatttgcccaaccaatgttctgaagcatttcccaatgttttcttttagtagtaagcgtctacaagcaaacaatcaacaaagtgaagagacagcctacagaatgggagaaaatacttgcaaactgttcagcagacaagggattaataaccagaatacataaggaactcaaacaaatagcaaaaacaaaaatccccccaaacccctaaagatcgattaaaaaatgggcaaaacatttgaatagacatttctcaaaagaagagatatgcatgttcaacaggtgtatgaaaaaatgctcaacatcattaaaaatctgagaaatacaaatcaaaaccatagtgagatatcatctcaccccagttaaaatggcttttatctgaaagacaggcaataacaaatagcgatgaggatatggagaaaggggaacacttgtatgctgttggtgggaatgtaaattagtacagctgctatagagaatactgtggaggagcgtcaaaaaactagaactaccatatcatccagcagtcccactcctgggtgtatctatccaaaggaaaggaaatcaatatgtggaagagatacctgcacccccatgtttattgcagcactgttcacaatagtcaaggtatggaatcagcttacaagtgtccgtcagtggatgaatggatgaggaaaatgtgatagatagtacacaatagaatattattcagccataaaaaataattagatattgtcacttgcaacatgggtggaacgggaggacattaacttcgtaaataagccaagcactaagacaaatagcacatgttctcagtcatatatgggaactaaaaaattgttctcatggaggtagagtagaatgatggttactggaggttgacaagggtcgtggagagatggaggataaagaggggttgattaataggcacaaaaacacagatagaaggaataagaccatttggtagcacaataggatgactatagttaacaataatttattgcatatttcaaaatagctggaggagtggatatggaaagttctcaacaaaaagaaatgataaatggttgaggtggtggatgcctcaattaccataatttgatcattacactttatatgtttatatcaatagcatatgtaccctgtaaatatgtacaactattatgtatccataagtttttttaaaaagaaattaatttaagacaaactagttttagtcttcttccacttctctctgtattactttgatatagattatgacaaggtgtaattactgacagtttaccttgaaattttaatttatttttctggaataaagtattgtagttagcacttttaggatattcctgaagagtaaatgttaaacagtgttgagatgacttcttattcacacctgaatcagaattgaatttagatgacagtaacaatgtcatgaatatttagttaagtttaatttttgaaatatgtatgtaatacagtatagtgagcattttaactagcatataaagagggaattaataaatgaaacactattaatataactttaaaaatatttttaataactttgccaaaaatctgtaaattcttctgaaaatattgtccttgccctactccagcattctactgtcactccctccaaagtatctacatttccttctattgcttctagaccaataccgcaaggaaacgagcattgtatatgtctgcacttggtattattttccttcgcagtttctcttgagacaaaatcataatggaagagagaagcagaatatattaaatttcccagattatattaaatttattttgggtatattgctttaatttccttcatatcttgtagacataatttcttctaggtgttagcacatggacactgttttcagagatgacacagataatatttgtaattttgttttcttgtgctaagatagtctattaatttgaagtaactaatggaatagaagacctttaggctttctttgagaatttttttccataaggaagttctctttaagcatcatcttttgaaactggaaaatgtactttgagctaagtggggagttttcctttattgtttttgcagaacattaaatgaacaaatgaatgggtgaaaaaataaataggctgttttctttattgataacttctctcagcactatgggaggccgagatgggcagatcacgaggtcaggagatggagacgatcctggctaacacggtgaaaacccatctctactaaaaatacaaaaaaaattagctaggcgtggtggtgggcgcctgtagtcccagctactcgggaggctgaggcaggagaatggtgtgaacctgggaggtggagcttacagtgagctgagatcatgccattgcaccccagcctgggcggctgagtgagactccgtctcaaaaaaaaaaaaaaaaaaaagagaaaacttctagaccttgctttactcccacaagaaaattttatatttacaaatttagggcacacagatgtgtggacagagtttctgaaattgacagatttggatttgtgctttgtgcttagaaacagtttgaaagttggatcccctttcagcctggctctacctggctacccagtatccccatgtcctgtgcatggagatattctccccactcctgcccagtgcagttcttcctggtacggcactttggagttcatgccgcctgatgggcagactaaagcaatgagtcatggctcctttgggctaagctgggaatgacagttattggaaaaataagagaataagcataaagaatctctgaaataaaatggctctctatacagcttaaagcaactacaggcaaatttggcagtaactgcaatagaacattctgtggtaatattagcacaatttagagccctttttatttacctgaattaacgtctccactggcaatcaagccctgattgccttctattcattagcctttgatttaattaataagacttgttgaagagggatcttcaatgtttttctgtaaacagctctaatttattgattcaatttgaattttgtgattatttcaagttatttaaatcaacgtttgaattatatgtttgaagttttcataaaataggttaaatccacaagataattagaagacacaatgttcattttgtttttcatacagtaatatatctttttgatatctttaaaaatttccattttgtaaatgagttagtaacttagactgtcaaatatttcaggtcatattaaactttaaaataaggctggacacagtggttcacaccttaatcccagcactttaggagggtgaggcaagaggatcacttgagcccaggagttcaagactatcctgggcaacatagtgagaccttttctctaaaatttttttttttaaattagcctgacgtgatggcatggctctgtagtctcagctactctggaggctgaggtaggagaatctcttgagccccggagatggaggctggaggctgcagtgagccatgatcatgccactgcacttcagcctggacaacagagtgagaccctgtctccaaaaaaaaaaaaaaaaaaaggtttaaaatatacatgaacaaaaggtagactattaaaaaatttcttaacgttattttttccacagctgtcttttctaaaagtagacccagtgacttaacatttttaccaggctttagaactgagagactcagtagttgttgagtgttgagacacgtagataaaaagtaattaagaaaggagaaagtcacaatgactcttaggttaaagagcaatttgataatcagtgtaattcttaatgagaaaccaatgaagcagtcgtagaaaagggagatgctgattagtggtctttgctcagattattaaagattagtaaggttagtgagtgttttgaaacatgtctgctggatgcaaaaaggttaattaacaaagcattctacaaattcttaaggaatataaaaacttaaaggaaataaaaacttttctatatgtagatgcagtaaacataaagagaccacaccttttatttataaaaagaaaataaacatttaaacctaacatgaaagatgttgaaaactttataaaatgttggtatttttgaaatttttggaaataatacttttagtaatttattctggacttattttgcaggtatgatgaggaaaatgttagtatactattataacagcattaatattcacccagtgaaatctactctgtgccaagaaggtcctagatactgagcacatatcagttgataaaacaggaaaagtccccttcatttctggaacttatggtgtagtatatattttaaggaaattttagtttgaagtgatgtaatacataaaatctcagtgtcatgaactgttgagatgatcataacttattaaaaacaaacacttggaggttcaattcatggagaattcagaatatgaattccatgaacctaggtcttgtttttttatgcagttaccatagaaaatattttcaaagacctttttcactatgaaaataatacaaattagtcagtgaaattacttagggggaatccatctttagttgcacttaaaaaatgagtgttgattcaattaaaggctggtgtcctttcagtgtgttacaaggcaaacatagtttcatgcctgagaatgtacttcaagtacacaacctacagaagcatgcggttcctatattccagaactcagttcacaatacgtgatatataaaagttaacgctctcaagagaaatggaaagctctgcgggaaaaaggttgtgtgtgtgttttatgggtgaggggaaaatatctgtaaatgaggggaaaattccaagcagttcctggaatcagttactgcctcctcagggagccagtgatgagctcaactgggctgagaaaaattcatgcagttatcagcactaactgcatcccagcctcaagccctgccaaagtgcttagtcctaaaagatgaagtgaagagtacaaggtgcagtctccagctgaaccccatgtgcatagtaattttttttgcctgcatctgggtacctagagcacaaacaggattagaaaaatcaagaaaatatactcaggagaagaagttgcagaacagaaaagcagcaggcctgtcctgtctgctaaagcagaaggaaaaagaaacacaactcctgaccttgaggagatggtacgttgtggagccttataatcaggtctccctatcccattactgtaaccaataataatgtatttccgcaatcagttcaatgagaaatgccactaggatggttcaactatgatgaagtccttgttcttttgggttttatgtctatggcagttttttgagcgaaagcagaccaaatagatgtaggtttaaaaaagagacattcaaattctttcaaactcagacactggattctctggcccacataagttctcctttgctagttctttaacctctagagatttttggtagccatttaaattgcaacaagagaccatttttgacctattaaattggcaaaatcagacactgagaacatatagtgtaggtgaaggaggagaggcaggggagctctatttggtataggaaaggataccaaatatttatattggtatcctctatgtaggatgcttctccaatattcatcagaattggagatcagaaatgcacatacctttgaccttgcaatggcacttttaggaatttaacttacggacatatttttacaggatggaattacacatacaagaatatttattacatcattgtagtagcaaaatttgggaacaagctacatagctatcaacagaggactgggattaaacttagtatgctatactcatacataagaacaccctgtggtttttgaaagcaaaaggcagttttctatgaatttatgtcaccaaaatatgttgttaagtgtaaacaatatagagtgtactctgtattgtataccactatttgtgtatgtgtgtatatttatgtgtatatatatgtgtgatacatatatatgtaagtctatatatcttgtaccttttacatttttaatacagttgtctctccatgtttgaggtttctgcatctagattcaaccaaatttggattgaaaataattgggaaaaaagacataatataacaattaaaatgatatgtgtaaaaaatacagtataacaactatttacatagtgtttatattgtattaggtattataagtactctagagatgatttaaagtatatgggtggtgggcacaggttttatgcaaacactacagcattttgtgtaatagacttacacatcctcagacttggtatcaaaggggatcctggaaccaatccactgaggattatatgtgtgcttttgttttttcctattttaattaacaaacaaaccaaataaagtatggttctaggcccagtgtaggtagaaaatagaacagtcaaggaggggactaatatagatagttatgtctttgattgatggcagaaatgactggataaaaagttaactccatagcacaatcttacttttaattggcgccaacacatatttagaatgtgtctggaaggaccatctgctttggataggtcttgtgtaatcttgtaatggtaaaatattcataacttttttgatgacatactgtaatataaagcacaactagaccaaatataattttaggaggttgtagtaaaaaagaaaaaaaaacaaaaaaaggggaattttttccttttttttttttgagagagagagaagaatgtcaagtttctgtccttgggaattgaatgacctcagctaaagactgaaaatgaagacatttcagcagaaggaacaaagagggagctattggagaaacaaaggaacagagttatttttgattgcatgatttttaattaatctgagactaattatcaagtgtggtgatttggttaaatactagtttcattctggaaggaacacagtgaatcacagaaaaattcagttaaatcttggcctatgcaagtatgaatatttaaaatgtgaatatttatgatgatgatacagaattcccagccgaaaccttgctttggtggtataattgaatcactgacatttttagcataaaagtgaatttatttagttatataaattataaggaagacaattagaactataatgggcacatatttttatgaattcacttatctttcatttctcacagggtaaatgggaagttggtagctctgaaggtgatcaggctgcaggaagaagaagggacacctttcacagctatcagggaaggtaggcacttttccttgttgatattgcttttgtgtttctatggtccccgtagctattttaatattatacacctctgaatatgctgagttttaaaattacaggattgtatctttcattaaaatgtgtaaactgaaatttaaaaatcagtatctcttgcagtcatgtcaaatcatgttaaatgaaacaagattatctgctgtgtgctcagatgtggaataaaatgctgtgcattaatggtgaagctatctaggtaactgaggaattttgtatgtctgctatcatttacagagttccttagatacatattagtttaacattattccgtattgatgatttttaaggaaaaatctttaaaaatggggatttgtcatgccatcttactaggcatttgaatttcttttcttcctttgtttctatcctttactgtacttttactggtttttctgattggaagaagataacatagacattctttatatattagggtcatttatgttgtgatattttcctctagtctgttattttctaaaatttcttttataatgtagttatttgctacatataagattttattttttattaaatcaaatagctctatctttgctttgttacctgcatagaaaggcttttgtattccaagagaataaaatatctttttttttaatcagtgggaacttttcagttcagtttaataagttttaggataagtaggtttacctctactacatttttaaaagtgcagattatcttgacataagacttcagtttatttttgcattgaaaggatcacagctattattctcttcatccataacaagataaattggtggtttgctgcaataatttatcaaggtattgatgaactaaatgtggtctgtcactgctttggtttgtttcccacaactgttgatatgatttacatgtacaactattgatatgatttacatgtatcatttttgaaaatcttgtttctatttctactctctcacctcttattctccttttcattcaattttaattttgtttccatcatttatctttagcggaaactgttcttataaagttcatcagtcacttgcttcttgtcaagtcaaatgtatacctctctgtcttattttacccagccttttagcagattgcatggttgaaacggtctcttctgtgacatcagattttccaagtaggtaggtttttctcttaggctgaccttttctctgagttagggggagtttcaggacaggaaagggcttctttttttttttttttctgggacagaatcttgctctgtcacccaggctggagtgcaatggcacaatctcggctcactgcaacctctgtctccccggttcaagcaattctcctgcctcagcctcctgcatagctgggattacaggcgtgcgccactacgcctggctaattttttatttttagtagagatggggtttcaccgtgttggccaggctggtctcgaactcttgaagtagtgatccactcacctcggcctcccaaagtgctgggattacaggcgtgagccactgtgcctgcctttttttttttttctttctaataagcactctgtcctaggtgatattatttatttcatgagtttaaagagaagctataagttgatatcctacacatgcatctctttagctaagaccttgtcttcatctccatttcatatatccacctgcctatttggcatcttctcttgaatacagtagtatataaaaaggatactacatcactaccaactgagattcatttcaggaatacaaggctagtttaatctttaaaaatcaatcattgtatgacagtcatctcagacttaacacatctgaatggaactcatgatcctcccactataaatgaaaccatgttctccctgtattagtaatagcagcatccagtgcttcctctacccaaatctagccatgaacaagccctgttgattacctctctaaatgatacctgaaatctgtccacgttctgtctctccactgccacccctagtccaggataccatcagttcttccatggacttctgtaatagcttcttaattatacacctcacttctcttgccttattactatcccttctctactctgttagccgtataatatttttgaaaactaaaatcatattatgtcaatccccttatttaaaattgcttcaagtcctatatgactgattttcttcaaacatgctatagagtttcctgtctcaggaattttacacatgttgttccccatggctggaatgctcttccctggctctttttagatttaggggtcaattcaaacatcccatttcagagagagtttctttgtccatttatccaaattagtggctgaccatcattttatgcatctttactctccacatcacaccctatttttatttccattataattcttattggaatgtgaaaatttctttccactctgtatataatcttagtgaggtcagagaccttgtctgattgttcactgctgtaccctcaacatctagcatggtaatcactctacaatagtaagtgacttaaggaaaatcattaggttagaatctataaatatgacagattattagatacagtctgttccctcaaggaacctgccttgcaggtgggaggtagaacatataaatcataagttgaagaataatatgtggtagcatattaatgccaaattatttataaaagattttgaaatctaaaagattgtgaaattatttctaaaagattgtgatttttaaggaaattcttccattagtgatgggaggtaaagtgttagctaggacttgaattaggcataagatagaaaaacagtaaagagtagattgaggagaagtgttccagacaggtatagaaaaggagctgagaccagaaagctcaatgcctttgccaagtgcagtgaacaggaggaatagttaagatcaggagttctcaattgatagagtgggagggatgggtaattattgctccatggaagtggcttttgtcatcacaataattgaacaatgcaaccatgtttagtggatgagagcttggcatttacgtgagaaactcttaatacagagggaggcaaactgtggcttggggcctgctgtctgttttggtaaataaagttttatttgaacgcagcactccaactcatttatgtattgtctatggctgctttcttggagttgagtacttttgacaaactgtatggtcccccaaacttaacagtatatgctatttggccctttcaataaaagtttgtcagtctctgctctaatacaataaacaattgtctatcgggggaaaccagcccacgatattcaacatgagtccttttctatttttcctaagtgtcggatggtctgagaaataaagggaaagagtacaaaagagagaaattttaaagctgggtgtccgggggagacatcacatgttggcaggttccatgatgccccctgagccgtaaaaccagcaagtttttattagtgattttcaaaaggggagggagtgtatgaataggatgtggatcacagagatcacatgcttcacaaggtaataagatattacaaggcaaatggaggcagggcgagatcacaggaccggggcgaaattaaaattgctaatgaagtttcgggcacgcattgtcattgataacatcttatcaggagacagtgtcggggagcagacaaccggtctgaccaaaatttattaggcgggaatttcctcatcctaataagcctgcgagctctatgggagaccagggcttatttcatcccttgtctacaactgtaaaagacagatattccctaggcggccattttagagacctccccttggcaatgcattctctttctcagggatgttctttgctgagaaaaagaattcagcgatatttctcctatttgcttttgaaagaagagcaatatggctctgttctgcccggctgtcaggcagccagacctaatagttatctcccttgttccctgaacatcgctgttatcctgttcttttttcaaggtgcccagatttcatattgtttaaacaatttgtgcagttaacacaatcatcacagggtcctgaggcgacattcatcctcagcttatgaagatgatgggattaagagattaaagtaaagacaggcataggaaatcacaagagtattgattggggaagtgataagtgtccatgaaatcttcacaatttatgttcagagattgcagtaaagacaggtgtaagaaactatacaagtattaatttggggaactaataaatgtccatgaaatcttcacaatttatgttcttctgccatggcttcagccggtccctctgttcagggtccctggcttcctgcaacagttgtctcatgtcccacaagcttttttttaatgtcttactgagcattcatgcaggtgaaaaatctgtttatatttatgagcccaaacccaactattttgcatataaacaaaatatgctgtgcacagatttaatatataccaaactatctaggaatacaactacagtgtaaatcatggaaaaattgtattgtgttttgtttaaaactttacaacttgttcatattttggaaaaattccttagtggcagtgctgcttgtgttatttaattcaataatgcaatatcccacagtctgcatttgtagtggttgtgcttatgctgattctgtacatagatgtgagcaccactcttcagtgtgttccggtatagttgtgtctacttacatatttaaagactttgttttattataaattaatttttatttattttttgtattagttacatatagatataaattaatatatttgaaattatatttatatataaatatttgaaattatgtatgtgtatcttgttatatatgaattccatttcatagtagtaaaggcaaaaaaagtagtaaaatatttgttatataaagagggtattggctttgatgggattgaaaatgactgaggtagaacaataggtttttgttaagctgtggagggagataaggttaaaagtgctactgaatttaattatacagtagaccctgaatatgagagaggagagggacagggactctgggccaaaaaggaaccagaagaaaaatgaaactggccagcaggcaggattcctggtatgcagggtgtgcactagaattaatcaacctaatcttactgttggtgctagtcttggtccaaggtgacaagaaggttcgtagtggtattgaaggaccagtgtgacaagcaggcccatcagtgggaggttcaagggaagaagcaagtaggatcacattgaagttgttgatgatcttcttattcactttggctgggtgtgaggcaagctcctgaggcacattaaaggttagcttctgggaaacacagagaagcggggaatgcaatgaatccttagcacactgagacctggctttgactggcaacataatttcattttaagccttgagatgagcttaggaactggccctcagttgcggttgtgttgtagaatgcagggctgtgtaggtgggatcttgttctgtgggttagagagcctctgaagactttagagttgggcatattagggacaaaaatctgatattcagataggatatcaattagaaaaagaagaaactggaagctgataagtcagtcattcagtgtgttgcagatttgaaattatgggtttattagatgttagtaacaaaaaataatattctatagaaagagatgtcagagctaggtgaagtattgattacagattgagaggaaaatgtcaatggttttgagtttgactgagtgaaaaaatagggccagagatagaaatagttggtgattgcatggagaattgcttttaagactttacagtttaaaaggctgttatccgatataatcttcatatgctagccctttgaaaaagttttaaatttttattttgtagaatttatattgtttatagaacctgtattataaatatggaattaaggctcagaggggttagatgacttgtctaaggagcaggatcttgtacctagaccttgttagatttcaacagggtcattactgacattttggagtaatcaatttgggttttagggattttgagctcatgagacatctgtatgaaaatgtcttgttgggaatgtgggagtgcagctcacaagagtttagcgtaagtagtatatatgtaccatggtcgttaagaagttgaaccatgtataacatttttgtggaagcgaatgttgagtgaaaacagagtcagttacaaggcaaggtagaaactcccatgggaagctggaggtgatttctcttatgttgtacagtgatgaaaaagtcagaatcaaaacctactgatttgtgtatgttgattttgtattctgcaactttactgaatcgacatacacagatcagtaggttttgatcctgactttgtttttcatccatgtacagtataagataagccacctcaattagtttgctagggctgctgaaaaaaagtaccacagcctgggtagcttaaacaacagaaacttaatgtcttgcagtcttggaagctggaagtctgagagtaaggtgtcatggccctccaaatgagggcaatgaggaaagatctgtgccagccactctccttaacttgtagatagtggtcttctccctgtgtcttcacatcatttttcctgtgtacctgtctgcatccaaattttctcttcttacaaggacaataatcactttggtttagggtccacccatatgacatcatttcaacttaattacctttttgaagaccctatctccaaatacagtcctattctaaggtactaaaggtcaggacttcaacatgaattttttggggggacacagttcagcccataacagcacttaatggctttgggccttagtaaccctacgtattaatccattcttgcactgttgtaaagaaatacctgagactgagtaatttctaaagaaaagaggtttaattggctcatggttctgcaggctgtaccagaagcacagcatcttctggagaggcctcaggaaactttcaatcatcctataaggcaaaggggaagcaggcacgtcttacatgctgaagcaggaggaatagagagagggaggaggtcctatacactcttaaacaaccagatttcatgacagctcactgactcactattgatatgacaacacgaagggggatggtgttaaaccatgataaaccaccccagatccaatcacctcccaccaggccccacctccaataatggggattacaattcaacatgagatttaggtgagggcacagactcaaaccatgtcaccctacttgcaaaaaataggagttggattatgccatctcttaagaactactttggcgttgtggttttgatttcccaaagaatctttaaactcagaatttggaatgttctggagatcagggaatgatagaaaaatagttggggccttgatcacaaaatggcattttattttctattgaataaaatattttaatgtctttctaataaagtctgacttctgagtgattttttttttttttgtagcagtaaatgacttcaaggaagagaaattaaactctgggtcagtttttgttatttgtttttttcttgccttctcattctgcctttcatattcttatttttctgctgtttatatctggaagcaaaaggcatcatcattgcttagcctttccccattaatacttctggaagtccagacacaataactcctctgtgtatctaatggtagaatttgaaatatttagggcaatgtgggagacatttgggatatgttcaattttacattgatgaggaagcagcatggtgtgttcaactgagatagaacacctgaatttgaatttgcccctcttctgctgtgttgatcaatttctcatttacaaaatatcaacagcgggaagatttcagaataggaaagcaccatgcacagtaaagtagtttgtaagtggctacttgccactcacaggcttacctagaaacttggattttagggcgtaattttcacctcaagtggaaatacttgaagcaactctaatctaacctagatttatgtccaaagatgtactttgaattttatctctcattgagctagagtgtgtaatggattaattcaagttcaggcgctttgaaactcattctgtcctcgatggcagcttggagaaattaagttgtagtgctcagggtcagcttttctattttaatttagaatcattatatggcatcatcttggtttatgaggaacagataaagggctgggagatacaggagaggtttgaaagacagtggataaaatgtcttaggatattccatctttcaaacaacttttaagtgttaagtgtgtatgttcttactctctgatattgtattctagacttccacgttttttgttgtcttaagattttcttagacaggcatgaggtgaatgaaccagttgtctcttttcatagattcttgaatatgtgatggttttcttaggtgagaattatgcttaaagagaaatctagatactctaatagggaacaaatttaaattaaaatggtagcagtataaatagacaatatttggtgtgtgcttgcacagccagagcctagtctcacttaacactcacaaaaccctctaaggtaggtactatcattattgctattttgaggttagtaaagttaggattggagaagtcactcacctaaggttaacgctagcatgtggtagagctaaaagctgaacctggctgggtgcggtggctcacacctgtaatcccagtactttgggaggcggaggcaggcggatcacctgaggtcaggagtttgagaccagcctgttcaacgtggcaaaaccccgtgtctactaaaaatacaaaaaaattaaccaggtgtggtggcgggcacctgtaatcccagctactagggaggctgaggcaggaaaatcacttgaacctgggaggcagaggttgtagtgagacaagatcgcgccactgcgctccagcctgggtgacaagagtgaaactccatctcaaaaaaaaaaaaaaaaaaaaaaaaaaagctgaacctgagcaatcatacggcagagcctatacttaaacgttatactctgctagattttatgtagaaattttgaatttatgcttcattttcatttcatacagagggttgtgttattgccattaagtcaaggttagcaaaaaagatagggattttgaggggggacatgggaaaaaatttatttataaaagtgataacacatttttcaataaagaaaggaaggcagcatccacataggacaagaaagggtctaaaagaggaaaggaacaaatagattcaacacaatataactcagagacagtagaaacatgtagaggaaaaggggacctctcatggtaaactctgtagtattgaactttttgtttgggtacattctttttaatacatgtctgagtattcccatgtgctttatccaccttctctctcttcctttctccacccttctttatgtatttttttcattattcattctattagaattctatggaaacattttagatttttaatacaaaatgtggtaccaggaaggcagaggtagatataaactgaaaaagagataaaggaaaaagaacaacttcttttatttcaaatatttggaattagttaacctgcttgtaaaatgaataattttatgatttaattgtaaaatttgtactgtataattaaaatattctaatagtacaataaatgttatatgaattattgatattacttttacaaattttttaaagttataaattggaaaataagactgattttaattgagtcattaaaattttggtgtttgactgatacttgattctctaccttacatttttcttttttaatgttatagcctatctgtttttgttgtttttcattaaccataccatttttccttgtaactgtatggtacaattgcttgtgaagtttgtatatgtaattgagttataattcaattgataattaaccagtctagatttcatttcttgcatttcatgtttggggtgttgtattgcttttctagggcttctgtgataaattaccacaaatttgctggcttattcttttgtagtgctggagagtagaagtccaaaatcaggatattggccagttcatgcttcttttagaggctatagggaagaaattcttgctagttttttcctagctcctggtggcttcctacaatctttggtgttctttggcttatcgttacatcacttcgatctctgcctccatcttcacatggtcttctctctctctgtgtcttctcctcttatagggacatcagtcattggatttagagcccacgctaatccagcatggcttcatcttaacttagctaattatgtctgcaaaggccccatttgcaaataaggtcaccttctgaggttctgggctgacataaatttctgagagacactattcaacctgctaccagtgtttatttttctcagtttcacagggagatttgtaggtcataatggactgggacctgcattggacctttgaaagcttaggagaaaaatgtactacatggtggttttgataacactcttctttgttttcttattactgaagtttgcatataatagacaatgaatgaatatagataactttctccaatgtgatttatttttgtttctctccatataggctcttttgttattgttattcatttatttttgttttcaagcaaaatatcattctctgtggattattgaatgacatatgaactgtggcttgtgtggagatagattacatctgtcaagttagtgagtatgattgagacattggtagttagtctgggattggaagcaggaagaactgatataatggagacctctaaagctactaagttgctgtgaaatgataaaggtctacttccacaattctatacgttggccactgggatttcagacacatttacacaaagacaaaatgttccaggctgttctgttggagtctttttttattcagatatgccttttatccaggtatatggacatgtttttttatccagatacatcttttttatctttgagtagattcctgggctgtcccataagagcctttttttatccaaatatatagttttgatgatcaaatacaacctaaatgataagtatataatcatctttggttataactgaaattattttgtcaatatctggatgcctagatacttcttacccctatcaccttcccagtggagagaggacatctgccaaaagagaactcaggtcctctgttccctcccttttccctgacctggagtctcttgcactcaggctcctgaaagctaagttgagagagtgggcacagatgggaagaggggctcctgggacataacctccttctttaatagactggagggctgttgcagggagaggaagaaaggacaaacatttgtttccatttgtgttttgtcaatatcgctgtttggaattgttcatcctcttgtaatgatttcaaaattaacaagttgattatagatggaattttcagtgaaacattatgttaatgcaacatttgaccctgtgtagtaggtgacaggttaaattaggtttcttcaagggtcttaataactttttttaagactcaaaaattctttgctcagcctagacatttctgaattcagctgttttattggcaactgtttttaaagacactatttgtagcatcattgttggaagtacatgaatcctataaaagctaattaggaatctaaatcagactttagagattaccttgtccaggggtttctcagttgcatcctcatggtcttcaagctatgtgtttggtcttacagtaaattttaataaatagtgaccagaaagtggtccagggcctggtttctgaagcctgactgcctggattgcagtttggacttcattctcatctaagtgtatgattttgagcaagtcttaaacttgctgtgcctcattttccatttcttaaagaggatgaaaatacgactcaacttacaggcttcttgggacattatatccatcaaatatgaacatgaggccataaaatagaagcaatcaaggaataatgaaaatttcttcaaaataaaaatacattaacaggtattaaactttcagaagaacatttggattgtgaactcagagaaatctcccaaaaggagatcaagaagagttatcatctcttatgtctttgagaataaataatatagttatttgaattttcttctatattgtcactttcatttatttctgcttgtgtgtttggtctctttcttattggaagcatctttcagctacctggagatcttgttgattgtcagctcatatttaaaagtcagactttaatacgctgtttggaagctctgggtgcttggatagggaatattggttggcagttttgtgatggggtgagttaaccatttttttttttcttgcagtatctaagatgtcagtatttgggggtcgtttcttggaaggaggcttcagtttctacagaaaaggattatttaatctcctgcctggaagatttcagtttgctgcccacattgtggggattgagtaagagacagaggttacaggggagtctcaaccttcaacatgcagatttttattgaatttacctattttcagttcagattatgcagtgttagagagacaaaaaggcacccaaatatttaaggcaaaaaattaatgggcctctaaaaaggttttggcagtagggatagataggagataaatatgtttggaagggacttaagagggacacttggtagggctttgtgtttgactagacatggagcttgatgaaggtggggttagtcagggtgacttccaggattctggattgggtaattaggtagatagtggaaccagtaatgagtaactgtggttggggataggggaggcaggtggagtataagaaagacaatgagttcaattagtgagtttgaaatctggcattcatgtggcagttgtgtgacatggtggtgcagtttagataacaggtgtttgttgtatctaaattgagaactttacaagtcatattcgagtatatgatctagtttaatttttaattccttgaggaaggttgatgttaccatcttcattttactaatcaagacactgaattccttgagggaggttgatgttaccatcttcattttactaatcaagaggctgaggtctaacaagattttttttgtgcaaagtcatacaaataattaagtggtagatatggagttcaccttgaatattctaaccagggcctagaacagtgcctggcacatgataggcactcagggtatgttgaatgactgagtgaatgaatgaataagctcccatgttctttctttgtattctattatatggccttactattgggacagaaacccatatgatgaaaattgtacacagattcttctcaggcttccccagagcaaaaaggcgatattgagaaagctccataagcgaggagctggaaatttttcagtcttgatggagactgtgcccctagctatgtgatcataagcaagtacttaacatattttgtctttagttttttcatttttgaaatggagaccatattattttagagctttataattaaaataatattaccaacatgaatcttttacctggaaaaaagatctataattgtatcactattattctcaatgcatacatgcagtaatatgatgcacatttattgggttaaaatattttttaaaccttctaacaatcaccctttctgtctgtcactgaaaaaattaacatgaattgcttaaagcgtttttataattgacaggcaaaaattttgtaaatggaagataaaaatccatgagtctagactgtaattctaagtatgcttatgtaaattgccacaattgttattctaagtctgagtaatctgatgggtgtctgccaactgatatcaacaaaaacttgtcaagtgttaaatcatgattaaaaactatgaaagtcatatgttttcttttttatattaataattttaaaggataaagtttgttttttaaaatcaagtaactgaattcctggctgttttaaatttgtaaaaaatttatatgacattttgtcctattttgtcaactagaaatataaattgagatatgatacttttatatttaagacatttttaggaggattacataaacagttctaatctgaattcatgtataacttctaaaaatcccatggactttttcagttcctactttgccaatctttaaaaaacgctatcttgtttgattttcaccaaatcttatgttatatgtaggttttaatatatccaagttacaggtgaggaaattgaggcctagacataaataaaatgtcctgtgttacaaaacttgccagtaaatgactgttaggatttacactgggatttttaa

SEQ ID NO: 87 - DNA, 1241868 bp, Homo sapiens
tttggcctgatggtggaaaggtaacttctatatacaatgagaatctatttatgtagaacataccttcctttctgcaattaagttgggatatctgagattctttatttttattttttaattgacacataataattgtgcatatttatggggcacatagtgatgttttgatacatgcaatgtatagtgattaaaacaggttaatattcacagcatctcaaacatttatcatttctttgtagggggaacattcaatattctctctttagctatttgaaattatatataattgataactctagtctagaccgttagaacgtagttctcctaactagctgtaattttgtgtcctttgacaaatctctccctttctcctcctttctcctaccctttccagcctttagtaatctctgttctactctttacttctatacaatcaactcttttaggttccacatatgaatgagaacatacaccgtttaactttctgttaccagcttattttatttaacaaccgcagggtcatttatgtcactgcgagtgacaggtttcattcctttttaagagttaagcacttgagttgactaagtatcttggcattatgaatactgctgcaataaatatgggggtgcagatatgtctttgatatttttattgccttcctttggataaatacttagtagtggaattgttgaatcatatggtagttctatttgtagttttttaggagcctctatactgttctttatagtggctataatagtttacattcccacccacagtgtataagagtttcctactctctgcaccctcaccaacattaattttttttctttttgataatagccattctaactgtggtcagatgatatctcactgtgattttgatttacgtttccctgatgattagtgattgaactttgtttttgttgtttttttagatggagtctcactctgttgcccaggctggagtgcagtggtgtggtgtgatgttggctcactgcaagctccgcctcctgggttcatgccattctcctgcctcagcctcccgagttgctgagactacaggcgcccgctgcgacgcctggctaattttttgtatttttagtagagacggggtttcaccgtgttagccagaatggttttgatctcctgaccttgtgatccacccgccttggcctcccaaagtgctgggattacaggtgtgagccaccgcgcccagcgattgaacttttgaaaaatatatttcttggccatttgtatgtctctgagaaatgtctgttcagatcatttgcccattttaaaatcaaattgtttatttgctgttgagatgtttgatatccttgtatattctagatgttaatgttcatcagaagaatagtttgcaaacattttctcccatttcataggttggctttccactctgttaattgtttgctttgttgtgcagaagttttgttgcttgatataatcacacttgtttttgtttttatcacctgttcttctgagaccttattcataaaaccttttcccagaccgatgttctgaagcatttcccctatgttttcccctagtagtcttacagtatggggatttacatttagatctttaacccattttgagttgattttttgcataaagtaagaaatggaggtctgctttcattcttctgcatatagatatcaagtgttcccagaacaacttaagagggtgtactttccttagtggatatacttgacacctttgtcaaaagttagttggctgcagctatgtgaattacttcctgggttctttattttgttccattaatctttgtttctgtttttatgccagtatcattctgttttggttcacataacttggtagtatattttgaaatctggtaatgtgatgactgtagctttgtttcttttttctttttttttaattattttatttttattttatttaattattattatactttaagattttagggtacatgggcacaatgtgcaggttagttacatatgtatacatgtgctatgctggtgtgctgcacccattaactcgtcatttagcattaggtatatctcttaaagctatccctccccgctccccccaccccacaacagtccccagagtgtaatgttccccttcctgtgtccatgtgttctcattgttcaattcccacctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgtcacattttcttaatccagtctatcattgttggacatttgggttggttccaagtctttgctattgtgaatagtgccgcaataaacatacgtgtgcatgtgtcttcatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttgtaatgattgccattctaactggtgtgagatggtatctcattgtggttttgatttgcatttctctgatagccagtgatggtgagcattttttcatgtgttttttggctgcataaatgtcttcttttgagaagtgtctgttcatgtcctttgcctactttttgatggggttgtttgtttttttcttgtaaatttgtttgagttcattgtagattctggatattagcgctttgtcagatgagtaggttgcaaaaattttctcccattttgtaggttgcctgttcactctgctggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaagggatccagtttcagctttctacatatggctagccagttttgccggcaccatttattaaatagggaatcctttccccattgcttgtttttctcaggtttgtcaaagatcagatagttgtagatatgtggcattatttctgagggctctgttctgttccattgatttatatgtctgttttggtaccagtaccatgctgttttggttactgtagccttgtagtatagtttgaagtcaggtagtgtgatgcctccagctttgttcttttagcttagattgacttggcgatgcgggctcctttttggttccgtatgaactttaaagtaatattttccaattctgtgaagaaagtcattggtagcttgatggggatggcattgaatctataaattaccttggcattatggccgttttcacgatattgattcttcctacccatgagcatggaatgttctttcatttgtttgtgtcctcttttatttcattgagctgtggtttgtagttctccttgaagaggtccttcacatcccttgtaagttagattcctaggtattttattctctttgaagcaattgtgaatgggagttcactcatgatttggctctctgtttgtctgctattggtgtataagaatgcttgtgatttttgtacattgatattgtatcgtgagactttgctgaagttgcttatcagcgtaaggagattttgggctgagacaatggggttttctagatatacagtcatgtcatctgcaaacagggacaatttgacttcctcttttcctaattgaatacactttatttccttctcctgccttactgccctggccagaacttccaacactatgttgaataggagtgttgagagagggcatccctgtcttgtgccagttttcaaagggaatgcttccagtttttgcccattcagtatgatattggctatgtttgtcatcagaattgctttggctatttgggatttttatgattccacatggagttgaggattatttatttttctttttctgtgaagaatatcattggtattttaatagagattagattgaatctgtagatagctttggatagtatggccattttatcgttaataatttttctagtccataaacatgggatgtctttctgttatttttgtgtgttcatcaatttctttcatcagtgttgtatcatttttcttatagagattgatcaccttcttggttaaatttgttcctaggtaatttttgtagccattttaaatgggatttcttttttcagtttttatttcagctagttccttgtttgtgtatagaaattatgttgatttttgttggttgatttttttcttctgcaattttgctgactctgttcattagttctaaaagtttttgggaagagcctttagatttttctatgcataagattgtgtcatcagccaagaggaacaagctgacttcttcctttttagttgggatgccctttattttattatcttgcctaattgttcgagctaggattttcagtattgtgtttaataaaaggaatgaaagtgggcattcttcgcatgttcgatatattagaggacaggctttccgtttttccctatacagtatgatgctagctgtgggttcatcatacatgaactttattgttttgaggtatgttccttctatatccagtttgttgagaatttttgttataaacagattttaatgttatcaaatgtttctgcatctattgagaagatcatatgattttactcttttattctgttgatgtgatgtatcatatttattgatttgcatatcttgtaccatttttgtgttccttgagtaaatctcactagatcatggtttgtgatctctttgacatgtttttgaattcaatttgctaatattttgttgaggattgcatccatgctcttcaggaatattggtctgtagtttttatggagtttttttgtagttattatgtccttattggattttggtatcagagttttgctggccttgcacaattagcttggaagaattccttccccttcaatttttggaatcgtttgagaagaattgttattagtttttcaaaattttgatagaattcagcagtgaagctggactgtgctggaatggtttttgttattgactcagtcttcttagtattggtctgttcatattttctatttctccttggttcaatcttggtaggttgtatatgtccagaaatttactttttctctaggttgttcaatttgttggatacagttgttcattagaatctctaataacctcttgcactcctgttctatcagttgtaatgtctcctgttttattcctgaccttatttatgtgtgtcttctctctttttagtctagctaatggtttattgaatttgtttatctttcaaaaaagctaactttttgtttcattgatcttttctattttgttagtctcagttttgtttagttcttttctgagccttctcatttcattctaccagttttcggtttgctttattcttgcttttctagttctttagggagcattgttagtttgtttgtttgaagcttttctactttattgatgcaggcatttattgctataaacttgcctcttactactgcttttgctgcatcccataagttttggtgtgctgtgtttttattttaatttgtttcaataattttttaaatttccttctcagtttcttccttaatgcattggatgttcaggaacatgttgcttaatttttatgtatgcatattttcagatattcctcttggtatagatttttagttttattctattgtggtctaaaacatacttgatgttatttcagtttttgaaaactttttgagatgtgttttgtattctaacatatggtcaaatgtgaagaatgttccatacactgatgaaaataatgttttctgcagctgttggttgaaatgttttgtaaatatctattaagtccatctggtctatcgtgcactgtaactttgatgtttctttgtggattttctgtatagatgagctatccaattctgaaagttgtgggtgggttgaagttcctattactgttttgtggcacaaccatctctttagatccagtagtatttaccttataaatctggaccctccaatgttagatacatatataattattatatcctcttactgaattgatcccttatttattatacaatgtcctttttgtttctttttacaatttttgacttagtctgttttagtatagctacttttgctcttctttggtttctatttgtgtgaaatatgtttttccataacttcactttatatgtttctatacaggtgagctgagtttcatgtagacagtatataattgggtcttatttattcagccagtggatatttttgattgtggaaatataatcaatttatacccaaggatattattaatatgtgaacacttactactgttttttattcttttctcatcatttcgcttcatattttctctcttattgtttatttttgaagtttgatggtttttagtagttataagttgtgacaatgcagccacccatgtgggcttgctgtaataaagatagaacctttctctttcttttttgtacataagcaatattagtgagtttcataatttagtgtgttttcatgatgatatttactgtctttttgcttccagatgcaggactctcttaagcatttcttgtaaggccaatctagtgatgataaattcttttagtttttccttgccaggaaaataatttatttcttattcatttctaaagtgtagctttgctgggtgtagtgttcttcactttcaattttttgtctgtttgttttagtattttgaatatattattccgttctcacctgacctttaagatttctgctgagaaatctgttagtgtaatggggattttcttatatgtgatttgatgcttttctcttgctgtttttagaattatttgtttatctttgacttctgtcaattagactataatctgtctcagagagggtctgtttggcttaaatctattttgtaatccttgagctttctggatgtggatatacacctttcccaagacttggaagttttcagctattatttcatttaataggttttctataccttttcacttattttcttgtttaggaattcccataatgtgcatatttgtttgcttaatggtgtcccataaatcctgtaggctttctttgttttttattcttttatgttgtatattttaattttgctcattgaattcttcagctgtaagtgttttgggttatttttatgatgtctatttcttggcttaatttctctttcaaaacatgaattgtttccctgacttcatttaattatctatattatatcgcactgaatttccttaagattattattttgacatttttttcctggcatttcatctatatcctgatgattattatctgttactagaaaattactgtgttcttttggatacgtaatattttcctgctttttaatatctgaggcatccctacactgatatctatacatgtggtagaatagtcatcttttccagttttatggagttgggttcatagagaaagacttatttctatagatggtcttagaatatcagttgaatgaggtgcacgggctttgattctaggtggatgcagtagtgcagtctttgtacattttcttcagcagcaatccattttagtgatgttttcaaatgtctcagtggcctgggctgaatatatggtggcaatgctgtggctttgcaggaggtgaactcacaggactatgtctcaggccaagggtacaaacatgaacatgatggatcagccaactgagggtgtgattcactatggttggggtgcagggtggttactctggctagggccactgttgcttggttgtctcaagggtgtgtccactgggctgtttctcaagccctagatatgggcacaaggccactcctgccaacctgattgtgtgtctgctgatggtgggcatgccaaactgtttgtcacactctgggcacaggtacatcactgctaggccagtctggtggcatgtttgctggaggtggcctgtcaggttgtttctcaggccctgggtgcagttgcagtgggtgctggtttctctgctgtgtaggacaggagtcagtcaatcctaaacctaggttttgagtagccagagttgcgacaacacagccacccatgtgggcttgctggaatgaagatacagccccagtgctggggaggtaaagtggctactggctcccagagcatagtgctctctagaagtaggtccagtcttaagattgtaccatgttgcagtggcttgggacacaaagggtcagtagggaatggggaattcacaccttgttctcctaatcagtagtaatgctgctgtgtgaattcctggcagctctctaaactgggctcagggctttcaaggactgtgggattctcctgtagtaaggactacaagtgtttgtggtgacagtgggggttggtggagtttctccacttacttttttttccacgaggggaagtctctcttgacttcaggttgatctcatcataggagacaggatagtagaggcaggatggctcattagtctctctacagtgccctcctggacttcggagcaccacagggacctctcatctcccctgctgccttctagtgctctctcttcaatactccagttaaattctatctgtttattctttgccttgtttcttttcttatggggaggatgagtgtcatgtgcctctagtcagccatcttgctgactttacattacgaacttttaaataggtatgttttaaatagtttatatgaaatcccagtaaaatctgtaaacaaacaattggaccttgatgaaggtggagatgatcctgattttctttattatccggttatgtctttgtttttattgttgttttgttttgccttcaattactatatatttttcctaaaatttcaaattgtttatgaaaatgtgatttaagtatgtcagtgtggttttgctctgaaggattactaaagggcacataggcttgtaggacagtgttttctgtaactccctagaaagaaggtttcttcatcaggagtgtcattctatgaaagaaagcttatgtgttgctttcctaattcttaaataagagcaagatatcacagaaatacttaactgttgttaacatctaccttttgcttatcgatgaaagagaacatgagctatcacatgtgagtgaagcaaggcagaacgataagtaggagaaaggaatggttagataggaaatgcaactagaagggaaaataaatgggaactcgaatattttaaggactccatcttaacccatgttaattcataagaaaaatcttacacattaggagaaaaaataactagttggataaatacacatgcacataaaaaaataactttcacaggattttgtcattaaatacatttagagaagttagcctgacccatacttctgatttcaaaatccataaataccaacatatataacaaaatgagatagtataggaatttgataggaatatttgtttcttcatatattagtaatattccaccagttctaccatcccatttctaatatttgaatagatgggtggtggccactctagatattcattttataaatgcaatttccaacagttagctgtatcatgtgagttttcctctatagtgctgactttttcaccagtgaactcaattggctgtttgttcaaattccccactgaagaaactaaagacatgtatttaagttcctagtgtaaaaatgtgttgagacaatagatgaattcatttactgagtatgctggccagtatgacttgacacagattaacattctcctacttctgtggaaaataccacaaatactttgctctgttggtggtatagaaataaaataagatgatacatgaagtttgtctaaactgtagatggcattttggtccttaaattggttaattcctctctaataaccatttcagaatatttgagcattttactagagtttatttattttttcactgggtatgtagacttgcgaaagtcttaaaagtctctccatatcactagataaagaaaaaattcatttgttcctaaccacaaggttcagcatttgtatagatttgcatgagaaacacagaaaatccatgcagagacaatgttctttacaatgctttttcattaaatatctttcatctctgttcttgattcctattttagctgctctttcctgtcagacctgagctcatatgcctaggagtttttgactgaagcacaacatcactcttgcctcatttttcatgtcacaattttcccacagaataggaagttttaaactgataataaattacaatgaaaccaagctgacatagaattcctagcttgctaaattgtgggcagcaccctgccaagtggaaggtgtctagagctgcactgtgaccatcacatatgttctcctacattccatgactatatttcttaatgcttcacattttgcattaaaacagtgaagacctcactgccaaacagctgtgattttgcagagctctcatgtctaataatatcccactggctagatgagatataacgtagactatgaataaccacttatttgtggttaagaaaaagcatacatggcttctgcttctgatagtgtccactctgtactttcctttgcaatattagatagctattaatttttcaggataatacttagggtacaaagaagtgtatttcattgcttaactcatgtcaacttattatggggctttagcttctccctactcacttgataattttagctcacaaacttagtgtttcccttccttttatatgtcatgaaacatgcagatgataatatttgtttggcatattggcatcggagtaaaatgaggctgtctctaaggttctgttcactacaaagtctggacaatcattatattagtatacatttggctgtttattagtggcatattcattaggaggctttgtaactacctctttactgacagttgctaagaaagctattacttttttttttttttttttttacaaaaagttttcaaagtcctctcagagaagagtatcattcttgaaaaaaaaaaaaaaaaaaagatgtgaaattaagagagtatccagtcctttaggttgtctagaagtcctggctgataccacattccatggacctgtgtagtctatggagccatcaactccccattcttctggttatacaaaatgatattgaagattctcgcatgttaaaatttatggagagtaatctctgagattactgttctacctcaatcacaattatcccagaatataagaaatgaaaaaaacaaacaaaaatggtccacatttttgtccaggagggaatgaggacagatgaaagctttgagcgactaattacacccatacctatagatgcagccgtacaacccacatgaccagtgtgtgatttgctcacttataccactccactcctcttctaaagtctttccaattttcttttcaaagcttactatacatttaaatttgtgatataatgattagtcttaagcattttattgattctcaagtactcataaactgagtttgagttagcagaactcagagtcagagatgttttaaattaactcaattatgatagtagtcatagactttttgctcttatgtggaatttaagtgggtggatactgtaattattgaatgacataagttttgttatttgtaatgagttaaagtctaaatgcaaacttaaacatattacagtttgagtcattagcttattaattttttatgaagctattatctatcttaagagcttggagtctaccaagtaattaaggcaatgtctccaaaaattatactattataaaaaaatgaaatttccatatgtttaatgtttcaaaagcaattatgcacgtttgcccagtgttatttagaacaaacttcctgatactataaacgtcccagaaaaacttgttttttaaaaaacaaacttattatatgttatctgacattgcccattcatctatatactcactcttagctattggcatgttgtcaatacaaagtgctaacagttcataaataatttgacttctcttcctctcccatcttgagatcaaaatattccctaagttcagctattatgtctcatgtgttatttgaatccatcatactatttaaatccttttgtttccacagtgattcagtttcttgccctcttgctcttggatcatggtagtaattaactatgtgtccaaactattttttactctactgaaattacgatttttaaaaggcaaagctaattatattattcactgacttaattataaattcactgccaaagtttcctataatctacaagttatgtttcaaactccttagcaaatttattgattaactggcccctatctaccccttcaccctgaaaccacaacttccttctccttattacatggtttacttttaattacatcagctgtatgcatgatgcattccttcaacaaatgtgcattaaatccccgtaatgtgccaagtgctgtgctaagcattggtaatttaatagcaggcaagtgaaatatgtcctcaggaagctacaatgttctaggcatgaatataacaaaattggcaatagtaatataccataacaagtgatatgatgtgcttaggagtaatgctcaataattagataggtcaagagaatggaacggggttgcccatgtaggggacaatagcttacacatttgtaattatgtttgtatcagagacagcatggaatatacaaagagctgggacacggttttgctaaagcacgggggtacacacagggggaagagcacagtgaagtggcataatatgattacatttgtatttttataaggtttatttgatttctttgtagagaataaattgaagaaaggccacattagatgcaggaagacaaactggaaactattccaaaaatttggttatgaaataatggtgacttgacctgggtataaccctgggtgtggtgagaaaaggataaatttggtaaacatttcagaggcacaaatgatagaacctaacgactgaaatgatcttgggaaaaaggagaatgagatagagaggatattgtcctggtttgtggcttagcaaatgagtttcctgatggtatcacatactagtagagcaaacccaggagaagtgagaagcctgtaataaaagatagaagttccaatttagacacgatgattttaagatttggttggacacccaaatggagcttttggtgaagagatgaatatggtggtctggctcttaggaaaaaagtctgaaccactgattcatattcagaaatctttagcataaagatattctaagaaagtggataacaatatccaaggataatttagagtgagaagaaaagttggccttagaataaaattcctgagaaatatcaatatttggaacatcaataagaaataaagagttgacaaatgaaataaaggtgaggcaagaagaaagtgattataaaaaacccatgagagagagtttagaataatagatcaaagaaagtaaaacactgactgaaaagtatccactggattgtataaaaagcaaatcattttttacatgcaagataatgataaagttgaacatgtttaaatgctgcagaaaaaaagccagagagagagagagacagagagaatcttctctggaagatacagggaataaaaataagagtccttaaagctagctctctgaggatgttcgataggaaaaggattctgcacaatggtagatggactaaccttaaaataagagaatttcttccattgtaataaaacaaaacaaaacaaaaagatgcagttgaggttgtgagtttagcatttataacagaaaaacaataaccttagatttctcagcccttctttccaccctacaagaagctaattacattttatactttcaacatctattcagtaaaactacagacacttttatgagagttcagtggccaaaatagagaatattcttattcatattctctcgctctccctctctcattatgtataggaagagagaacctctcccaggtgggtctgcactgttatatgtgagccttcaatgtgaaaacgaagaaggtcatgaaagctcttctcagacaatacaatactttttgaacggcaaggccctaaaatctagagatcaattcagggaagatgcaaattttggtctcatccctgaactggtcagatgagtgtccagcccaagagctcttatattacttggtgcaagtgcttatgccctcaatgttctgctttttctagtgggtaaaattaggcagttggtcatctccttgtttgccttttctgcagacaaagaaggctgtactggaatgtcagtttgtgaatccttcaacgttttaccactggaatttgtttgttcttgcttgtctaataaagtgctttctttacatatttactcaacccatgattcctgacctcatcatgtatatccagcatgtgacctttgaaacatttgagtggtacataattatagagtggtttgttatgatagtgatatatttttaaaatgtcaatatataacaaataatataaatagtaaggaataccctgaagtgagcattttatacaataatcttaacccaatattggcaggaacttgagttaattacaaacagcaacttgattagcttgtgaaatagaaagcagtcatatgaaaagagtgagcaagaaagttgtgcatttggaaatttcaggatgatagaaaacattaaaatggcattgaggagaaagctctagaaaggtaaacaagattgctgagcagcttcaaacaccagttgaggttggaaactatgaagatatagttaacttactgtgtgcaattataaaatataccgtgtgggtggtgcatttgtggggccattttgtggtttttgaatgccgttttctacttcatctgttcattcatgtagagaaacttaatcctttaagaatcaactcatgtgcctcattctctgtgatttcttctctaatcatcgagcagggcatgccatacagtaagcgtgccataaatgtttcttgaaatgattaaaattatgctttgtttgtgctgacccttttacagtgattttagtcaactacttatgttctttgttcttcagcttccttacttgtcaaacatgaataataacaatgcctatttcatagggttgttttgtggattaaatgagttcacacatataaagaacctgaagtagtacctggaacaatttaagtgctcaattaaaattaatcatgataattattattatcaagcaattgttattattatatttaattctatgtccatcacttatttacaggaattgatctcctactagcctgcaaattatttagcaaagtggtccttttgttttcaagaacttactatgagcttgacatagaaccagcacacataagtgcttatgaacaaatgaatgacaatgaataatagctgaatgttttttggaaaagctaatatttgtttgtttgttttgagacagagtctcgctctgttgccaaagctggagtgcaatgatgcgatctctgctcactgtaacctccacctcccgggctcaagcaattctcctgcctcagcctcccgagtagctgggattacaggcatgcaccatcacacccagctaatttttatatttttactagaaatggggtttcaccatgttggccaggctggtttcgaactcctgacctcaaatgatccacccaccttggcctcccaaaatgctgggattacaggtgtgagccactgtgcctggcctagaaaagctaatattcacagaagaagaatatcctgagatgtaatatgggattaagggaaaacatacacacaggctttggaatcagactaagtttctagctgggaaatcctaagcaagctatttaattttcttgagcctcaagttgttcatctgtaaaatcaatataactgtactcaactcatagagtaatgatgattgcatgtattttatactaaagatgtagatgtttggttattactctcatcaccaacttcatcagcggggtcattattgtcattcttatggtcatcagattgaccttttgattaccagacttaacataatgatacaaaacacctcagtaacagcttcctaaaatgtaactttcattttaattagattatcctttcagtaatgtaattgagtgttagaagctggaatgggggctgctgcttaggaatttcaggtggtactgtattagtaatattctgatatttgtctacttaatgagagcagcaattcagtacaaaaagaaaaggctctgttttgacgtaaaaatctgatatataaagagtcttattttgggaacaaaacaactaaatatatcagggttgtggttacgttaccagctgcaagcattagtcatgactgtgttataaaagagttaattaaattctttgggtgaaggaggtgcagaaggaagtcaacacagtcttctgatgagatgagtcactgtgatcatatcagaaaaaagcacaggagctgaagaaagtctgggtcccagactgatgccatattgcaggatcagcctgtgtgaaaagccactgaccaataggaagctcagacaaaatagtttagtgtcatctgaagtctcatcaatacataagcagtttgaatttgtgtatgcaattttatttagcatattttcaaggaccataggagaataaacgtccttggattcatgactattgctgttgaagagtgggtttgggtataatgagtaatttcttcccatactaaataatattgctatatcagagagtatattgatttattaattaatatgtatgcttgatcatgacaaaaaaaacaagatgaaaacatgtagatttatcaagacttctgttagcctcatgactttccattctgctgttatgtgttgcctacatctccctcactcatcagtcttgagttttatgattctaatctgtcaaatatcttaactttttttggtccagcctcatctctcaagtaaattttagaaaacggtgttttccatttcccttgtctttttcctaatttattttccacattatgtgaaaaatattctgaaacccaaatcagtcacataatttctattcaattgctcccttttgtcttataggttcacttagcacataataaagggccatttgtgatctgaccttgaccctccagttttaatgaagtgtggtttctccctgcaatattatgctccagctatagtggtagctgctaaatgtattattcagtttcttggtgatgttcctttgtaaatgttgtgagcttttcttggaatgcccttcctttggccttcattacttagcaaatgctggttttcccttaaaaaccctgcattacacactggggccttttgggggctggggggttgggggagggatagtgtaaggagaaatacctaatgtaaatgatgagttgatgcgtgcagcaaaccaacatggcacatgtatacttatgtaacaaacctgcacattacgcacatgtaccctgcaacttaaagtataataataaaaatatatatgtgtatatatatatatgtgtgtgtgtgtatatatatatatatcagaaataggaaaaaaaaaaccctgctcagacatttcctcttctgtaaaactttctctgactatacccacctagactcaattaccctttgcgcacggcccctgtgtcaccatgcacaatatttcattatggcagtcttcacacactcttataatcatttctttgtacaactgccttcttcaataaaccctgagctatttaagaacagggaacatttttctctcagtctccaaaaagcttgtcacaaggtagaagacaaataaaattttgttgaacttaatttctaagtgatataatatggataatgaaaaactttttcagtggagtagtgtaaatggcagcaaaaacatacatcctaattttttttccttgttctgccattaaaatttacaggatgtggaaaaggcaaatattttctttaggcttctggtttttgtttttttttttttcccaaatgtacagcgaaagatttgaataactaatacccaagtcccttttttacaaacatgtattatgactttgtctatactgagacactctcttaaaatagtagtatgaccttattttataatttaatttatatcatttcatgttgaaagtgaatttacatctttaggtaataggcaaccttttcaaaaatcaatgtcgttctgaggctgagattcataaagcaaatggaattgtttagcgtagctagattttatttcatattgacaaatgcttataatatttgtgcaataggtttttttttttcttgatacaacctgttcagtggcttagaggcaaatactgtgtgatctcatttatttgcaagctttcctttttggagaataaatgatatatcagctcaagatcacacagctattttattttgagttgaaataaatcctaagatactaaatatgataggattagttaatcttttgcaacattttcagaacgttgatttttttccccctcaagttttatgtcatagtgataggagcatttcaaagaagaccagaaatggtttcaaatttttgtggcttgtaggaaatgtatgccccgaaaactctttataatacattcttgtgttggggggacaggatgtggggtgggggagagaatgagttaagggggataaattcagactcaataaatatttaaatgtttctggaaaagattcaactagattttaaagtaaatgttacatgtcagaaactaataaatgagatataagattaatgagtctttaattttatatgagatagatagtacaggtttacttactttcttttcttcatttcagaatattttcaaaattacaaggttatctttatttcaataagggtgtttacatttaaaagtctgtcacattgagaaacatgaaaatatacatagagctggattttaagagcagtgtaaatacctgcatcattggtgaaggcacaggggcttcacaagttgatcagccttgaggatgaaagtcagtttgaaaataagagagacatcagggagtaggaggtaggcacatagggaaattgttaggtttgcagacataacctacctgggaatgcagaaacttttactttatttttaaaaattttaattataaatacacaaatatggttgcatatatttatggcatacaaggtgatgttataatttatgaatataatgtggaataattaaatgattctaattagcatattcattacctcaaatagttatcatgttttgtgataaaaacatttgaaatttattctcctggttatatttaaatatacaataaattatttatgactatggtcacttcttgtgcaatatatttaaaaggaaaaaaaaaaaccgtatccctcctgtctaattgaggctttgtatcctttgaccttcatctttccatcaccccccaccacttccactcctactccccagcctctggtaaccaccattctaacctctgctactttgagttctattgttttagaatccatgtgtaaatgagatcatgtggtatttgtctttctgtacctggcttatttcacttagcataatgttctccaattcacgttgtcacaaatgaaggaatttctttataaaggctgaattagtattcagtcatgtgtacatatttcatgttgtttagccattcatctgttgatgtacacttaggttgatttcatgacttggttattataaatagtgccaccacaaacataggggtgcagtcatcatttgaccaactggtttcaaatattttggataaatactgaaaagtgggagtgctggatcatagagtaattctatttttagtattttgtggaacctacacacagttttccataattaatgtactgacttaaattcccgccaacagtgtacaagcaaaaccctctatgctaataaaaaatatagttcgtttcccattgaatgtgaaacttaaaacatgaatttgtaaaaaaaaaattatgtaaatacattttcaacaaaggaaaagaatacctttcctgatgaatgacataattaaataaatatgaaaggaaatattgttctaaaaactaattagggttaaatttaagaatttaaagaagaaaatattgaaaatttattaataaataggtgaaaggtctttctgctttgtatcttcatttttttcagttatgttatttagaagattaattatctgattaaagaactatgatcatttattgcatcatttttcataacttttattattagtgtagcatcaacatttacaatacaagtttcattgttcctttttaaacacgaagaaaacataataatgtgttaaataattttttaggtctaattgatctcttcctacatattcatttgctgtagttgtatctattgtatttatttgttattgaatcccagctgaagaatttcaaagttgttttatgtttaattcacttaataagcatttattgagtactgcatatattaggtcctggagggtggagattataggttaataaagcaaagtcactgccatataattagaaagaagactttttttgaagttttacatttatttatttatttatttttattctactttaagttctgggatacatgtacagaatgtgcaggtttgttacataggtatacatgtgccgtggttgtttgctgcaaccatcaacccacaatttctcctaatgctatccctcccctagccccctaccccccgccaggccctggtgtgtgatgttcccctccctctgtccatgtgttctcattgtttaactcccacttatgagtgagaacatgcggtgtttggttttctgtatctgtgttagtttggtgagaatgatggcttccagcttcatccatgtccctgcaaaaggcatgaactcatccttttttatggttgcatagtatttcatggtgtatgtgtgccacattttctttatccagtctatcactgatgggcatttgggttggttccaagtctttgctattgtgaatagtgctgcaatatacatacatgtgcatatatctttatagtggaatgatttataatcctttgggtgtatacccagtaatgggattgctgggtcaaatggtatttctggttgtagatccttgaggaattgccagactgtcttccacaatgtttgaactgatttacactcccaccaaaagtgtaaaagcattcctgtttctccacatcctctccaacatctgttgtttcttgactttttaatgatcaccactgagatgttagtttattatactctaagatctattgaggaaactgcagtgtgaatttctacaactgcacattgcacattcacatatcaccatagacaattacattttgggggaagaaattacatgtgaatgagcattttggagaaatatgatggtgaaaggagtattttagaagacgagattttacctaaattttcaataagtgttctaaactagatatcacattttttattagacaatattttgaaaagacccacctgctgaaaagaaagaacaaacatggttactgttataattattgattcagaggggatgttatgtatgtaggaaaatcacaggcaattcattaaaaaactcttttggtagcttctatcaccagcaaagaaaatagtttaatttcattttactgtagttcaaaatcctccccagggtgtaattctgattttttgtcacaggagccaattgtgttattagaataagaaaatggtgtattttaaaaaaatcagctacgttggctttttattctgatgataggaaattatgtgtgtgtgtgtatgtttcacacatgatggaaaaaaatgagtaagacataaatcttcagaattaaagcccggaagcaaagtgtatgttccagtgaagactttaagtgacagcgtgacgaacttttgatcagtgtttcttatcatggagtaatttcttgatcaattaacaatcaattagaatttcagacatggcttagatggcatgatcctatttcaaaaatgtaatgagccaaaaaaaatgggttggcagattccaaaatctatgaatatactgatttaagaacaggaaaaacattcaaatgtcatatttttgttagtacattggacccgtagggtatgggaaaaataatatactgggatatttgcagtcattccaaatatatatattatattatatattcatatacattatattattatatatttatatattatatataatatattaatatattatattatatatttatattatatacaatacatattatatattgtagtatagtatatattatatgatatattaatatatagtatatattaatatgttatatatatataatccaagttaaagcaatagaacaaaacacagtatgtggtacctgcagtgctcactgcaattgaacattcagtattaactcttaattcccttgaaataaaaccaaaatgggtcatatatagagatatatagttcttaagctgcctgagacaaaattccgaattatccacttattagttatttgcaaattattgactttattcttggctaaactttatccatgaaaagagaaaagaatattaccttaatcatgaggatattgtaagaattgcaggtaatactatatgtaagacccttaacactgatgtgcacagacaaaatgcttaatattaatgaatattagcagttaataatgttattaatattagtattatggtaaataaaattatggtaatttatgtgaggggattccttcttcctgcttctcctaccccagcaactaaatttaaataaagcatttatgataagggtaaaacggaaattagttaatatgatttttatttaagtgtggtttttgaaaaagacaaatgattgtattttacaaaactatgtttcttttatcaactctatacagaaactgagaccttagtcttaatgtataacttagaaaagagtttttcatgacaaagtgctgaaacaatatggtgtggacacctgatttcctggtaatctaatttaatacagtggtaaaacttggatgttggacacattatgctgtcccttccaatcactaggagtctgaagtagctggtgttgggttggactcacttccaagctgaatttttttgaataaagggccaatattgtttgatgactatggtaaggtctgtatgcttaaattgtcagacaataaacagtcagagttggcattctgttgtgaagatgtggaaatcaaaattggttcttgctatgatgtttaatctactttttcacatcagtgagtctccaaaatgcctctgggtatagctgacattttcctgcagaatgaactttaaatctttttaattacttgccacattacacgaatgagacaattttaacctaaagaaaatgtaagggcagatgttatcagttaatcattctaaccaaaaagaaaaaaatattcctctgagtcctatgggcaatgctcacatttcagtagaaatgtattcaagttgacctgccagaatgagttggttccttgcaataccaatagaaaatcaaatatagtaatcatttagaatgtacagaccaccaacatgcttaagaatgtccactaaatagcataattgctgcttttagttgtgttttaccagtgtatatatcatcacactagaaaaagctgttgattgtggtatttgttgtaatcaaaccaaatcaatttaacacatgtaccaattatttaaatataaacttaaaatttgagggtgcacatttagattatagtattagttatatatgtatatatttatttttacctagccttattgacctataattgacaaatgaaaattgtatatgtttatagtgcacaatgtaatgcatggatatatatatatatatatattttgaaatgattactacgatcaagctaattattgtatccattgcctcacacagttatcagtttttgtgtgtgataagatcatttaagttctactctctttgtaaatttcaagtatacaatacattattaagtatagtcaccatgctatatattagatctccagaatttgttcatcctgcctaactggaactttctaccctttgaccaactcttcccacttcccctatgccccagcccctggcatctgccgttctaagcggcaaatgaacttttataagttcaacttgtttagataccacgcatgaataagattatgcagcattgtcttactatgcctggcttatttcacttagcataatgtcttacaggttcattcatgttgtctcaaatggctgaattttcttcttttgtaaggctgaataatactaaattctgtacacatgcacatacacacacatgcatatcatattttctttatccattaatctattgatgtgcacttacattgattccatatcttgtcttgtgtcaataatggtgcaataaacactggggtgcaggtatccccttgatatactgattttacttacttactttagatgtatcctcagaagtgggattgctggattgtttttaatttgtgagaaacctccatactcttttccataatgtgtatactaatttacatttctaccaacagtgtacgagagttcccttctctccacatccttgccaacacttactttttgtctttttgataaaaaacatcaaaacgagtgtgaggtgatatctcattgtggttttaatgcatatttctctaatgattagtaatgttaagcatcttttaacatatctattggccatctgtatgtattcttttgagaaacatttattcaggtcctttgctcagtttttagttgggttatttgttttcttgctattggattgtttgagttccgtatgtattttggttattaactccttatcagatatatggtttgcaaatatttttgctcattctgtaggatgtctctttactctattgatttgttacctttgcagtgtggaagctattcagtttgatataatcccattcacctagttttgcttttattgcctttgttttggggttatattcaaataatcagaccaatatcaagaagcatttcccctatgttgtcttctagaatatttaaagttttaagtcttcctgttaagtttttaatcctttttcagttgatttttgtatatgatgtgatacaaaggtacaatttaattcttctggaagtggatatccagttttcccagtaccatttattaatgaaactgtcctatctccaccatgtatttgtggcatttttactgatgaacaattgaccataaaagtgatgacttatttttaggctctttattctgttttattggccagtatggtgattttctattttttttattgccaatatcacgacattttgattacggtacctttgtagtgtattttaaaataaggtactatgatgcctatggctgtgttcttttttcttaagatttgtttggctgtttgctgccgtttgtggttttatactacttttaggaattttcttcttgtttctgtgaaaaatgccattacaattttaatagggattttattgtttctgtagattgctttgggtagtgtaaacattttttgtttgtttgggtagtataaactttgggtagtataaacaatattaattcttctaatcaattaacatgggttatctttccattattttgtgttctttaaatttcttttattattgtgttttagtttttagtgtacagatctttcacctccttgattaaatatatttctaagcattttgttttatgctattataaatgaaattgttttcataatttttttagataatttactattacatgctactaattcatatatgttgattttgtcttctgcaaattgaatttatttattctcacagttttttttggtggaaattttaaggtgttctgtataatcatctaaaaacagaaaaaatttatttttttctcttcaagtgtcttttttttttcttgtaggcactatctagaactttcagtatagcattgcaatagaaggaaagagcattcttatcctatgtcctccatcttttctgggtatagtttttttggttgccagtttttttattgtaacacactgaatttatcgtctcatactctcctggagtgcatggttactgttgagaaattcactgatggttctaacagagtttctttcatatgtgataagttgcttttctcatgctgctttcgaaattctctttatctttgacttttgagaattttgttaccgtatgtcttgatgatgatctgtttatgtttaatctattttgggttttttgatcatcatggatctggatattcattttcctctccagatctggagatttttctgttattatttattcaaatatacttttatactttttctctttctctgctcattctaggagttctatagtgcatgcattgatgcatttaatgatatctcataaatcccataggctttctttactcttttttatcctttatttctttttcatctcataaatctcttatttatttatatctcataaatcccattgactttctttactcttttttatcctttactctttttatcttttatttctttactcttttttatcctttatttctttttattcttttggataatttcaaatgacctgtctttgaactcactagttcttgcttctacttgattgaatcttgcttctacttgactgagctatctgttggatttttcagtttaattattgtgttattcagctccagaatttttgtttggttcttttctatggattctatccctttcttaaaactctgatttcattgatacattgttttcttatttttggttagtcgtatgtctatgttctcttatagctcactgggcttctttaagacaattttgaattatttgccagacagtttgtagatcttcatttctttagggccagttaatggtgatttcttttattcctattatggtattgtgtttctttgattatttgtaatcctgtggacttgcattggtgtctgtggttttaaagaagtggacacctcttctagtctttgtaaactggcttcaccagggaatgtccttcatcagtcagcctttccagttattacgtgcagtttatctgatggggtctgtgtgtgccagcctggtgttgggacagggcctagagcctgagactgtggaagctggcctggtgctaaagtggaactgttatctgggtctatggagatgtcctgagtttgtgggaaccatcttgtgctgaggtcaactggggtaggtctggttattgggaccataaaggtgggtctggagtctggatctgtggggccagtcttgtgaagatctcctggggtaggcctgaaccctgggtccatggagccttggtccttggtagctggcctggaaccttggtctatagggactggcctgaagcatgggtccatgaggactaacctcacactgtgtcaggctttaagcctgattcgaaggggcttggcctgactctgagatgtacctggaaactggatccaaggaaacagatctgttcctgagtctgtgggagtcagcctgaaactgcagtttactagagtgggcctggagtctgggtctgccctggtaggcctgctacctgtatctttgtgggcaggcctggtgccagggaaccacaagggcaattctagatcctgggcccacagtggccagcctgatgctgggacaggtcttaagcttgagtgtgtaggagttggcctggggcttcagtctgcaagtgccagcctggagcctgaggccatgagggctgacctggcactggagtgtccttggaacctgggctcatgtgattgagtctggagacttggtctttaaggactggcctggcaccaagctaagcctagattctgagaccacggggccttgcctaacactgggacactgggatttggtgggatggggctggtgtcgaagtttgtggtaacatcaggtattcacttccctttcctttcctcgagcaggacacaactcttttcacactgtgctgttcaggcttgtgggaagggtttcatgaataatgtgaactgtccttgctactttttacaatgtgtcttttctcatatctgtgccccaccacttgctataatttgtcagctaaatttcttagcttttgtgaaggtatttttatccatagatagttgttcaaattaatgtttctgtaagggaatcagcactgcaaagtcttattctaccatcttgcagacatcaccagtatcatcatatatgacttaaaataaggattcaaagtcatttttaaaataaactattcctaccagaggagtcaaagtgttataacagatcagtgaaggctgagaaatgtgttatactttttctagttcagctcaactataaatagtagcaagtattggtaaagaatagattctagctctggaaccagacagagaaggagatggacatgagtctcagctttaatatttacttgctgtgcacttcgaacaagttattcaatgtagataaacttcagtttcctctaataataatatgagggataataatgtaacagtgtttcaaaatgcaatcagaaatgttataatatttctgaaagttctgtttgaagtcttctcactttgggagatgaaagaaaccagtttgaggtgtttcatgagggtttttcatagagaatatgaaaagtggttaaagttgtcttacttgaataatatgtggaactcacacttagtattagttcagacactgaaaatgatttgccctaaaatatttaccaaatctgagattttttttcactactgatactgagtcaaatttaaaggcttgaatttctaatgatatgtaaactttgttttcctatatagttaagttataacctttctgaatagatcttagggtaaaaagctttcactgtaaaaataagccctaatttcagctatcataatttgggactaatgcagagctagccctgctctgaaggattggatacgaatgtgttttactccttgaattcttcatcttatccgagattctaccagtgaatcagtgacaactttgaaatctagagtttctgaatgagtttaatcctctcctgtttcttaggcaaaaatagttcaaaacatttttttcatagatctgagtatcctgtatttatattatggatgtgagataggagcaggtttttaaaatctggcctacaggtaatgaaataatgcatatgttatgtacgcaggccaatttaaataagctattcttttttaacatacaatctcatattcatttctatatgccatttcataaaatatgccttttttattgacttctttgggcaggaattgtatgtgtaaaacaaatatggaaatcaaggacagctgtacaataaatcaaagtcacaatgctgaaagcagaaacttgagacgctcctttaaaaaaatgacttgtaaatcaactcatggttgcctgacatttccactgattaatgccggtgtcctttgaggcatactaataggataaacaaggaaaaatggaatttcttgccataagatgagggtcagtttgaagatattcatgactcagtcgcatcacttaatcacaaatagttgtaacctgtagcagaaattaattcaatgtgaattttttacaattaaacacagtagtctttgtattgctgcacataattaaccttcattgtctcaaatttttcaaaataaaacatttctacttttaattacaaacatctaatttttgtgagttataacaaaatggaatattttctgagtaggctatagagtaaatttagttctgaaagttcctggaataatgtcattgagaaacataatatagcatcagccataaaatgtcatggttgatgctcactgaaagccattcaaaggaattctgtattaacttttgcaaatgcacactttgaattcataaatctttatgggaacacattttaacaaatgtactgtggtttatatttaaaagcactatgtggtttatagttaaaagcaattatgattcactctgtctgctgaactcactaaagggaaggtcttcactgaacacaagactcttaagaacagtaaagattgttgttaaaattcagagtatcagcctccttccaaactgggccagggacctcctttaataagaccagcttcagtgaatatatattaagagatatcaggagctaaagtaagttaatagaaaagaaaacatcaaaagagtacattctaaagaatttatggtatatatacacaatagaatactattcacccatagaaaatgaaatcctgctatttgtaacaacatggattatgttattatgacaagtgaaataagccagacacagaaagacagacactgcataatccccacatgtcctgggaggcattcagtggaaggtaactgaaccatagagatggttacccccatgctgttgttttcctggtagtgagttctcatgagatctgatggttttataaagggcttttccctctttgctcaacacttcttcctgccatcatgtgaagaaggatgtgtttgcttcccctttcgccatgattgtaagtttcctgaggccttcccagccctgtggaacagtgagtcaattaatcatctttcctttataaattacccagtcttggacatttctttatagcagcatgagaacggactaatacagtaaattggtatcacagaaagtggggtgctgctgcaaagatacccaaaaatgtagaagaactttggaactgggtaacaggcagaggttggaactgtttgtggtgggggcttacaagaagataagaaaatatgggaaagtttgggacttcctagagacttgccaaatcactttgaccaaaatgctgatagcgacatggacaatgaagtccaggttgaggtggtctcagatggagatgaggaactttttgggaactggagtaaaaatgactcttgctatgcaaagagactggtgacattttgccccttccctagagatctgaggaactttgaacttcagttagatgacttagggtatctggcagaagaaatttctatgtggcaaaatattcaagaagaagcagagaataaaagtttggaaaatttacagcctgacagtgcgatagaaaagaaaaccccattttctggagagaaattcaagcaggctgcagaaatttgcataagtaacaaggagccgaatgttaatcagcaagacaatggggaaaatatttccaggtcatgtcagagaccttcacagtagccccatccatcacaggccgggtagcctatgagggaaaaatggtttcctgtgctggacctaggggccccctgctctctgcagttgggacatggtgtcctgtgtcccagctgattcagctccagccagggctaaaaggaacaaaggtacatctcaggccattgcttcagagggtgcaagccccaagccttggcagcttccaggaggtgttgggcatctgtgggtgcacagaagacaagaattgatgtttgggaacctccacctagatttcagacgacgtatggaaatgcctggatgtccaggcagaagtctgctgcaggggcggaaccctcatagaaaacctttactagggcagtgtggaggggaaatgtggggttagatcccacacagggtccccactgggcactgcctagtagagctgttagaaaaggaccaccattctccagaccccagaatgttagatccactgacagcttgcaccatgtacctggaaaatccacagacactcaatgtcagtcatgaaggcagcctggagggggaccatgtcctgcaaagccacaggggtggagcttctcaaggtggtgggagcccaacacttgcatcagcatgacttggatgtgagacatggagtccaaggagatcattttggaacttttagttttaatgattgctctattggatttcagacttgcattgagcctgtagctcctttattttggccatttcgtctcatttggaactggtgtatttacccaatccctgtacccccaatgtatctaggaagtaactcctttgcttttgatttcataggctcttaggtggaagggacttgccttgtctcagatgagactttggacttggacttttgggttaatgctggaattagctaagacattgtgggaatgttggaaagggcacaattatcttttgaaatgtgaggagatgagatttcagagggactggaggtggaatgatatggtttcgctctgtgtccccacccaaatctcatcttgaattgtagttcccataatccccaggtttcatgggatggaccccatgggaggtaattgaatcatggagacgttacccccatgctattcccgtgataagtgagtgagttctcccgagatctgattttacaaggggctttttcctttttgcttggcacttctccttcctgccatcatgtgaagaagggtgttttttttcctcttttcaccatgattgtaagtttactgaggcctccccagccaagcagaagtgtgggtaagttaatcctctttcctttataaattacccagtctcaagcagttctttatagcagcatcagaatggactaatacacctctgaaaaaagttgtgtaaaatagaatgctgctgtatttattacaggagaaatagaatgtcaaagacatgggaccatttgtgtcttttgataagtttattctttctgtatttcaaaatgtcacaaataaatgaaattataaacaaaaaagtttgtaacttaaagtctgaacaaaagggttttgatggactaaataaaggcctctcttctctcattgtctgaaatgctgtctaggtagctggacattattatggttagttatctaaccaaatatacctccttaaaacattcaggcttgttaaaaacataaatgttattgttattgccagggatttagaagatatgtttctgatcttgaaaattttgattttgattttccttttttttccaattcaaaaaaaggaagcggaaagtttgagatagttactcatatagtttctggtcccctaaacattgttggagataccctattacttatcatttttttttagaatccctagagagtgattctgatgcaagtatacccataaatagaatataatcaattatatcactggtgcagtccagttattatgatcaattattatttatttcttgtaatcattccttatttattttaatagctttctataaccttaccttcataacttaaataacttaaattttgacgtttgcttgcaatcatctattttctggctattccttagggcagataattttcataaatagctgaatttatcctttgagggttttaaaattatgttaaatttccatgtttatctgcaagttatggattatgtcactttaccatatcactcctttctgctgacaagcattaacatctatgggtgattttgtaacaacagcaaacatcgtcattgtagtattctctgccttggactttgtaaagttaaggaagtgatgtagtaatatttactagttgtgtgattttgaatgttaattattattaacattggatattaatttatccaaactcaaatttctttcaccagattatagggaaacttacaattgcctagttgattttccatatgaattagggataatgtgtattaaattaccaaaaataatgattggcatttgttacatattatcaactgaagagtgaaatttggaaaggagcgctttattactcataaaatattgcagccttcagggttgccattctgactggctgggaagcatagcctccagccagaagtcagaaacagatacttcaagggtgggaagaataagatagtaatttatgctgaatgaggtagccaaatataaatgttcaataagctatgggaggagtcgtaaatgttcacaaatggagaaacatgcacatgtgcaattgagcttcatgcctctccacaggacccatgttcaaaaaatggtgacaacagcatgaactcagggcactctctgatgttaaaaagtgaagcagaaggcatgaacaccctcactgcactgtgcattctctctagactgtctagaaccactccgtgatcagtggtctcttaggcaaaaaaggaagggcagcatcaggcgattggttgatctcagtggctaaatccttttttttttttccccctttggatatagagccttttggtttgttttctttttcctttcttttctttttattaatttccataggttatttgggaacaggtggtgttttcttacatgagtaagttctttagtggtgattttggtgcacacatcacctgagaagcatacactgcacactattcgtagtcttttatcccttaccccttcccatcctttccccctgagttcccaaagtccattgtgtcattcttatgcctttgcatcctcatagcttagcccccgcttattagtgagaacatatgatgttcacaaacacacacacacacacacacacaatggaatactactcagctgtaaaaaggaatgaattaatggcatttgcagcaacctgaatgagataagagattattattctaagtgaagtaacgaaggaatgaagtcttttttaaaaggactggtttctgtttaaccttcagggaagaaagcctaatagctgttagccacctgggaggggatataatgaggggtctgtaacctcctatctagtcctgacaggcaactcagctttcatggtctctttgtagcccagttggccaagagatggtctgttcagttggttgggatgcttagaattttatttttatttatcaatattatgattgttgcaatgaatgataatatattatcattaaaaataataaaaagcccttaattcagttaccttaattaggtaatttaattagaaatactcctgctagtattttgaaagatggtcttgaaacacagaagaaattatgtaaagattatagagactgtttatataattttttgatttaaaaaactcatttcaattaattggttttagtacaggtctcgtcattccttaagtactgctcttaattatttccttacttggattggctagtggtttttctcttcttatgaattttatgaaataaaccaaggtcaagtttaaggtagaaaaagatgcttttagagaaggcaaagtagggtcttaaatatggaatttgtatgacaacttatcttgccctttgcttctgtttcaggggtatacttcttataaaatatttgctgacaaggaagaaacacaatttcaggttcttgtaaatagccaagagtatttgtagtcagttttcccaaacgcatttgctttgtattgtacaaagtcgctattgtctatcattaacatatcattaacaatcatattatgtgaacacttaataattatgtaccttcatgctgagactccttgacttaccatatgtacaatgaaaatgttgaatcagcttttttagtacaaggtcattgacaggccatgtgggagacactgactgataagaatggaatcttctcactcagcccaatgctccaccaaagggagattttcagtttgcttcttattagcacgattcacaactgagaagtgtgaatgatcttatggttcacttctctgatgtgttggagttggcctgcatgggtttgcaaaagctggctcttaaaattttagaaaacttgccagctggtttttgaatacttggtagcttgaaattggttataatgtgaatacttacaccacagaaactggaaaatgcctctgcccttctattccccaaagatcttattgttaaacatttattagcacatctggtttacttccacaactttagtactcagctattaccggaaaagtccctgatgaatgtatttgttctttactatgaagtttcaagtgacagaaattaaaaaaaaaaatactgcagaaactacactgctctgggtataacttcctttgaacagttaaaaatttcccacagtctggccaggcatggtggctcaggcctgtaatcccagcactttgggaggccaaggtgggcatataatgtaaagtcagaggttcaagacaagcctggccaacatggtgaaacttcatctctactaaaaatacaaaaattagccatgcatggtggcatgtgcctgtagtcccagctactcgggaggttgaggcaggagaatcacttgaacccacgaggtggaggttgcagtgagctgagatcatgccactgcactccagactggatggcagagtaaaactctgtctcaaaacaaaaacgaaaacaaaaaatttctcactagtctaagtagatggaaaaagaaatagtttttttccaattatgagtttaccacaatttggctcttctaggtccaaagtactaacgctttctatttaaaatcgtatttcggaagataaagttttaaaaaaattttaaaggcaatgacaaaaaaaaagattttagtattattaccaagtgacctagatataaaattttatccattaatgcagcatcatgaacttcctataatttcctttctggtctcagatgaagggattatgggttattgccacctaagaaagcatgggatcagagtcttaaaataaatcaatattcatgtggtctaaaatgattcctcctgtaataaagtcgtaccattttcaatcaaaaatataattcaaacggggaattggcaaaattccaatgcttgctgtatggttagtggttttacaattaattccttgtatcatagtgcgtgatccttggattaatgtccctgatggttagtcattttgttaattcacctgtccatcaggactcaattgtgataccttattcttccttcagatggtttaaattttacaagagaatacaattctcatcttctaaaggtgcattagatatcgtcatctaccagggtcttatttattgaaagaccttccaagaaaataggaaattttcttcctctttctgctttttcaaaacagttcattttcatatatcaaaaccggctcattataacaagtgaaatgatagagatgaacagagaaaaagctaataattcccacctaagtccctcttaatgattacctttctgtcataacaactttttatatacatatattatttcatatcattttccaagttatagccaaacaaatggatataactcattatcattttgttgaggttttattaaggtagaagcacaaaataaacctcgttttatgagtttgtttcttttttttaacataaaatgtattatggatatcactcctgggcaatagatactgatcctactcattcttaatggctacacaatgttccataatatagatgtatcaatgttttcaactattcatttatttataaaccttcagattactttttcattttatctcttctacaagaaatgctgtgttaaagatccttgcctgtgtgtaggtgtgtgtgcatgtatacagttatttcagtaaaaaaaaaattccagaagagttactactataaatttttaagtaggtattaccaaattgtttttcaaataattgtatcagttgatagtctcacaagtaaacttttaggaaccatttactttcaatggccaaaagaaattgatactattaccaagtgatttaaatgtagaatttcaaccattaatacggaattattaaaaggatatgagaatgaatttctccacatgttatcaagtgctggattttattgttcctgttcatttttactggattcaaaagcccaaagtttgctattttaccattcaagcttctgagtccagcaaataccaattttaatatatgccaatctgataagaaaaacatgatcttcatgtccactagtgagatttaacatcttttcatatactaagagtctattttgaattttattttgtcaattatgtttcagttaattccctttaatcttttaatttttgagttttatttcatcttataaatttatgagtttcctttgtttatcaaatatattaacaatttgcagtatagtgtcatggttacaagcacagactggtgtcagactacctgccttcaaatcctgtcttccacatctcttaccagtgtgtctttagggaagtgtcttgtcttccctgttgtccagtttcttcatttataaaatggaaagaataccaagacctccctcactgggctgttttgaggaagaagtgttagctattaatatatacacattttccccttgtgattttgtttgtctttgaactttgggatatctttcattttaccaacttaaaggtttttttgttgttaaatatgtctaatttgttttatggattatgcattttctttcatttaaagatctctcccactcctaactcttttattgttcaggtattaactttattttttattttttatttttttgagacaaggtctcagtccgtcaccaaggctggaatgcagtggtgtgattatgactcactgcagcctccagctcctgggctcaagtgatcctgccacatcagcctcctgagtagctgggactacaggtgtgtgccaccattcccagctaatattttttaattgtttaccatcagttttataatttttctgtgtatttcctaagtttctaaataactagtaaattacaggataaccaaagctatgctcagtgattgctggtgctagattgcatatatgaaatagctgtaaaacaagaagtaattaaaatagtaaataattttcattattatagattttgaaactaaggcaaaattgctacattgaacattacaatttaaaagtacacatcaaagaagcatttattattttatttatttgaggtcattttcaccaaactagcaacttcatgggtacaaaaacattgaatggcatatagtttctgattttgtgtccctggttaatgacaggaagcacagaactcaaacctcgtacacaaggaacccatcttactatggctttcctatccaagcattgcctcaacaaaacgtactcacatttagcccaattcattctttttcaggcatgtggaataatgatattcagattttctatgaaaactgatatttcccacactcacttctttgcactgcagtttaagagtgtatgaacactacttaccctttggtcatccatgtttgaaagacatatttgggctttcacatttttctgtcacctagttagtgtaaaacttgtctgtattcctccagcttaattaagatcaactgtgcttaacaaagtcattgatttcttctttaacattaaatcgtattccaaaagaatcgccaacttctcttgatacatacaatttaattcaggtataattataacagttttatggtatattgtttttataaaattaaatagaatgtttcttacagaattttgtaaaagacgttctggttgtgatttctatagtaaagctgtcagaaagctggtctgtcgaatgaataagtgacattactgtagtcaaaactacacttttattgcttttacctccttgttgtatttatagtacctagtcataatttctaatttgacagacacttgagtcttgttgctgtactcagtggtgtttcttgtcactctctctttacctcaggtgctttcatttctgcatttgactccagtatctagaaaatcatacataatggcaatttacactgaataataaagtagacttgtgtgaattttttcttgagctattcattttgaacttcaagtcaatattaataatatcaacattaaaagtaaactaatttgcaactgaactttgcagcagggatcaaggaagagttttgcataaatgttactatattatttttcagtatcataaatttttgattgtttttggctatagtcatagtttttcctgtttcagatgatcacttttgatttccttcctcttctcttttcttccttccttcattttttccttcaatcgcttttcttctttgcatttcttgctctctctttctctctctctctctggtttaatataattgattgtatactcttatgcactcagaaaaaagtcttaaaacctcttatctgaactgatactttgtattgaagagagtaatatgaaaattgtaggcagaaattgaagatcttacctaattggatgttgaatgttggtcctcccttgtctcagatggggagaatataggtaacaggttttgtctatgttgaagtgttatttgtcactcactattcaattacagtactcatatatggctttaacctcttttaacctgcacaattacattttcacaactatagctatggtgccacttaaaatgtggttatttgtcttaaaattgttcaccaaatttcatgtggaattctaagcctgatctccttggagatttgagtcatttgataggtagaagttcataagtagttagcctggttctctcctgctgtgttcttctcttctctggcatttgccctgtattttaggaaattaattgctgtcttatatgtgcctattatacaagaataaaataattctcatatattcatatatacttatatataatataaatatatattattactaatatatatttatatattatttgaaaccttatatattcttactatatatgaataaaacactttctggagagaaaaaaaacagacatcagagtcgtgcctgggatagcctatttgataaatatttgttgcattatttcctacatgaatgatggcacaatacattttcttttaaagattagcatttcagagagatgctcagaccataccacttctaaggaaatgattgtggcttagaaaggaaggaaagaggaacaagaagtagtaaaggatggttaagcactgagtaagcttttttttcatttttgttatctggcataaagcattaggaaaaaacaactctatttttccagatgtcccagtctttcaactgacatatttacagctagagcacgcttattcatttatttatttatttttggagtggaggaagaggaggtagtcaggtggtttacaaaaggtggatttctaagtctctgtcaacatagaccaaccctgctggacctcatactttttccccttcctccctgtcatcctcatttttttcctttctttaaaactacattttgaatgtctacttgaatacctgttcaaggcattgatacttatcagtaaatacaatggccaagaactttgctaccatgtagtcattaccttctacaacaggaagaaaactaaaataaagcaaacactcaaataccaaaatttaagatagtaataattactattataaacagagtaatgagttaaagagtgatggggtgaaagtgatgttaagtgttgacttagattgactggctatggaagaccttcttgaaaaggttaattttgagggatgacttgaccaagaaagttcggttatggggaaatctgtggcagagggaagaatccttctgaggaaaggctgagtacaaagaggaggcttatgtgactggaacttggaaagtgaagacaagaatggtggaaagtgaagacaagaatggtagaaagtgaaggtccaggttttctaaaccttgaagactcctgtaagttcaatgagaagccaaagggctgttataatagcaaaacgctaagatctgatttgtagtttggatgctatatggaaaaggggttaggtataggttaaaagaatgagcaccgggattggggtgattaggtccatcagtaatatttgtgggcctagcgcaagaggaaaaatggagggaaataaatgggatggaaggttaatcacatgtcacaacaaggttggatcttaccagttttgtctaattcctgatatcaacttcacctctaagcagttagaagtgggggaaagactgcccacccgcttcctttgtccagtgaaaagtctcacacatgcgagtgaacactgtagctatttaggcaggaaattccatggtcctttgcatttggaaaatatggcagccagggaaaccttccccttattgctctggaggtttgctgcaaaaaatcaatcagaaaaaggtgaggggtagagctgcacaggaacaagtgtataattatgcagattcatttcctcaagtaatttcttggcgctgctcttagaagaatagatgaaagctctgtctggatgtggtgataactccaagtctcttctcaggtggttgatttttcctggttatttgatgagatcacttagggtgaggatttaagacaattgtatttcttttggaaagaagctttcttggtcagatgaggaaattccaaagagactctctccctgtaattggaagtggagatgcaagacaaggttagaggagcattgattctgagtcatcttcaaaagcctctcagtatatcagagtgccagtctttgggatattgctttttgagtcccaacaaaagggatggataagtgggtttgtgaactttcaaggatgtaaacacttggtctcaaagattccttgtcctgtagcataggataaatgtagaggtgggcaaaattgggcccagtaaagcctgaagcccaggggcacataccctggttgctgagctctaagggaagtgtcattactgataacattaaacatagagaaaagtagagaggtgctatgtatgtttagaagtaaaatcaaccaagttgaaaacggggtttgaggaaaatagacagtatgtgtcttcttagagcttatgatgtagcaaggaaaggagacgtaaggtcaggggaagacctgttaaaattgaatacagcaaagaaaatccctcctgcctccagtcctagatgcctttttcttgcagtatttttgatatgacactgaaataggactaaacttctgtaggaaaagcataataccaaccaaatctcaaatagtcaacataatacttttccagaaaataaatgggatcgaaggttaataacctgtcacaacaaggttggatcttaccagttttgcctaattcctgaaatcaccacatacctctaagcagataggagtgggggaaacactataacaagaataggttcattgcctgatgcacacagcaagtcaatacactaagactctgggttgcaacagaggaagaggtttagtcatcgtgtcactgaatgaagagatgggaagaaacctcaaatctatcttccaggggaatttggggttagggttttaaaggttttggagtgggctaaagtgtgaagatcgttgattggtcaaagagtgcagggagaagtcatgggacagggagaggaagaagctgtattttcatgctggtcccatttctctgagggggtcctccaacttgttgctggaatttggagtccaaaaaacatcttaagcgatagattcttaaacaaaagctttatgattgtaaagtcagagatcctgtctataggaacaatggggatgaaagtcaattcttaaacagtcttatgaccccagtgtcaggaatcctgtctgtaggaacagtggggatacaaatggtcagtaaccaatgctaacatgactttcagcgccaagaaaataggtcaaaatgcagccggattgatgcttaactataactatatttctgtccagaaagtggcatgcaattcttatcaaccctggggagggggcagtttcaagactaaagagatagggaggccaaaaacagtttgctcagaccatccaatgactggagctcagagtgagggctacagttccttgaaggactaggaaagcaaggaaaaaccctcttcatttatttaaaaactcattaattaattaattaaaactataccattcgaagtcactgctgggcacagagaagtgttagtggaatttacattgtttctgactttatcgatgtccagtgtaataaaggcattcagtgggggtgtgagggatgaagagaggtgaggctgagtagaggcagaaaggagcccagtggcaaatggccaatgaaggaagcaggccactgtggagtggggttagagtagaagcaagtgatgtgatgtgttttattattctgtactattaaatttttggtctaaatctccttgatttcctccccagatcaagaagttgatttcctgtctttgaggagcttggtcaagggatcctaatttcaaacattatgaaatgcaggggtggacaaagaagtacatcattattacaaaaactaatctagaaaatgacacagattaagtgtgcaagtaaagagaacaactgaggcatttatcaatattctatcccagaaaaagagaaacgttccagagtctcttgggggaggtcaattctcaggccagtggtttaataatacaaaacaacattaacatagcagcccatttcattaactttgattacactcctctggatgcttacttgcccttagtgactgttagtaagatgttttccctatatttattaggaaagcaacctttatgttaaagatctgcaaataaaataatgtgttgaaatatggggatattttgaaactgcttaggtatggtgaaagttaatgatttcagttacatctttataattactgtcatcaggtttctacctttatggcttcttaattgtttaaagatcataaaacagaaaatttagcacaagcttgagaaagatattttatggtataacataattttatattgatattatcactataaaaagattaacaatggattttactttctacacctttgattattattttaactataatatactatgtagtctgtagcataacattcctactaaacaaacactctgtttttatttagaaacaagcattttttaaggttttaacttttaccaggcttaccctgttgatgcaaaataaggaatggggggtctggtagtacatgaagggaaaaagacagggtgacacttcccactggggaaagtcaaatttacccctcagaaatgtggcagtgaagggttttgtttgtttgtttgtttgtttttagatagggtttcactcttgtccatctggagtgcagtggtacaatttcagctcaccgcaaccttgacctcccaggctcaggtgatcctcccacctcagcctccagagtagctaggactacaggcctgtgccaccatatccagctaatctttgcattttttttggagacaggctttcgccatgttgcccaggctggtctctaactcctgcgttcaagtgatcttcgaagtttggcctcctaaagtgctaggatttacaggtgtgagccatcatgcccagctggaatggttcctttcaggctaaataattctcttttggtcaaattcatttgcttcattctagtgtattgagactgtactcatgaaaccagatggctatcataatcccaaaaaacaaaatcctaaatataaatatcgaaatcctgaaacccaaattctggggaaggtattattgcattttcagttgtatgcaggatggttgcttcatgttagtttcatcacattaagtgaaattattactttgtgcattagtctgttctttcattgcaataaagaaatacctgaggctgggtaatatataaagaaaagagatttaattggctcacattctgcaggctgtacaggaagtgtggcgtgggcctctacttctggtgaaggcctcaggaagcttacaataatggtgggaggcaaaaggatagtaggcgtgtcacatggcaagagtagaagccagagagagaaaaggaggagatcttagactcttaaacaaccagatcctaagtgaactgagcaagaactcactcatcaccaaggggactgcactaagccattcatgagggattcaccatgatccagtacctcccaccaggccccatctccaggaccaaagatcacatttcaacatgagatttagaaggggcacacatccagaccatatcactttgttattgtttttatttggaaataaaatatagtttaaagacatatgtatgcataccaagttgacaagggctattctgacttgtgggacttaattttggatgtcaacttgagtggattaaggaatacctaaaaacctggtaaagcattattttgggtgtgtctgtgagggtgtttctagaggatattagtgtgtgaggttgagcagactagatgggacatgctgtcagtgttggagagcaccatctaattggctgggcctggagagaatgaatacagaaggtgaattgtctttctttgagacattcttctgctgccttggaaattagagctctggactgactcactaggctttggactccaggacttacaccagtggtaacctgggtcctcaggctttcagagccctctgactgagagttacaccattggcttccctggttctgaggccttgggacttggactgagccatactatcggcatcccagggtctccagcttgcagatagcctgtcatgggacttctcagccaccataattgcataagtcaattctgctaataagtccactatatctatatacatgtcatattggttctgtctctctgaagagccctaattcagatttggtactgggaaagctgaatatcatttcttcttactgtattccttacaacataatggaagagagctgtgaaattgttctcttgcaaaaaggctgtgataagtgaaggagtctacttaatggtaaagataaaagcttaaaagtgaattattattggtgctatgaaagcagaaaatcacttaattgaaatggcagagcaataaccagactgtcaagtggacagcatctacttacaaaatttgtcgatcacaaccactctgctaatctatatgccgtggtttaaagatcacagaagaggagaaaatgcaggtgaaaaaatacaagaaatctcccctgccaagttatttaatcatatattaattctactcctccacacataatgccaatttgatgtgctatgtatttcatctttgcatcatttccagtactgagatatatattgtacgaagatttttagagttttaatttatcttatacatttttgcgaaattgactccacaaaagtgagttaacacaatgttgacttcgtgtgtaagcactgtgcatgtacataaaaaacactgaaacttaataaatgaaaagatgtcttttttgtacatcggcatttgtgaaatacatttcttgatatcctggctttattggcaactgcatatggagtggtgacacaataaagtttttggtcaatgtcatcaagattttggttgtctgtcctggtatttcagatgaacacagttataaagctgggtgcacacaattaccaaccgtagtaatatgtatttatacatttcactttttaacttttttatcactatggtttgtctgctcgtaactgttatacccttatgactgttgttagtatacctgaatgtttatgcttgcaaaatatgtatgttattattgcctattttatggttaatgtagcctataaagtgttctgttgtgtttgcatattattctcaaatatctccctttaaaaatgtaaatatgtgtctttcaaataattttttaaaaatgtccagaattatatttttgaaattttgatcttttgggacttcagcatttgggattatggtgtttggaattatatcttttgtgactctggcccaaaccccatgaaaatgtgtgtgtgtgtgtgtggtgtattcatatcagggaaacgacacactagaaagtgtgaatttaagcttatgttcaaaatttcaactaccacctacgcattttataactctgaaatgtttatattcaaaacagtccatgccctctcctgagacccacacatatttcctagaggcagcactattgtggataagagcagggattttgaagtaagatagttctaaccgtgtcatatcccagctgtgtaaccttgtgtgagttactcacctctttgtgcttcactcagtttcatttcataagttttataaaaattaagagagttaatatatataaaatgctcacatcagtgtctggtaatagtgctatataaatgatcacatttatcattattaatatcatatcttactgtctattgcacatctccatcatcaggatgtctcacaaacaacgaaacttagtgtgttctcaaattaactttatcttctcgtctctacctctctcccaatcacctcctcttctgtatactatatgtatactcttggccaagtcagttatcttggtttccttcaaacattcatcactcccaattcctagggggtcagttattcttcatatactcatcaaaagcacttgtcttcccagctgctagtgctcgaggcagactggataccgtatccaggaggcatcatcatgatatcttcctgatgaccactacttccagaaagaaggcccttctcatctaccctttactctgtcaataggaagtctttcttaaatagtaaacagaaatatacaatcctgccactcacatacttagaaatcattctgtggatctccattctttacagaacatttgaacttcgtgacatggaatacaaggcactcatagtcacccctgtaattacttcatcagcagcctcttgcttttgctcccatctccagctggaccttgttaactcccttcacaccccatttttaccactcccaaacccttgccctaagcaatattgacctgacttctacccagcctccacctcaaaaagagttagcactcctctctgcgttttcttggcagtctctccaaaatgacttttgtcatattattttgttatttttatttatatattgatatttttttctcattttgactattagctctttgaaggcaagactataccgtattatttttgtttcctgatacttaaagtagagcctgctatacagtaggtgttcagttaatatcttttcaattagtgaagaaagtagtctgaggtaagtcagggaattgactgctgacgactaacacatcatcacctgcccattatttcctattgagtggacccagtcaactcatgcttttattttccagattcattgaggcgagtataatcaattcaaagtgacaggtaattcctacatacttatttatatttgtatgcttttttcctaccttctgatattttaaggatccacttatgaaataataaatttacattatcagaagaaacttgctatgaatagaagcttaatagtggattaaaggcagagttgttctgaaattttactttgcccttattagcttttgaccttaggataggtgtaccttctaagatacatctgaaaatttgacataatagtaatactttatttcatgattgttgtaagaagtaggataatgtatttgcagtacttagtacaatgttagacatgaaagtaagtatattgtaagtattagcaatcgttattatttgttcaactatagtagaagtatcctccccaattagaaagaaatgatacaaaattgctggtcaaactaagctatatatttttttctttatcatcatgaaaatggttaaatttggggcattttgaggacctattgcatgtctgatgctgtgcaagacttggaaaacatatagctatttacttatgagaataaattctttagtcaattagctcatagtctatggtttcaaaaatgttcatctttagaatacatattagaagcaaaagaaaataggaacctagctcaaatgtaaatcaaactgatgtatcagtagaacaaatcaccaatcaacagatacctgttgggtatcatgctatgcagaactcacaggaagaagtttcatgccattcagttaattattagagagagaaactggtagtaatcaaggtgggaaactgggggaagcaaatatagaccaccttgtgctttatgatgtaaaggaaatgagaatgtagaatagcttcatgtgaagaaagaggaagaccatcacaatgtttaaaatattttctttgttttcaaattatttaactaaaattgtctgcatcagtggaggaagtccccaatatttaattcagtcacccattcatttgttcattcattcagtaaacacgtactaagtatctaggcaagtagaatacactgaatcacaattgggtgaatgaatgcgtcaatagctaggactgtcctcggtgttggttacagccagtggagaaatcagacaaagtgccctcagaaaaaaatatattttcaaattagtagtattgtgtgttactctcaataaactatcaactaagatttattgggtagtttagagttggtggttgtgtcagtgaagcaggttgggttctcgaggaagcagactctgagacagagtttagcgttcagaatatttattagagaaggagctgaagcaggattgggcagagggagaggtcaagatgcactgcagcattggcagaccctccgtggagctctggacgtttaatggttacccagagttgtcctaccttgggtccaaatgactgggcttttataagagtgcctgattcagccactggatattgtctgctccagaagaacataactttgagtgaagctgttctctctcctggaaacaatcccttaagggcaaatagctgactatccactgacagccctccctgaagctggggcagcaagtccttccttgacaaggaagctgctcggtataacccgtgtctaccatagtcgctttaggtttcaggagcaataacctaagaacaactcaaattggcttatataataattagctcacataactgaaaagttgagaactaagtaaactttaaatgtggtttagattagagctcacatcttgaggtttatttcttggttgatggattgattgttcctttatgaaagtctggtcatacaaccatggaacaaaaatcctgatcctttccccctttttaagatttctaacccctaaggttcccttctggtggggcatgtcatgtgcacagtaagatatttgacagaattcctgttctccacccagtaggtgcctatagcaaactggaggcttccttgtaattatctctcatcctccctgaatgttggtggtaaatattcttaacttcagtggaaggtggtcacatcataagtgccagaagcagaattcgattgtctggtggacacccatgctgattacctgttctctgcatcacactagcttcacttaagagtcatcgagaaaggcaagaatcaggctgggcacagattttcatgattgtctccagaacagaattaaggagaaggctagaagggaaattgccttggtgccagaccacaaaagccactaaaatatcactggaaacagtttggaggaaaaaaatcactagaattcctctcagggaagggtactgcttgtggtcagaagaaatacttccatgagccacctgtcaagagaaagaaccctccgataggagcttgccagagcagcccctctaggtcatgtgagcaagtaaactacagagcatgagtttggatgaatgaggcctccactgtgagctagaactaaatcattcagtggtattaccactggctgcctttcttctcagccctgaaggcagcctgttggtgccagcattgagctttcttcttaaacatatgtcaaacaggtgtgttgattggagtcccatgttaccagctgggccaaagtaattctcaccctatctctcagcccatagggcttctgcatggatgcatcgtatgtatttttttttctttttgtattctgatgatgcaataaagcttaggcttcagaacccctcaccagtatgggacccctttaaaaccttgaaaggggcccagcaatttatacacatgtgtattaattagtcttttcttattgctgtaacaaattcccacaacacacagtgggttaaaacaccaatttattctcttatagatctggaggtcagaagtctaaaaccaaagtgttggcaggcctgtgtttcttctaaaggcttctggtggggttggggaggggtttttgtttccttgctttttccagcttctagaggctggctgcctgcattcccagggttgtaactccttcttcacatcatctcaaccttttacttccatcttcggatcctcttttgtccctccgatctcctgcctccctttataaagactcttacaacttccttatgcccatctcctgataacccaggataatcttcccatttctaagtgcttaatttaatcacatctgcagtcttctgttgtagatagtgacttgtaaattttgaggattagaaagtagacatcttggggaaccattattctgcccaccacaacacaatcatatgtttaagtacaatttgtagaagacattgcatacacactcagttaaaatggccatccctaataacttctgatgtcacactttacctaaggtttggtagtgttggatagtttcaagcattcagggttctaaggagaatttggtttgagaacacatttggtttgttttcatgggacatattgatcacagtcacagcgtgtatttttaaggtgttgctggctagctggtgtagtaatggcttcccaggagtagtcctactgcctgttatgctaactcactcaacattgtgccctgaagctacagggcacaatgaagccttgatcctggaccaaggatcaaattgcaataaaatcatgtcctatggtgcctggaactcttaagtatatagggagtggaggggaatcagtgttcaaaatacctggagcctgaaaacaagtctgtagaaaatgatgggaaccattagcaggttaaaaatgtaagtgatgaatttgtttttcattgacgcctggccaaaattatccttaattaaaaaccagttttaatcaaacatgctagaagacagactggactttttttaaaaaaattgtctttatataaaatgatattaccaaatatttgtcatctggcgtaacaattaatgagtatgcagccaaaaattgtatagaaaaattatttttaagctatgccaggcagttcataataaaaatattacattcttttgcttgtttatttgttttgttttgttttgattttttgagacggagttttgctcttgttgcccaggctggagtgcaatgacatgatctcagctcaccgcaacctccgcctcctgggttcaagcagttctcctgcctcagcctcctgagtgttcttattctggtttatgtgatgtttgtggtatttgtcaatttctaatatatatataagtatatatatatcttgtggttattttatcatcctacatatttaatacctaaatatctaactcttttttctacaccaaattgtataagcttcacatctcataaaattgggatccaacactggttacacttgtatcagtcagggttcagtcagagaagctgataagctaccgatcaatctatctgtctaccaacctacctacctataaagaaacatgtattataaggaattggcttgtgtaattgtctgtagctgctgactaagcaagtctgaaatcaacagggcaggtggttaggaagggaagatccaggaagggggaagcaattgtagaccgagttgttgattggaatctctatcactgggaggagcccaggccttcgtagggcttacttgattgagttaggcccatccaggataatctccttcatttagtggcagatactccagatactcagagactttcattatatatgtacaaactccttaacagcagcacctcagtttgtgtctgattgagtcactggcagaggtgtatgcatgctaccaaatgattgctcttccctttcataagcctagtctagcccagcggacacagcaaacacccatgccaacactcagtgttattggccaaagttgtctcttcctggaacagtgagagttggaagacttctgttgtcttggaattcatactcattaccttattagctgcatgtgtattttagctagtaaaattttacaaagggaagcaggtcaataccagtagttagccacaggggctgtgaagtcaaacagcctgagttcaaagccaggtttcatcatattctatctgtgtgactttaggcacatttccaaactatgctaatttttttcttttcttttctttttttttttttgagacagagtcttactctgtcacccaggttaatctcggctcactgcaagctccacctcccaggttcacaccattctcctgcctcagcctcacgagtagctgggactacaggtgcctgccaccacgcccaaactatgctatctttttttgagagtgtttatgttaaaatattttttaaaagtttaaacaagataatccatgcaaaatgcttaaaccagtatggatgacagtgcactcaaatgttagtagttaagagttaaatatcaactattttcaaccagagagcatactagatgcttttatttatactagttaatttggtctttataattagtgttgtgaagttattaaggcagaattgggtaaataagaaaaatactgtgagcattttcttcttaaagttgtagcaatatattcccgttttgttactttccataataagagtacatgtctagaatattttatatattactgaagcctgatatcatttttagtatattcttaattaagatgttttattatatgaatgttttatgaaatagaaacaatgtctcataaaaccaaatatctgcataaagttattacctatttataaatatttttattcactgatttttctgtaaggagagtaaatatgatcacaatgtttaatgtattactaaaaagaaacacatgatgtttaaaaaagttaccctgacatttttcaaactgctcttttatgcaaggcattggctgcattctatgttgggaatagagagcaaactactggaagagcaagaaacaacattataaacgggagatgctatagtactggcgcataataggtctacctggaatgttttaacatttttaatttggcctttataaatctacattgtgaacgagactctgttaagcagtatatgaatagattaatttgaaagttatcagaatgtgtaattgagaaaagcaccagtgttttgttagactagtctaggaaatttggactgtgagggacaagacactagaggcacttagaagactacagatgggtctccctaagcctgttttagaaacagtcttcaaggctagaactgagatgagtttgtgccctaggggaaggggccagtgcctctgaaatatctgacttcagttccttgctcaagaatggtgactgggaatcattcagcatggcttgtgattggacaacaaaaagcatgagcaggtactcttttatgtcaataaaatcagttgtgaccttaccagtaccctgtaggcaaaagacacaagagggtgattctccaggactggcttacttattcttaatgtgactgtgctttatgaaagaagaaaacttgtaaggcctacctgtcataattactgtggccaagatggcaagagaaatctcttatgtctctttacctagagagcttcagttaaatggagtttgatggggcacaaagtgttaaagggcaaggccgtccccacagaaggaaaactcatgtaccattaaagtctaaatgtctcaaatgagactatgtatgtgaaattaaaatcacaccattatagaactaatatgagcttattaagtataattagggaatttttgaaaccagaaaaaagaaatatcatgcatacttcagtcattcaaatacaatcactatttgattcattcctttaattttttttaatgtttatttcaattttgtaattatatcacataaaaattttgtacttttcaaagtatgatatacgataagcattttgagtgttatgctatgatatcttatgaacattatcttaatggctgcacaatattccattttatgattgcattatgtttggaactgtatacagtatggtctatatttacacttttggaaatagtctgctatatatctttttagtcgaattttcccccagtatttagcactgtacttaaaagcctagatgctagaattgaataaactcaattttaagccacttaatatttgaatgaccttggaagattatttctttttaaaatatttcagtattatcatctgaaaattaagataataatacctgctggcaggattggagtgaggttaaatgagatatgcatgaaagcaagatgcctgctacaaacttagtgcttgataaatggtaccttattattaagtgtatttcccttgggaaaagcaaaattattgtgtctaaagggtgtaaaggttttatttaatgtgtttcttgttacctactgccaaagtgtgttttcaaacacccagacaattaacagcaaacaaatcagtagacaagattttttagactctgttctgtgttatgaagtaaagtggcaaggcacattagaaggtaaccttacttgcaggagtagatggcagatataaattatttcaagtactatggtcccaaatatcaagattattatgttttgtttttgagagaacagcaaatgcaaaaggcgctggcttgagaataagcttagcaagtctgagaaacagaaaattgatctaggtggcagggacacactcagaatgagctggggtgtgacacggggatccaggctagacctggaggtgcccccaggtcatgataacagctcagatctggctcccagaatgatgtaataacactggagggtttatgcagagatgaggtgagtgttagaatcaggctgctgtctgctaataccatctcaattacttcttagctgtgtgagctgagagcaagttaactaagttctctgagggatggtttcttcatctgtaaattgatggtaataataggatctatgtccttgttttgttgtgaagacagaatgagatgcagcatgtagcaattctaaccactgtgcctggcctacagtaagaatttagtaagatttaacctcaggctcaatggcaaattttataaggtcaaattgattttgaccttataaattgattttataaggaccattgattttttttctcgaactcaaggagctcgctgccccttaatgggcattcaagtcttcatttgtagagaaagagaaaaactgtatactctcttataatggcatttctccattcctagttatcaagatttcaaaatatagtcatcccccagtatcaatggaggagtgggggattgattccaggacccctgtggataccaaaattcatagatgctcaagtctcccatataaaatggtgtaatatttgcatataacctatgcacatcctcttgtataatttaaatcatccctaaattacttatcatactaatactatgtacataatattatgtacatatttgttatactgtgttgtttcaggagtattgacaagaaaaaactatgtacatgttcaatacagacacaattgccctttttctgagtgtttttgatctgaggttggttcaccccatgcatgtggaacccactcaattcaagggttgtctgtattaaattgtaaagaccgactcaatcaggaaatttcagtacctaaataatgctttgacaaaaatgttaattttaaaatgtatgcatctgacttaaatgtgtttttatttatttttatttttaaaaatttcactcaagaagtatagaaagtgtgtttttaattaattaagaaagtctttacagggtcatttcacgtgattgagaggtaaggacactcacccaaaggcatagttataaaaaatataaatgaaactatgatatcaggaagcagtagtgcccacagaacaaacaatcacggggataatcagtaaatgtccaattccatcactaacttatagcctattttctgactcattcaattacaatgttcttgttctcaaattcaggtcaattttgctatcattccaatttaaaatgctaattttaacaaaaggaaatatgcttctctatgagcagaaatatttgaaattttttaagtagagatttttcaagtagtagatatttatgcacacacaaatgtacacacacacacacacacacacatttaatttgtcttccaaaaacataacatggcatcctactaagaaatacttacttttcctacctaattgtgagatccttattgttacttctataagttttcttacaaatcctacttgttctggccaatttttcagggtgatgacctatctcaagctgggtcaaagaccataatccttgctgcaggtgataaaaatgggaaagagaagctaacctaagctagtctgatagaggccattcttcagagttttgacctcgaaagagagggtctgacttttagctcttctctgtaggtacagatgtgaggctttagagaaatggtttccatgatcttgcttttggaagaattcaatctccaatagggagaatgagatcacttggcaaaggagaaaagcccacacaaatgatagaaagagaacacatgtctttcacagtctcaattccagttttctctgaggcctaggtaacatttctttctcatggttagaatggtttggctcactgccacttgaaactgtaggaatcaagactagttgaaattactatgccttattttcctcttttggtttctacttgccagaagattgcataactactcaacaactgccttttaaattaaagaatgagctctgtactacatttcaactattctttgaataactcttaaacatttggatatctgatatagtatgaacttgcactatctcatccaatctgagctttacctgaaagttggggctactgcctcagagggaccagatcatgtactctcttttggagtatatgaataagttgtataaaaataacagtatgaataaatattctatgcaaaatgaataaagggcctccaaataaaggaagaaattcaggagagtgacatgagactatgtaaatataaccaggaagacaacagagaataatatgttgtttgagaagaattataaaggttatttttgcctttttcttatttcaactctatttagggaataaaaaaatgcaatgaagaaataaggctactgcttgggaattgcaaatgtgagctcattttattttatcttctcttaaactatatatcataaagatatatgagagctcagaaatgcacctgggcaataaactattaggtttctgaaatgagttcaagccagggtatcaaagagcttattcaattaggacatagttactagccctcaatcagagattatggataatcaagtttgaaataaagactgttgacccattattaacaactgataaaataataaatttcagaaatatttctagtaatttctgtcaaaacatgtcatgagaatttttaaaagactagttatcactacctgaaataaattagtgagcactggaagtcagcataggcaccccaagaacccattcaattgagtttctaatcagttggtagaaactgtttcttatattctccacaatagccttttattaatacagattggaaaataaattttcaccttgtattttggggaggtaggaatttagaaagtgagtcctgtcctaccatggggaagggttttcaagtgcactgagtgaacaaaaatatgctcactctgatagattttcagtagaaagaaattattctatttttattccacataaagtttttattagaaaaggctgcttatttttatctaataggttttctgaatatattaccataattatctgatcatcccatttattttgctagatttcctgtatcagatcattcttgaaattttgcatttgatatgttgatagattcttattttttaagaactttttctatattcataagtaaaattagtctattattttgttttataccaccttcaattttgtggtattggtgtcactagattcgtaatcaaatgtgatatttgtagcatcagaattatttttcttatgagttatgtggaactcatctgtgaaataatctgtgtacatcttaaaatacttttgatctgtgtttaacttctggtcatttaattgtaattaaaaaatccgctttttattctaaatttttaactttgttaatagggattcaggtaatattcaaaatgatgtcaatctcagaagttcctctgattttgagatgatcacataatacaagtcagggatttagcaacagcccagagcttgtcatagtactaaaaggatttttcaatttgtaggactgccaaagcctaccacaagggaagtaccagtttatagaggatggggtgggaggaatattgagggaagtaaagatgagaaatggggaaggtaaagtactgatgatatttgttaagtgtctggatacagccattcctgaagcaaaaactacctcctggagtgttcatttacgtgagccaatacattctaattgttttatgccaacttgagttgaatttcttgtaaagtcaaaggatttggattaaaatattcttccctctctttctaggagaaaataaatacatattccaggcaaatgaaaaaatcaataatatagtttggctgtgcctccacccaaatctaatcttgaattataagtcccacaattcccatgtgtcatgagaggaacccagtgggaggtgactgaattaagcggcaggtctttcctgtgctgttcttgtgatagtgaatgagtcttatgagatctgatggtcttaaaaaggggagtttccttgcacaagctctctctttgcctgccctcatccatgtaatatgtgaattgctcctccttgtcttccaccacaattgtgaggcctcccatgccatgtggaactataagtccattaaacctctttttattcccagtctctggtatgtctttatcagcagcatgaaaatgaactaatacagtaaattggtaccagtagagtggggtgctgctcaaaagatacctgaaaatatggaagtgactttggaactgggtaacaggcagaggttggaacagtttggagggcacagaagaagacaggaaaatatggaaaagtttggaatttcctagagacttgttgaatggctttgacaaaaataatgatagtgatatgaacaataacttccaggctgaggtggtctcagatggagatgaggaacttgttgggaactggagcaaaggtaactcttcttatgtttttgcaaagagactggcagcattttgcccatgccctagagattcgtgaactttgaacttgagaaagatgatttagggtatctggcagaaaaaatttctaagcagcaaagcattcaataggtgacttgggtactgttaaaggcattcagttttataaaggaagcagagcctaaaagttcagaaaatttgcagcctgacaatgcaatagagaagaaaatcccattttctaaggacaaattcaagctggcttcagaaatttgcataagtaatgaggagccaaatgttaatccccaagacagtgaagaaaatgtctctagggcatgtcagacgtctctacggcagcccctcccatcacagaccagaggcctaggaggaaaaaatggtttcataggccaggccctgggtccctgtgctgcgtgccatctagggacttggtgccctgcatcccagccactccagccatgactaaaaggggcccaggtacagctccagctgtggcttcagagggtgcaagcctcaagccttggcagcttccatgtggtgttgagcctgcaggtgcacagaagtgaagaactgagcttcaggaacctccacctggatttcagaggatgtgtggaaatgcctggatgtccagacagaagtttgctgcaggggtggagctctcatagagaacatctgctagcccagtgtagaacggaaatgtggaatcaaagccctcacacagagtccctactggcgcaccgcctagtagagtatgagaagaaggccacaatcctccagaccccagaatggtagataacactgacagtttgtaccatgtgcctggaaaagccatagatactcaacaccagcccataaaggcagccaggagggaggctgtacccttaacagccatggggcaaaggtgcccgagaccatgggaacccatctcttggatcagcatgacctgatgtcaaaggagatcattttgaagctttaagatttgattgccctgctagagttaagatttgcatggggcctgtagcccctttgttttggccaatttcatccatttggaacagctgtatttacccagtgcctgtatcaccattgtatctaggaagaaactaacttgcttttgattttacaggctcctaggtggaagggccttgccttgtctttgatatgatgttggactgtggacttttgagttaatgctgaaatgagttaagactttgagaaaccgttgggaaggcatgattggttttgaaatgtgaagacatgggatttggaaggggctggggtggaattatatggtttggctgcatccccacccaaatctcatcttgaattgtaaattccacaatccccctgtgtcatgggaggaacccagtgggcgggtctttcctgtgctgttctcgtgagagtgaatgagtctcataagatctgatgtttttaaaaagggtagtttccctacacaagctctctctttgcctaactccatccatgtaagacgtgacttgcttctccttgccttctgccatgattctgagtcctccccagccatgtggaattgtaaatccattaaacctctttttcttcccagtctcaggtatgtcttcatcagcagcatgaaaatggactaatacaatcagttataaagaacctctcttatgtacataagaaaaatattgtcaaataatacaaccagttagatccaaatgatttctgataatatgactgtgacatttacagaaatttttattcaaagattcttaagagaaatttttgtataaattaaaatattgtagctagtagagtgatgttataccagaactattgttaaaaaataatagaggcttaattaagcatacatgcaaactgaaagggtggataaaattcagtattagtgggtggacatacaggagagagaaggatgctgagagagtccctgggaataggagggatttacaattaaagcactgctgggggaatgaacctcagggcaatggggagaagaacacaggggtggcccacataggcaagtatatagtgtcatatgccagtgagaatggcgctgtctaatggcttcaatattcggtgacataatctgcagggtcagagcatatatgtggagactgaagttgagggagaatggaggatatctgaaacagtgatgatgatgttcccttgatgttgctttccctgtcataatggtcagtaatcaatcctattgtgtaatgctcttcaataaacttaactgctgtagggcaggtacaggaaaagcaggttcttgggatcatccagacctggagaaattcagaagtggagggaaagtataaaagcctagaggtaaggaattctagatttttggcagaagggtaattcgttgaataatgggtcatggtatgtcagtaaatgaggaaagtgaagaaagaaggttgacatttttttttcaaatgtagatgtttctgatagctgtaagatataaaatcacttacaaaaattacacattttttaacagccttaattacaatcttatttagagcaacctgtgttttgattaggtattgtttagagaaagataatttaacgagatcgtttattcttgagtaagatttctgaaataattgaaaggaagaggaagataaaaccttgtggtgcctggtgatatagcactttatgttctgctcaagttcaaaagataacttttttaaagttctgaatttgaaaatatgatttcaaaatacttaaaaaatttctgtctttgcaattacatttaaaatgttgcttcttcctaactgtatatttttgaataaaagatgttatattagcttccccaaggttctctctttcttaagctaatcagtgggattcaagtgaaattaggtgaataaacaattaaaactacttaactgtatcaatataaataaaaatacctaaagtgctattcaccttaaaagtatttccagaaaaaccgcaagggtttttatcatatgacctctaattgaattattgtgctcactcttattcaggttaaccagttgaaaattttcttagaaccactttgtattaaaatatttctgtaatacataaataaggctaataagagcaatactgtaaaggcattactctaattaaaaaattctatggctactgagagttaagaagacataattttatcaattaacgttaaatgtttacgaacttagtaatgggatagtgagctccatttggaattccttcctgtctaaatatttaccattattaaggtgaatctcagtgtgatgactaactttttcagacttgctcagtaatttacaatatattattgcatcaatgacttgagcactgcgggaaatcaagtttaatcagtatattttgtgctaggaaaaacaaatgctaagctttatctccctttagcatagcatgtgcttactagaaatgctcaattaagaactttgaaaattgttggtcatgcttctaatttgatgcagcctctaaagaccagtatgcaagagtctttgaaattaatatattgctgagaaaataaaattcttcttcatttgggctaggaaaatgtgttttatttgttttcctaccattctttaccagaggaaggttttcctttcccttcaatattacctaaatattttgcaatcagataaataaaatgataaaatgagatgttagggcaatataaaaaaaacacaatattgcaatttgtctaacacgatttttttttttttttgcagtttgttacctctcttacatattttctaactaagatttttctattgcctctaaaagtatgtccagtattattttctcctctgtaagggattaaaataacaatttaagaagaaggaattagggagtctgagaaatacaattggtctttctaacctcccttcttctttcttccaccatttactcaaaatatttcaaactttcaaaccatgatattataagatatataaaggcctactttattcattcaggtagattaaaggagatggagtatggggccaattgtttattacggaaattctgacgtagtagttgtagttcttgttactctttttccatgcttttatacttctaatttttaaaatccataactctttcagctttgaatggctcaaaatgtacctgccacttttgcttttaagtatatcaaattcccagtgatttgtcaagatatgtgtatccatttagcaacaaataaatttcatagaggccacaaaatatagaggcaccatttgtgaatgagggataagataacatgaggttcttgcagttgttctagaacatggctattagatgttctaaccacagctgaagcattaaatattacatggtcatttttttttctacccaggggcagcctctaggctaaatgttttttattttgacatttcctttgcagttctatgtttagcaagtaaaaagtaaaacataagatagtttggcaagtgtcacaaattaataagtaaaataccattaaataaagacctgatttgaatacagagtccttcactcttaggcaggtaaccctttggtaaatttttcaatatctggaaacttgacttatttactcaacacctgttaaacacttactctctgcaaaattctcttatgggtgatatagatactgcagtgaatctgcctttatgaagctcacattccagttggggcagacaggcattaaaaagggtgaaaaatacatgaaatttagataataagtgtaagtcaaaaaacaaaaacaaaaacaacataggagacaagaactaatataggaggactaatattttagatagtgtgtgccagaaaggcccttctcagaggtgacttttgcgtaaacatgacttgccgatatccaggggaaaagctttccaaataaaggaaatagatgtccaacaactctgagatgagatcaatactggtatattcagggagcagcaagaggcccatgtggccagtacactatgaagagtattaggagataaaaagaggaaaatagagaatcatcagggaactggattatggagcaccttggaggttatgagaaaccatgaaggctttgagctttggcatgacaggataacttacatttttattttttttttagaatgacacaacctactagaatgaaaatagagtgaaggtaggctagtcctgaaataaggaaactgattagaaggcattgcaataatcaaggataaagatggtgccttggaccagggcagtggtggtggtgacaggtaatcaaagattgggtctaatttgaagaaacctcaatcaaatcctactgaagttaattagatttgcaagactattgtgtttttgagagaatgagaaaaatcacatagcttcagtctcttcaccttaaaaaaaaaaaagtatatcatttgctcatttgccttgtgggttgttgtagaaacatattataaaaattaaataaatggtagttattatttgagctatttgcactagttatatttagactatgccaaagactgaacatgccattttataacatagcttttaggaagtaatacttccgttctgagagcaggaaaacctctaattagctctttatgctcaagaaacatttcttcttctatatttatatgattttgattagtaaaggttatgatctgtagagatccaagtgactcttcataattgagccttttatccatggaaggcgtctcatccagtcactttccatttggttgaacatcttgaggaagagtccctttcactggtgaacatagtgaactattcagttctgcctcagcatgctcaatctagaaatcccaaggaataggaggtgacatcgaccatgaagagctgccttattcttataaattttaagtgcattttgtagcaagttaaagcagggtgttttgatgctttttgtcataataaggaattccccacacatcccctacatttttaggaaaaagtgtctaagtcctaaatatgtgctaaaatccatctacagaaatctatcaacaactaaatgaatagataattttctccacactgaaatgtgaaaagcttgatgcattccaaatatttttgcttgatatatacaatttgataaggagaatctacagttgctattacaaagctaggctttcagagataaagaagagttaaccgagggatgttggagcaatagagatgaattgggctttgctatcctgtatctaatagagccaagattgctccttagattgagaaaaaaagtcagccttcttcagggacactagacagctcagggctagaaatttgaaacttattcagtgccaggaatatagaaaataataattagaattgaaggcagaactgagtttaattagatattaggcagggtaagtactgaacagggtcaggtgttcttcagaaataactctggatctctccaattagatatactaccctgccccccaaccaggtgctctcataacttgatgtacttgtcctttttagagtaacaaatttacatttattttgttatttgatcaatattgcttacttccaatccattctaggtctataatttcccctaaggctggtttagatccccattatgaactaagaataagcacaatacatggcacatataactcaatcacttatggaagaaagtgaggaagagataaaaaagaaaaacaggtcatcaacatttaagcaaattaaatgaagaccatcctgagatatagctggggattcacataatctctaacatagacatctttggaaaatggacttttcttacaccccttcactattttaaaatctaactgctctcattctttactccttcccatgtctattgaccaaattgttcatcttgttgtatttgggtgttatagatcatgttgtcaatgacctatgaaaagcaaatgaccttattttcaactttctatactttagtttcttctctgaaatatcccttttgtctgaaactcttcctttcttcaaatccaagggaacatcttcacttcctttcaatttcataaatttacctaaattatttccaggtttcctggaaactctaatattcacccattctcataattatttttgataggatatgaagtaaatgtcagtttatttttctgcttataattttgcaacttaagttatatcaatagtttaagaattatacaacacttatctaccaaaatattacccaactttgtgtgaagaacattggtaaaagcttcctacagattattaataaatgccaactaataatattacgctgatgaaagggaacaaatgccaaatgacaactcaacagccatcctaaattatattaaaatttgaatataaatagatgttcaaatgcaaaatagataatttttatccgcatatatttactggttaggcttttttgaaattacaattataaagtaggcaaacttggttataagcatttcttatctgatatattagtgtttttttattatttttcttacaagcacctattatagtaatgttctctattttccatttaaatttaaattggatttaaattttccatttaaatccaaaattcaaagcaaaacaaaatacttttaatataaattacactaaggagtagaaaattatattacacagtttgttgcatcacccacatatagtaaaaataataaaactagtaactcttcttctttgaaatgccatctatcactaggttgcagatgaggtagaggtggacttattcctgatttcaaaatcttaccattattctccttcttattaaactaacttttatgactgatataagtggttaaacacaaaataaatcaccagctcatttgtagctatcatttgcatggtacccagggaatcccacactattcaatggaagacatgtgtagcgatctaaataagtgtaaaaatggtaattcttctggggtgcaaaggaaatgagtgacctaaagagaatttttgtttttctactatattacttgtagttgacaattcttttaatatttgatatgtagataattacatattattggcactttgaagattgatttttactattaacagaaaaattattttaataataatctgtgttttgttcatgtaatattattttgagtaaaggatttccaagggcattttatttttgtaaatgtcctttgaagttttgtaaatgccttttgtaaatgcctcttgaaataaagatcccctttacagcaaagaagactttaaagaagaaactatgttttgactgccacaaaatttgaaattctgctaattaacctagaaacagaaaatatagcttactgttatggaatctatttttacacacacatacctacacagtataatattacaagatttttggaatgactatgtgcaattatttggactttctgaaatatcatgagctctacaagaaacaatacatgtttataatcatatctgttaataatttctgttcctttctccaaatgcactctcttggttctgggtttctgatcatttgggggaatgtctataatgttagtggctcagcaggatcataaataaataaaagactaaggcaagaataaatggcattgattattattgtacattcctaataattttataatatatattcagaaacacatgtgtttgaggatgtacctaactttatatgtctgaataatacttactcatactcaagcaatattccaagtgtagcaaaaccgttacactttggaaagaactgaaaccaatataaaaacaaaatttcatataacttaagtacaataataaaagtgaaacatattgagaccgttaaactttgaagatttttttttcagaaattaaaagctataacctatggattaagtttatacctgaaaaagagtgtatttcttctatttgtctttgtgttgcatcctaaaggattggacgatataaccaaatggctccaaatatacttcagatatgagtaggacccatttaatgatgcctgaggcctggagtcaatataacactgtgattttagccacatgattgtttcttcattgggttaatttacaaagcctcatcagaacagtcaaagaaatggcagaagctggggatagatggaataggacaaagatatctagacaggatgtaggtctggcaagtcttgatgagctgtcaagctatctaaatcactctgatcaaaatctgggtggacacacaaagaagcttgatctataggcagagcacagcagatggattttctcaactgtagcaatgccctgagttatgtgaggagtatgattctaggagatttgcacagccagtgagaatctgttgccagtctcagggagtgggagtgggaagcagaatcttagaatccttagaatcttagaatcagcaagctgattgaatttcaagagaaagctcaaatcctaggaggaccaaccatagtgaagtcaagatactgaaagagaggttaaatggtacagtgtaaaccatactataggtttaagcagaagtctacagaaaataactctcaccccaggcacattggataccagattatatcagatttttcaggtattggctgctaataatatttcccactgtggcaagtgtttacagtggtaagcatggaaaattggtttcagtgacaccagcaaatcagcttattccattagtattagaactctaaacaattatatttatacttccagatctgacttagatttttgtatcaacaaggtcaggtatgaaggatacattgctgacactgatttcttaatgtctataaatgtcttcaaatgtttagataacaatagtaatacacacacacacatatttaactacctacatagatataaaacaaaccatcttctttaaaacaaatgagttctctaaaataattactatttatatgatttctatttttcacatttttgttctattcggactggatttttacttcttcaataaaatgttatttattactggtttctaataagtaaaaatactatggtgaaaaactgcagcatgacaatttctataaataatcatttataaaataatattactgaaagaaaaagacaaatatggactttgaaaaattgccctgtagctctttttatttcaaggggacagactgtttctgtacatggtttcattttccttgaactttctttaggttaatctttccaaatcaagtaaccctgttcagcattcattctgtaagtttagaatatgctcgccaaatcaaagctcttttgaaaaatcgaagctgcctttgttggggaacattcataaattgacatgttttctatgtttgagattttctactttcttccctttcacctgcacacttcaagatttattacagattgtcagaagaaatgattgccttcctagttttatagaactccaaataagaaatctaatttgttgtttctcttggatccctggttaaagtttctgaatagtttggggcagaactctttttcctccataagtaagcctgttttagtagttgaaaaatgttcttggagttgatgaattgaagtacaattttttttctgcttttaattgctccccaagtctgctatgttcactctgcaagagtgagtattaatccatggaaccgtggttaattgtgaggtgggtaaattcaatgatgtttggatatttcacttggatgcatgaacactctatatgccactcaaatgacctcattccatatgccttacaagtgtctctgtgacactctgcaggattttttgtctatgtgcaaaggaggcacacagctgttaattgacaaggtaagtaattgtcttctgattacagtagttaaaggctgttctctaatggattttacttgtcacttttaattctttttaatctttgtctgcatttcattagaatggctttatcatttggattgccctcctgttggttattctgataagatttaatgggttatcttccaactatgacaatccctcaaaaatataatagagtgatatttagattcttccgggatttttaaaacacgattgcttttccaacccattttttctcttttacacttcacatttttgcaaatcaagtattttgcattttctacatgccctgagcaagtttctgctttaatcttccatgacttaatctattgactaaataggagatagttggtgaggcagttaggaaagagcctgttatcattttctattctgcttacctgctgtgattttatttatttatttatttaatttacaagcaataggctttaactgcagttttctaagagatgattcaggtactgacaaaaatatttgtaaaccttttaggatctggggataacagaaaagtaaacttgtaaaaatggttcattatgcatttcgtgatgcagaaatgtaatgttaagtcatcatttattctataatagagcatttttaggttttgcatatgttcccctacctatgaaaatgacaatttacatacaaatgcatatctttaatcatatctcactcctctatagctagtgcatttaccaaacagctctttataaggtgtactgtaattactgaattatgcagtcaaggtgtctggttagtggaaataatttattgatgtaataacaactattaaaaataaaaactgcaaacatttgtgggaaagagacaagatagaatatctggcctttttaatgtttaataaattgggataaattgtcctaccttggtttcaaatacaattgagtcatttaacaatcatatttggcaaaggttgtatgatgctgaaccatgcagcagatggtggaattacagaatgcaaaattttatgggatgccttttcagagtttgctaaagtgagatctagtgcatggtttttataataaattaattcttcctagaagcttgtgtgtaagtaatttgacaaaacagttataataaaaatttgtctttgtataaaattgaatctatacctaatgctaaatgatgagttaatgggtgcagcacaccaacatggcacatgtatacatatgtaacaaacctgcacgttgtgcacatgtaccctaaaacttaaagtataatgataataaaaaaaaattgtagtgccaaaaggcaaaaaataaataaataaaatacataataactttttttaaattcaaaaaaaaaaaaaaagaaaggaagcacaattttcgaaggactcagtgcactcattggtttttaagatgtaccagtgaagtggtaagtcaaaattggtgtatatttggaagcttaaatgaatttcatttttggtaacgtaactaagagttttaaagcataagtatgaaaataagtaagacaaacagtgatcattttcaattcttgatttgcccttgtttaaattgtagctgcccaaaatggttgtgtgactctaacctcaactatcatatattttctgattataaaaaaaaagggtccaaatgttaagtactaaatgtgcttatgagatattataatgcttcaaagtcccagaagtgacctcaaatcatttgagtaattatgtagaaaaggaatacataaatattaacattaataacacataaatacaacatcaaaatacactaagtaaatattacagttatttaaatatgcaagtgctttgcaaatttaactagttttgatatctctttaaatgatttttattcatagattcaccagaaaatcatatatttgattctatatgttagtgtctgttgaactttacatattaaactaaaattttgttaaaatgtggaacccattggtagaagacattgactctcaagtatttcatttatgtttatcttctgtgtgacacataaaactagtaattctactttctactttctttcttttcccaaatctttcattgctttcttctactttcctaccgtaagaaatatatgtactatgtactgggcagagtcctctcttcttggccaaagctaaattacaagaggttatacaggaaatgtccatgttcaattagaaaatctctggaaataaagatctctcaacaaaatcatggtagtgttatgtgcttatatatataagcttacacatatatgtatataaatatatatatatattaatttatttcgtttccaccataactcttcaagagagtatatttgattttacagacaagaaaattaatttgcccaggatcacacagtttctaacagaaagaaccacaaacccaacccagtctggctgaatcaagaattgttcctctcagtgttctgttctgattctctattaagtttatagtttcatgattattactgttaaaccttgagaaataaggccaaactgaaaggtggaaatatctagaagcaagaactgaccctcagataaacactaaaagggaaatgacatgtaaataaattcccatttatgaaaacctagaaaacaaaggcaaggtggatataggagctgagaatgagatctggaacccttaaaaagtctagaatatggtagccacttgaaatctataacaagttattgcttatttgtgacatgctttttctcacttttgaaaatgctttgtaattaattttcaaaaagagcaaagcaatgtattgtgagtcagatctatgagtaaaggccccatgtaataaggactggattcagtttattcatcgccctaggtccttgcacttgccttgccttgctctctagccagaatatccctggtactaacttctatcactcctgcatcctagataagagtcacagctgctgtctctgatgttgctcttgtttgggagcaaaccccctgtcatgctccatgtcctctacctctgggcttccttgttgcctcagaccacctctgcacagtatggacatgctgagagttaacaccttgtggaggcaaacattgaacaatgtgaaatgggaggcagttgatgttttcttccttcttcttcccctagctagattttcaaaggtgtagcagctacataaagcctctctaaagactgaacagtcgtcctgctacagaaccatggccagcccagcaaggctctccttctttatatttgctattccacctcccttgccacattcccctttgctctcatttctctccatgtgctcctgggtaaggtgttatcacataagcctttttttcctttttttttcttttttttttttttcctagggagtctaaggagagctaaagtatagcatactagcttaaatgtagtttaatttctatgaagattacatgcagttcccttcaaaagttttccttaataactactttttattgatttttatatgattaactctatttctcagctcattgctaattcttgaacaaggaattcttcagtgttaaaattaccattctcttgatgtaacaagacataatacttcattatgttgtatttgttacctaaaaatgtgctgtgctcagatacagatggctatgttttcggaaaaattttttttcccatttctctgaataggtatatatagaatcacatgtgtaagtatataatgtttatatgtatatattaacctttggcagcaaatgttgtcttaacaatttcttaatagcctcctctgtaaaatggaaatgagtggtaatttaactcaaccactttaaaatgcttcataagaggtagagaaaaaaaatttttttttgcacccacacataccaatacaaatgcacacacatacccaaacacaccaatcacaaaagcagaaacaacatcaaacaaaacatctaaatatattaaaatttaaatattgaaatataattaaaatgaaattaaatttatttttaagtcaaagttattttagtttgatacttgcctgaaatgtgcaggtggcaagtacatatttaaaatgcaggtgttgtattttctgctaactttacttttgaaagactttcaacatatcatttcttatggaaaattatactcaataattctcagctacacagcattgacttagaatggattgtaggctgtgctaactgatatataaggtgaagaacccaaagatctatgtgtttgaattgtttaaagagaaaaaaatagcctaagattttttctcaaattttaaaagtagttgttacatttacggacagtaaaataaatagatctggccattacaactgtgaaacacaataggaaaataagcacaaaggatattcttagtttccaacatctaattgcaattgggctttctcttcccatcatcattaattaataatagataacatttatgttgcatgtactgaacatttctcatcacatcctcaatatttaaatacaaagaataaaaacttcactgggataccatttttgtctgttttgtttattgctacgtctttacctcatagaaggttcctggaatgcagtagatgttcagcgaatttttgtggcctaagtaaatatgaaaattttttaaaatgctagaaaaaaatgtaagaagaaatgaaaagtttcaggatagaataagagagacttgggatgtattttcaggatgtgattagttagttcctctttatctcctaaataaatagtacaatgtttggcacaaaggaaaataatcaacatgtatttgataaaataaatgtaacccaaaatattgtatataggtatagttttagtttgttgactacttataggtatttagtagcctcatgatgattattggattataaagatgaaaaaataggaaattcagcattactaattgtctactttattgaaaaaacaattacctagctagtaatttgaggactttggactgcctagccaccagtaatacaaatacacagtttttcaatggctttcttccttttccccttcaaaaaatacaaaaatactattctggtctttaaagatttttaatttgttttggcaggctgcatacaggcacatgtatgcaagtaaaaatatacatatacccacagagagtataaaggaactgaaaatatttaaaaagctattaataaagactgatacagactataccaaatgcaaaaatgctgagaactgcacacgtaattaaaaataaaggggtgatcagaatcaggcaataagtaacacattttgaggaaagtttggacgtaagtattgagtatgtggatgagctttccatacataatgcttcgtctaaatttatctttcctgttttcttcttccaaaatttacttcattttttatcagtaaatttaatgatagcttttgtcattgaataatatgaaagattggctttagcaaaccacagcatatctaaaaattcatgagtttagggatgctaattatctcaggataataatgccagctaggaaaaaaaaaaaagtaaagtctttcaaattaagtgacttagatgtaaattagatgtaaatcacacatcattttaaagagagaaaaacaatttcctttcaaacatggtgagacctagccaagtcagcaacagaaacaaatatgtagtaacaggtggcaaaaagtttattattttacaatatttctctattagatttgcctcaatttcttgggttgagtattttcagagctttgaatgaatactggaatttaaacaagttttctcggtaaaagtcgaaagtagataactagcctcaggaaagctaaaagtgtgtgcaaaagggaatgaaagcatgatatggtggtcttggtcataatcaaaagcaaataaacaagcatttgattcctgaggattttaaatttttcaaggatagacaatacatcccacaaagagcacaaataaaacatacttttatctttccactttcccttgtgtggctcattctccctctcactgtaaccacctacaaggattcagtgcctttctatggcacttcatactgagggcttccctcctggggttttggtgaatgagtgatactatgagtttcagaggttttcttctctccttgtctccatcaacatgtgcctattcagagtcttgttttacctccttgagaaggcagtagccgtgtaagttaaggggaattcttatgcacagtttttttttattctttatatttacttatatattcaagcatttatttacatctgttaataaatgtatctcatgtgtcttagtttgtgtaggctattataacaaaacactgtagattaagtgccatataaacaacaaacatttatttcccattgttctggaggctgagaaatccaaaatcaaggggccaaaacatgtggtgtctggtgagggcccttttcctggttattagatggtgccttttagctgtatcctcacatggtgaaataaacaaaggatttctcgggggtctctctacgggcagtaatcccatatgtgggctctaccttcattactaatcacctcccaaagtccctaccttctaaaagcattgctttaggcttaacatttcaacatatgaattttgggggaacacacattcagacgatagcatcgtggacacttacgttatactttggattttactctaacattgatttcttttcttttctgttttttttttttttttttttttgagatggagtctcactctcttgcccaggctggagtacagtagtgccatcttggctcactgcaagctccgcctcccgagttcaagtgattctcctgcctcagcctcccgagcaactgggactacaggcacgtgccaccatgcccagctaatttgtgcatttttagcagagacagtgtttcaccatattggccaggatgatctcgaaatcctgaccttgtgatccacccgccttggcctcccaaagtgcgttgatttattttcttcctcaaactgtaccagctttggctattggaaacttttgcaattgtctcctcagctcctttgacatattcccattattgtgattatgattatttttgaacacttctttacttgctcacaccaaaagatggtacagttcatcttatacatttttaaagagtcctggttccttttattggagggtagtattagaaaccaagatctgggtgctagatgtattcattgttactgaggtattgttgcttctaggccctttttcctgaaagagcaagggaatatttatgtatatactaaatcatacatatacatatattcataaatctgtatatatgtaaccatttgtatttgtatgaaaataaaaatgagttcatattgctatttccattgctaatccattactgcatggattgttccagctatctcccttaacttatttgtagcctcccactctaactctgagaaaactggctctaaccatcttccacttatttatctaactgttaaattctagtatacataaatgatgcttttaaaactgctacctgtacctctgtgggaaacaccttatcaattagagtatagtgctgtgtatactaccttgtgccttttgtcttgatgaaacttccatttccaaagttatttaggtaacttttcccttttcctctacccttttcagtgaggttgtttcataattcctcatacagtgagattcttttgtcaaattcagcattccatgctgggatccccccaaaacttctaaaggagttttaaaaaatttgtatacatcaaggttcactctttgtgttttaaagttctaggtatatcaacaaatgtaaagtttcatgaattgaccactatggtgtcagacagaatagttctgttaccctaaaaatgttctatgtgtatgtgtgcacacacacattgccctgtttgtacgattatcttaaagactaacattggtaaactcgactctgtctttggccaagaaaacgttcaatctgcagacttctatgcattgaagtccatgtgtctgaaggaactgccaaattattttgcaggtttccttggggaggacccccttcaacaggtatagaaaggtccaattatccaaggttggtcatttactagttcagatactgaaacatattttagctcaggcattcaagcaaatgaccacaatttacctggaagtgagttagaactttgagaaaccactcaaattgttgtgggatagctcccttcactactgattggcagcttaccctgagttcacagggctcagaagcccaccaggataggtgacctactgttagctagttaaatgtctttaggcaataattccatatacaaatagaaagattttagtcaaagaccttacaaacactttatactattgtcaaacatttgggaggacagaaaaatgaagatgcggctaatatttattgcaagctattgaattgtagatatcattctaggccatttaggtcacatgttcattctaaaagttctaaaaatctcaagtaacaaagattttactttgttgaaccaatgtcacgatgcctgtataaatcattatctcccttcttctgaatcagtactgtgactttgttttcaaatgtttatttaacctctgtatgtgtgtgtgtatatatacatttactttctttaaaatatgccatatcaggaactctttccagttgtctttttgaggtttcctaaatgctgagaaagtctacctttcttacgcctactaaacattgaattgtctgctctttcctgtttgagtcatatgaaattgcctccactgctgtccataaaacaaatattggagaagatatgggtacactcacttttttaaaaaaaaatcctggaattttaatacgttagtcgctgagatgcagtagttttcctaccctgattgatggaaactcttctcctttgctacagtgtgtttctgatgaaaaccaaagagttgtttatacatttttttttcagtttgtagactttttcaaaacaaaaatgatgattaattttcagttaaattctttattttgcttatgcaagtattgataaacctattcacattaaaaagtcattacatatggaaatagacctaaaaagaatagttgccttaccgtgtcaggatttgattcaattaaaactgattgagtaactttggaggggaacagcagaaaatcatatttgttttaaagttgagtccctagcaatatctatcatggtcttcatttattttcaataaatacgaaagttaaaatgtaagtattacccccaagaatatgaacatgaaaactcttataatgtgctcttcttgtgatacaatgtttttgctatggtttgaatgtttttgttgcctccaaaattcatgttgaaacttcatccccaatgaaatagtagtaggaagtgtggcttttgggaggtgatagaagcatgagccctccaccttcattaatgagactaaatgcccttataaagggatttgatggagaggctttgtcttttttgcccattccaccgtgtgaggacacagcatttcttccctctggaggatgcggtcacaaaatgccatcttggaagcagagagcagcccttgccagacacacaacctgccagtgacttgaccttagacttcccagcctctagaactgtgagaaataaacatttatttttttgtaaattacccagtctgtggtaatcagttgtagtacacaaactaagacagtgttgtattttatgtaactgtgcaagagacaattataacaaaatgagagcatacattgataagatacatctgaaccttgtctggcatttggattagtgattatgtagtcatgcacaagtctaaaacataacacaggtcagtgtaaatcatcagtatgtttaataataaatttgtgaaggtatacatatatgcaatgggaacacaggaaaaactctgttactagtttagcgtaaaactaaattatcagataattgcaaaaattaacaaatgagaatcccaacaagtcaaaatttggtataaaatatttgcatttacatttgtttcctgttaagtttttaaactctttaaaaatagatacaaaaatatttttagttaaacctttgccactcccctagaacttctctatagaactcatcaacagtgcatctctatagaactgagtttgaaaatcaactcacgcctgtaatcccagccctttggcaggccaaggcaggcggatcacgaggtcaggagatcgagaccatcttggctaacatggtgaaaccccgtctctactaaaaatataaaaaaaaaattagccgggcatggtggcgggtgcctgtagtcccagctactcgggaggctgaggcaggagaatggcgtgaacccaggaggcggagcttgcagtgagtggagatcacgccactgcactccagcctgggtgacagagccagactccatttaaaaaaaaaaaaaaaaaagaaaatcagtacctcagcagatgagaaatggatcaatctatggtgtgactagacaagttaatgttaaaactgaacactgtgatgatgcatggcagctctgacaatacaagtaggatcagaatgtaagtgtggaaattcagtgtcactagggaagaatgggctgagagaaagtttaataggtagagaataatcataaaggaaagagttgccccaggactggaggggaaccaggtggaagagttgatcccgagactgatgtgactgatgattcttatcaaatgctcctctttgctggccttgcttagagccttctttggttgtttttagtggttgctttcgactcaaaagtgatctgtttattgtagtgtgagagatcatatatttgcagtcattgctgtccacgttattacttggatagatgtttttcccagttcctgattttacgataatccagttcaaagtgatatgcatgatatttcaaaaacagatgtcataatcttttctttgttttttaaatcattagattgtctaactcattgatatttttgaacatgggctttctgttgcactcctcatcgaagtaattttcattatgtgttgttttttctaagtttatttatttttattgcaagtggccaaatgataggccctttctagggaactatgtctacacaaaataaaataaggttaaaattatgcaatgaaactggcacttcggtgagctgtaaaccttctctgtagacattgtccttagatcatcctcacacctgtaatgttgaattattccctccctaggtttcattcctagcatttctgatccttaatctctgcttatccagaaagtcattttcagttccagggctaacttcctgaaatcctcacagattgattcaggctaaatcctgtattcaggttcatgttgaatccccaacgaaaattaatgggatacgtgcagctgcatctctggacagaccacacctcatcttgctttctgcaatccccgtccctcacttgcctaaagtgctttgagaactgttgtgactacttcagaatgaactatgtttctgtgactctttcttgctggctcatttcacaggaagcccgaatttacttgtacatggctcacagatcaatttctgcagtgtggatgtttgtaatatacataaatgtgttggatgaaggcattgaaataaaatttttgagtctgcaaattaagctggaattgaaatcagagaaaataatgaaaggcaatgaaaactgattcaaggagaagttttgagtaagagtgccaacaggcaccaaatcattttaaatgaaggcaaatattaaataatttaagagcgaagaaccaagctggagactatttcttaaatagaataatgaatcagcagttcaatcattatatggtttgaaagttattatggaaaaatcactaaagctatcaactcaaataaaacctaacaagaaattaatagaaatataataatagtgtgtattttgaaagtgatgaaatacctatcaaaacattaaaaaattataatacaggactctgattatgttactgtagaaatattctcatttgcttaaatttgtgagagggtttcttgagttggaaagcccacaaagatgcaaactctgatttattttataatgaatcttctttctgcaaattcatttcattttcctacaaatgcatcacctgcttttttctataagctgcttgtcttagtacaattatctactttgataaggttgtgcttattatgtcatattgcttagctgtcatttacctagcaggtaaaatacatattcagaagctatataataacataataatgtttagcacattcttatcgtgcactagcttggatacagacctaagcactttacatataatttataaaatttctttaaggtaggaacaattaacattttcttttattgatggggagactaggaagttaagtaagctgtgtaaggctctacacaattagaaaaagagcctggattcaaaccctggcagtttttgcttcagaatccatgttcttaatcaccatgttatccttacaaattcagtgcaaggcaaaaagcatcatcataatttttttttttttttttgagatagagtcttgctcttttgcccaggctggagtgcagtggtatgatcttgactcactgcaacctctgcctcccggggttcaagcaattctcctacctcagtctcctgagtatcttggattgcaggtgcgtgccaccacacccagctaatttttgtatttttagtagagatggggtttcaccaacgttggtcaggctggtctgaaactcctgacctcgtgatcctcccacttcagcctcccaaagtgctgggattgcaggcgtgagccattgcgtccggcccataacaactttttttaatgaagaaactgagatgaggagtagctaaaaacaaagaaacaaacaaaaaacaatgctaaggttatagagttcttaaataactttggattcaaatttcattctaactttaaactctgtgctgctcctacatgacatttgcctcatcttatctaaaacttgtcattccttatttctttttaaatggggatgaaggagatgaattaatgactctgaactgtaaactgccaaaataaataagttaatatgcatttatttgtttataagctcaagtacctgcctaaacttcactaaattttgtatttttatacctggtcataagatgaaaatttcttactgaaaagtaggttgtgttgttttaacaagcaaactgaaatgaaatcttgaatgaaaactataattcaacagtgcagtacaattatatacgtttgaatatttatattatatatattatatattatatatatattatatatgtacctatttgaataacatatattcacacacacacacacacatacacacacaccttaaaggtggcatgggaatggaatgtttaagaaaaataaaaaggctaattttggctgtgatgatttcatccttgaggacacctccagaaggtgagattacagagctaaaacctgtggaacttccaactcactactatatcataacttgaaatctagagctctttctttgaaaggatgatctaaggacagctatatacaaatatataataaaaggggaagaaaaaataatgtaaagcaaaaattattttcccaaaaatgttacaatagaagtccacatgtttcacagtttgggtacatggtttaaaatccacctgctcactgggaagcagcagccactaagaaatagatgcacctctaggggctgggaaaaggtccagttcagtgaaaggaatatgatgttctaatgtgacaaacaagaggagttcgcagttcaggtagacggtgggcttcatggatatcaaaccaccataatggaaatgttgcaattgataggcatggtgatcaagagttcaaaagtcatgtccacaatttgggggtttttagagctctacatagggaaatttctcagtaacggttgtgttggggttttgaggtaagccatcatcccatctaggtgaacttgtaagaataaggcaaactttagttctagaagtattaggtaactcataaagacaaaggtcaggcttagagatgagatgtaatacagaagcagctcaggacaatactgggtgacagtgaggactggactgaactaacaacaagagtgacttcatgttgatacccagactggtaccatccttgatcttggagaggcttcaatcttttaggtattgggtcatatggctcatctgaaagaagaggtaaatctctaaggctagaacctaggtagaggttaacaaggtgtatttcagaaacctcagattaattaaatgagtgtttcaaacacatgtattttattgacagtttttcccttgggaaaaatgacaagaaaccatattttttagactaatggaacagaatagagaacccagaagtaaatccatacatctacagtgaactcattttctaccaaagtgccaagaacagacattggggaaaaggcagtctcttcaataaatagtgctgggaaaactggatatccatatgcagaagaatgaaactagacccatatcacttaccatttataaaaatcaaatcaaaatgtattgaagacttaaatcgaagccatccaactatgaaactactacaataaatcattggagaacttctccaggacattgatctgggcaaagatttcttgagtactaccccaaaaacacaggcagccaaagcaaaaatgaacaaattggattacatcaagttaaaagccttctgtgcagcaaaggaaacaatcaacaaagtgaagagacaacctatagaatgggagaaaatatttgcaaactatctctctgacaaaagattgattacaataatatataaggtgttcaaactactcaataggaaaaaatctaataatctgattaaatatgggtaaaagacctaaatagacattttttaaaagaagacacacaaatggcaaacacattcacaatataaatgtggttcatattgtcacccataaagagatatgaatatgttctattttaatcatttttcttcaaacttaaattcattaatggaatattccattgtatgcctgtaacaaattatctcacatactacataaatacatatacccactatgtactcaaaaatattaaataattaaaagaaaccataatataaaaatgaagtttcaaggttatatgtgtgtgtgtgtctgtgtgtatgtgtatatacacaggtatgtatatatttaacctctgttccattggaaaaccaaatgtaattcataccaaaccacccacaaaaagaaatgatacattctattgtcatcatttttcttcaaactgaaattcattaatgtaattcaaaaagcaatgcaatttcaaaagaaatcatttaatgtagcagttttagtgcacacagtctgattcaagagcatttcatttactcatgggcactatggcaaaactccataatctgtattcattatataaaacagttcctccggcaggcatgtttagctttgagctattttcatggtgtgcatatcaccaatttggcgaggttggcattcaaacagaagtatcagaagtgaatattttgtatacttatcagatatattcatttatgacaatatttctatttttataaaactctcaaagtgatattctctatttgatatacagtgtagttttaatgatgaacataaacggctactcctgtttaaaatataaaattggatctacttatggtaataaaatatattaattatttctcacttttaagactataaagaagtctaactcacatttataaaaggtgtgaaaaattcaatttctcacaacctaaaaagcatacaaaattttactagttttattacgtaaaatcaggaataattgattataagtaactgatgtaaaggtaatgtaaaaactacctttcttttcacacttaatttatatatgatattacaaatttatttatgtattcatttatttgttttagattcggggatacaagtgcttgtttatacatggatattacatgcttaatggtagggattgggcttttagtgtacacattatttaagtgttggatattatacccaataggtaattttttaatcctcatcccccttcctttttccctccttttagagtctccagagtctattccttccatctttatctacatgtgtgccctttgtttagctcccacttataagtgagaacatgcaatatttgattttctgcttctgtgttagttcacttaggataatggcctccagctccattcatttatagctgtgtagtattccatggtatatatacaccacatttttttaatccaatcaaccattggggacacaggttgattccatgactttgctattgtaaatggtgctgtgataaacatgtgaatgcaggtgtcggttttacatgatttcctttcctttgggtagatattcagtagaaggatggctggatagaatagtagttctattgctagttctttgagatatttccaaactgttttttccatagaggttgaattaatttgcattcccaccaacagtatgtgagcattcctttttcttcatatctgtgccaatgtttgtttttctgttttgttttgttttgtttactttttaataaaaaccattatgagtggtataaaatgatatctcagtatagatgttgcatttctctggttagtaatgttgagcgttttttcatgtgtttgttggtcgcttgtgtttcttcttttgagaaatacccgttcatgtcctttgctcagttttgaatggggttgtttgttgcatcttgagttgttttgggttctttgtagattgtgcatattagtcctttgtcagaggtataatttgtaaacaggttctcccattctgtaggttgtctgtttattctgctggttacttcatttgctatgcagaagctttttagtttaaattttatttgtctatttttggtttagttagatttgcttttggagtctttgtcataaattatttgcttaggccaatgtctagacaatattttcctaggttttcttctaatatttttatagtttcaggtcctacatttaggtgtttaatccatcttgaattaatttttgtatatggtgggtgagagataggtgtccagcttcattcttctgcatatggctagccagttttcacagaaccatttattgaataggatgtcctttcccaattgtttatttttgttgacattatcaaagatcagttggttatagacagtggttttatttctgggttctctattctattccattgacctatgtgtctgtttttttttttttttttttttttttttttttttttaccaatactgtggtgtttggttataataaacttgtagtataatttgaaatcaggcaatgcaatgtctccagaattgttcttttaacttaggaatgctttggttattcaggctttttttttttcctggttcttttttttctgctatgaacttgaaaattgttttttcaaattctgagaaaaatgatgttggtaatttgtcagaaattatattgaatctagaggttgctttgggtaatgtggttattttaatgatattgattcttccaatcaatgaacattgggtatttttccatttatttgtgtcattcataatttatttcatcagtgatttgtagttcttcttgtagagatattccatttccttggttaaatgtatttctaggtattttgtgtgtgtgcatgtgtgtgtgtgtctactgtaaaagggatcaagttcttgatttggttttcaccttgaatgctattggtgtacagaagtgctactgatttttgtttgctgattttgtatcttgagactttctgtatcttgaggtctgtgagtcttctaaagaggtctttagggttttctaggtatataattatgttattagtgaatagagaactttgacttcctctttacaatttggattccttttatttctttctcctgcctgattgctctggctaggacttccattattatgttaaataggagtggtgagagcaaacataattgtcttgttctaattcttagaggaaatgctttcaactgttcctcattcagtatgacattggttatgggtttgaaatatatggctgttactattttgaggtgttttatgtacagctagtttgttgagggtttttaatcatgaaggcatgtttaatcttattaaatgctttttctgcatctaattgagataaccatatggtttttgttctcagcattgtttatatagtggacaatgttaattgatttgcatttgctgaaccatccttgcatccctggaataaagacctctttatcatgctgaattgtctttttgatgtactgttggattcagtttgctagtattttgtggaagatttttgcatctatgttcatcagggttattggcctgtagttgtctttttttgttgttgtgtccttgcctgattttactattagggttatactggattcatagaatgagttaggaaaggatctctcctcttcaatttcttagaaatagtttgagtaagattggcaccagctcttcttcatacacctggtaaaattcagctgtgaatctatctggtcctgggcattttttgttgggagatttttctactactgattcaatgttcttcttcattattggtttgttcagggtttctattaatatttccacctggttcaattttgggagtttgtgtgtttccagaaatttatccattttccctaagttttctagtttgtgtgaatagagatgttcatagtagtctctgatgatgtttcatatttctttggtatcagttgtcatgtcaccttatttttctgttgggacaagtcccatgactctctcctttttttccctcttattttcacctctatcaatgttttctttatttaccttatttttaaataacctttaaattttttccaccttcttgggatgagtcctttgattctctgctctatccttcactcttctcttgttaattagcctaatgtttttattaatatttgtaagatctgtgaggtgactctgaggccataaatttgacaatgcttctggaactgctacttgattctgcaggaatcaaatacttatctgtgattgttcagtagtgagctgtttgtcctgagtcaacgcaaacatgttcttctactgtgcagcataaaaaactaaagacactgctgccaaattagttactcacaacccattttagtaaaggtttctcaggaagctgatgataccaatctaaagaatggaacaattcgcttaaactataccttctgatttcaatggttacttggttttgcccttctcctacatttactaccttcttagtaaccacaggtctcagaggtagtttctgttgtctctgtataattctgcccttcaggggttgtctctgagtctagctcagaaagactcatatctgagcatggtccagtcttaaggcttgacccagcactctcttttaatttcattgtaactgttatagataacaataaccaaggaattaaacatttcacttttttattagtttgcatttcctcatgcatccaatgaacggactccttgggagtcagatttatctctaaattccatggatagcttttaactttagtaactgaactaaagcacagttgttgtttcataccatgggtgaccacatggccacccaggaatttgaggttttttattccctacccttatatgcattctttccccagcccatatgtttccttgaccgtgggccagtccagcaaatccaacttcactgacaccaactgggtaggggaaaactatctcaacccatgtttgcctccactctcacacaactataaccatcatcaacacagaagacttatgtaaccaaaggtacggggctttcgtctcacacagcaagcaacacacacgtgttgggtgttccccaattcagttttgtcagtatttacctggaaatagtttctgatctcacaggtccccaaggatacctctgacattcccagataccagtagcaagcccagccagacctctgaaacttctaaccaaccagcttcatgttggggttcccatgacccctttgttaggttcaattaatttgatgtagtggttcacagaactcagggaaacacttatatttgctgtttcattacaaaggatattacaaaacatacagatgaagagatgcatagggtgtggtctgcaagaagagtcatggagcttccatgcttcctcaggtacaacaccctctagggacacccatgtgttcagctctctggaagatccatacatttatttaaaagcacttacaaataaaatataagttccaaatggcagagatggtgtcagtactattccctgttttacacctagtgtgtggcatggagcccagcatctatgggtactcaagaaaaacttgtaagatgtatgaattcaaagaaaatttcaaagatttgtgatatatcacttactgttacatgtttttgttttctcagtcaacatgtgctaaaagcatagccattatcctgagctggtctgtgaaactttacatatttaaaggagttttttatactttaaaagattgggcaccagtgtttatactacagaattagtaatgacttctagtattatgtgctagatcctctgtgttttaaactgggtgatatagtaatgaatgcttttggaaactagcccgagattgatggcttgtgtagagagaaattggagagttagatgagaaaaatggatccatattgatctattacacttctgaatgaagaattgataatactattacaatctaatgaaaagaaatacaattagaagaagccattctttaagaaagtcccttacttccaccaaaaggaactagaaggtaggaagacaacatagaaaaatcctgtagcaatgtaggcctaaggtttaaaacagactggattgggaggatggctagagaaatctgtgaataaagagataggtaagtgatatgttttagaatacaaaaacaagaccaagctaatatggaggaagaactggagtggcagaacagagaatatcccatgttttcaagtaggagatacattatatctttgaataaactgaggacagcatgttgttggagggagtaagatgatgaatttggttttggagctgtaaggatttgacagctatgtgactcacagaaatatttaacaggagttgtaaatacagtactgaaactcagataaagaacatctatggagatgttattacagttgttaaaggcacagttattaaagggaaaatgaagtgaagaaaatgaatgaattcttcaagaacatattccaattggaaattgccctggtagttttacatattagttaataagtaaaccactttttatttataatgtattcataaagttttagattataatagtggagtagtttattattcttttgatatttagaataactttttgatatcatgcatgatgatagttattttaatgtgtgtgatttgagaatatagtgatgaattataaatttaatgatccttttacatgaatttatgtaatcactgctgctagatacattagtaatagtttccatatgtttgagatatctataatggagtggattgtaaaatataaattgatgagtattttccagctttcctatttcagccaccaacactcctttcttagcaaatctatggggatactcttagtgccttaggaattatccgtagctgagaataataacttcacatctttttaggattctaagtctaaaagacagaaattataaactcattagcggatacatgtgaacaggaaaaaccagcatttctcttcctgtcaaacaagatatttgacccttcaactggagagaatcagtgtatgtgcattcttttcctttacccgatgaatctgggtggcttgaaaagaatgataatttccttgaaagtgtttatagaacaatggagttgtatcctatgtctcagacataatccatacaaaaagaacaagcttagagagccacagacaatttccaaaacttcaccgctattactaagcggcatggggggtattctctgaatttcctttgggttctatgcaggctggggaattgagagaaacagtgggtccttcccggaaggtcgcctgactacaaagaagagatgagcattaaaaagttgtactgtgggccataagcctgaagctaaagaaggaaatgtctcaatctcctaagactgtcacagccaggaagtcaaagggggctgaaccacagagggaagagaaagcaatcatgaaacatctgaaccgattggtaatagaatgcagttttactgtatgaaaaacaggacatgtaggcaaaaacaacttaagattagaacagtttgatgattttcctccttttaacctctttgtgggcattagttatgaagttatataattagctgcttttttttttttcttttcttccacctgctagggagtgatgataggtggcttttatctcgacagaaagtacacggagggaagaacataggcttggaggctgattcttctgggtattctctgctacagagagaggaagaagttgtggagtcactggcttctaatgaaagacagatcatgactggccatctacatacatgaggagggaaggaaaagtatcttactttttatattatagaatagttttcagaccttagctcaaaagagcctcacttttagaaactttttattattctagaatgatttcactctctttgaacaatctcacaggtcatctctggaaaagtgatcttatttggaaatacagtagcaatgcaacacgtttaatggtctctctgacatgacaaaaggcaaaggaaactgatcctattggatgtggcaagatctaggtcaatggtgaccttttagagaaacatttctgtagaaggcctggcaggagacaaattgcaagggaacaaagaagaaataagtgtgaaaagtagagaagaaatgactgaagatcaagaagagtgctcacaaaaaaataagtggtaagcaaaagggcaagagttagaaaggttaacctatataaaattcaggctaaaaaggagaaatacattgcttgaaaacaccagaggaagaaaagaaaattagttcctgaatttctgttgcatttaaactgcatatatatttaataagttcaggctttcatgcagagctgtgtcattagtattggaggggaaaaaagtccaactaatagttataatctattaatagggatgaagtaaatcatgtttgggtataattagtaagagaacatcaataaaggagaaaaattttttaaatctaatagacctagaataaatcacgcattacttgtaattaccaggaaaatacttggatcatggcaaatgatttgacaacatggttctgtttaatttaccaacctattttaaatggaaacataatgcttgcaatgtattttactgtctattcgttacacaagcacattgagataataatgagaataccatgagatagtaaagaactacttgttctcttgaagagttatgagaatagccaaaatgttcaaacttcacattaaattttatatcatgatgttaatttattttaaatttactctgtcattccaatgagaatggctttctctgccaaggtttctgcaagctgtcaattgtcccaatgctggctgttgatctcctaggcagatttgggccataacacagccctttgcacccagttactaggaataattgaaattcatcagttttccacattttgatttcattttcttggtaacttctctttcacagactctcattcccacatttttgcattactgctgaagtctggaaattagtcttcatcacattgttctttcattccctctttactcaaatgcctaattaatcttctttaagcatagcttaaatcattctactctctttttcaaaaatcagtagcacctctgaccttctattttgttagcctttagttgaatttttattttgctcttttctgggagatgaaatattttattttgtcactctactcctaaagtgagtttatatgtcttactagtgcataattcatctcacctgatacacttttaacttatttatatgttgaaagtaaatgcattatataactatttgggccaaactctgttttaggtcccagtaatatgaaggtggatatgcagttgagggaaaaaaaagacaaaaatacacagcatttgcctttgaagagaccaccagtttgttatggcagcagatgataaaaccagtgattccaaaatagaattgagaaaaaaacgagagtacagacaggaaaggataatgtttcagaaaattttcagtggtaggtggggtgctaggtaaaggtgagtcaccaggaggtgtaccaggtgtgttgtatagcacaacaaaactgccatacaatatagtatattcagaaaactaattacagtagttcaataatactaattcatgagaaaccagataggttatctagtgagctgatgagaggtcctcacagagtttaaacagggaagtaccatggtaaaatttgcaatttaaaaacatcattttggaagcaatgtggtagatgggtttgagttgaatgaaccaaagtcaagttaactaggtagagagctatcacagcaatgtggaaaaggaataatgtggttctggacaaagggagtgtcagcatgaacagagttaaggagacagatataagtgacagctcaaagactttaaaaacaaatatactttatatttcatagtaattttaggtttacagaaaagttgaacagaaagtatagagggttctatatgctttcttaaatgctgcctgagtttctcctattattaacatcttgaattaatgtggtatatttgttacaattaatgaaccaaaattgatacattattaactacagtcaatagtttacatcgggtttcagtctttgtattattcaattttatggaatgtagagaaacaaaaatgcacaatataatatgtgaaccattacagttacagtattgtacagaatagttttcctgccctaaatatctactattttttttcattcatctctcctctcctcccaccaccaccctaaatctcaggcaaccactgatctttttactgtttctatagtttttctttttcaaggttgtcatatagtgggaatcatataatatacagcttttacagatggccttctttcacttcgtaatatgattctaagtttcctccatgtctttttatggctcggtagctcatttcttgtcatttttaaataatattctgttggctggatacaccacagtttatctccaaccattgaagaatatcttggttgcttccaagttttgacaattatgaataaagctgctataaacatttgtgtgaaggtttttgtatggacataaaagtatttttaaactcacctggacaaagatcaaagaatgaatgctgaatcatttgctaagggttttatttcactttgtaagaaactgtcaaactgtcttccaaagtggctggtatgaatttgcattcccttcagcaatgactgagagttcttgtagctccacaacctctccagcatttcgtgtcagtgttctggattctagccattctagtaggtgtgtagtattgccttgttgttttaatttgtagctctgtaatgacagataacgttgagtatcttttcttatgcttatttgccacatgaatgtctttagtgagttgtctgttgagagtttttcacactttttagttgtatttttattgttgcattttaagaattgtttgtatggcttagataaaagtcttatcacatatgtgttttgcaaatattttctctcagtctgtagcttatctttccttaattttaagtttctttctcagagtagaagtttttcattttaataaaaatcaacttattaattttttctttcacggattgtccttttagtgttgcatctaaaaactgattgccaacacaaaaatgtgaatatatttaatgctataaaattgtattcttaaaatagttaaaatagggctaggtgcactttgggagatcaaggtgggcagatcacttgaagtcaggagtttgacaccagtctggccaatatggtgagactccatctctaccaaaaactagagaaattaggcagagtggtggggcgtgcctgtagtcccacagctgtttgggaggctgaggccggagaatcgcttgaacctgggagacctaggttgcagtgagcttagatcatgccactgcgctccagcctaggtgacagagtgggactctatctcaaaaaaaaaaaaaaaaaagttaaaatggcaacacttttatgtcatatacattttacaatggacagactacacaaaaactcattgccaaactgaagatcacatagattttctcctaagctatcttataaaactttaatagtcttagatatgacatctaggtctatgatttattttgagataatttttgtgaaaggcataaaggtcagtggctaggttcattttcttgcatgtggatgcccaattattcctctaccatttgttgaaaaggctgtcttttccccactgaatatcctttgctcctttgtcaaaaataagtggaccttatttatttgagtctatttctgggctctctattttgttcaattgatctatttgtctgttcttttgccattaccacattgtcttgattactgtacctttatagtaagtcttgaaattggtttttgtcagtcttccaactttcttctttttatgtaattttgtgtttgctattttgggatttttgccttttcatacaagctctagaatcagtttgtcaataaacacaaagtaatttgctgggattttgattggaattgtgttaaatctatagatcaagttgggaagaattgacatcttaataatattgaggctgcatagtgcttattttaagtaaagagtgaagagagaggaattagggattacttctatacctcaaattaggacaactaggtgcgtcttgaccctcagttgggtataaacggaggtacagattttgaagtgatgatgataaattagatgttagatatttagaatttgaattgccaaagggcaaccagatagatataatcaccatgcaattgaataatcagatatggaatacaggggcctggcctggatataaagatttaaaaatcttcaacatacatataatttattgcttatggagaaaatagatgtgggggagaatatgtgagaagatgttaggaaatataaaaatgttcagtgtgaatatagaagaagttgccctggaaggaactatagtgaaaatgtcagaggtgaaataaaataaaacaatccacagcagatgaggttgttttggaagccacatgagaaaatgattccaaaaggaacttgtcagtatgccaaattaacatagcatgaagatagtttgttcactatatctgtgtgatgggatcatcgtacaacgggcctcaatggcatgcaatttacccatgtaataaacctgcacatgtaataaacctgaacctaaaataaaagtcataaaagaagaaaaaaatagcataaagagtgaaagcgcaaggggaaaccaaatttcatggacatgaaataatggagacacaagtatgaataactcttataaaacaaatgcttaacttgagagaaggatcaatataattaaaggaggatgataaaaggactagggagggtattttgtaatcatctcacgctcattttcatcattaccatcattgccatcagtctcattatttagctgggacaaattggtgtatatttatatattgagggcaaataactagttcaaaattgaaaggtaaaaaacaggccaggcgctgtggctcatacctgtaatcccagcactttgggaggccaaggcgggcagatcatgaggtcaggagattgagaccatcctggccaacatagtgaaacctcgtctctactaaaaatacaaaaattagccggacatggtggcatgcctgtaatcctagctattcaggaggctgaggcacgagaatcgcttgaaccaaggaggcagaggttgtagtcagccgagatcgtgccactgcactccagccataaaaaaaaaaaagggaacacattttcccaaagtaattaaaaggaatttccttccagggataggtgcaagaattaagcttaaactggacaagacacttttctctcaagcaattaataagtaaacagaagtggttgaagaatgagaacaagcttgatgtttaaaccttagccaaaaaataaagaaaaaaatataaattattagtatctaataatcacttggatactaatcatttgattattggacactagtaaaagttaattaaaagtaaattaactaataaatgttaatcaaaatatttctcctctcaacctgaataaatgttcaagaaaatatttaacttacttccaatatgttttacttcaaaatttagctttggcatattggatataaagtgtggaaattttcaactccttctccctaaaatcatgcaaaatatgcaaatgaaattgagccatggttcaatgaagcaattcaccaggctctttgtcattactgagaataatgacaatgcagagatgtcagacattgcagcacatttgaatctcccagtatactttgtacaaatctcacatagatggatgaataagacatgaagtttagatatgggtttgctccttgaatgatatctggtgccactagtttcaatctttcttattgatgctctttttgcattgctctttgtcagtcaggattcactcatagagaatttaatgcaggtaattgattacacagatgtgaaaaggcctgaaaaaacagaatagaggaaaaagaaacattccagattttaactgcataatcattcttaaggctgagggaagaatagtaggctatggggtcaccagtgcttagaatcatggagggttgagccagtgctgaaaccaggaaaggtaaattcatgaaggtgttgggaacttcgagagggtctgagcactgatggtaggctaagataaatgttctgtgttgtagctactagaactgcaaaaaacaaaaacaaaaactattaaacatttagctttacacgtttatagagaccataaccaagtattttttttctgtcttcctgctttcctttttcctatgagttcctctaatggaagaaacttaactagaagtcagctggccaaggaatgtggaaaacatagttaacagggccctaactcccttaaaatgcataatagaacatagagggatagaagagggaatcaaggtcaagcacatttatgattggcaaaatgaactctccacctggagcattgtttgacaagattcccgaatgaaagagggttttaaatgaaaataaccattacctctgtcatccactcaacagtatatttgaattcaagacattccaaacatgggccagaagacctaatttttaatgagagctttactcttaacaggaaaataaggaaaacatctacaacaagtgtatactcaggaggattcacagagactgtattttgaactggctcattgtttggtgtcctgaaggttttcccaccccagggagatgcatcctattaagacaacacatagatgagattacagcagtattgggtacagtaggagacagggtcatacagtggagaagagtaagacatcttgagcccagatgtatttttaggcacatacatttaggaaagataatggatggaagttgatgatctaaaaattggtttctataaaaataccacaatcctgtacctcttggaaagtcttatgaacttctctatgtatacttcaccttgaaaactgctcttatagatgattaagaaattgtgtatatttaaataataataaagctctaaaaggttgtgcaatgaactttagtatgaaatgatagttctttgtagtttttagcctattgcaaacatattcaatttctgaagggagaatcaagattttgcctctttaaagtcaagtcaacattattactgagcattaattaatcacgtatttaaaggtcaacaggtttttttgtttttttttttcttttttttgacaagagtctcactccagttgcccagactggagcagtggcgtgatcttggcttactgcagcttcgacctcccgggctcagatgattctcccacctcagcctcctgagtagctgggactacaggcacatgccaccatgcccagttattattttttttttttgtatttttagtaaaaacagtgtttcgccatgttccccaagctggtcttgaactcctggattcaggcgatccacccacctaggcctcccagagtcctgggattacaggcatgagccaccgtgccaagccacggtttttgtttttttaattgaaacagaaagtaaagaccgtgattcttgaataaggtatttgtgatgtctatggttcaaaatgtttatgatttaagacaggtatggctattaaaacacatattactccttaaaaacttagaaaatacaaggttgttcaattataatagtattctgcatttcctgctccaaataaaaagactttgaaagagtgggtctccatttctatatttgtcccttagaacctcagacagcgtgttttgagtcttcatgaaccctgtgagaaagtaactaacctacaactatttcttgcatagctttgaaatataataaatcaattggacctaaaatccattttaaaggttcaaatattaagctttagttataaaattataaagcctttctcaacaaatagtctggtttgtagtgtagagactccattttcataaagattagtgatatatacccatagtctttacttctaatttatttaccagcgtatttccttatctgtccttcctctagcaactacatttcggcataattattgagagatattttttacacgaattttaaattacctagattccactagagtgctatatagtaagttgaataatggcaccagagatataaagcctattgtccagaacatgtaaatattactttatgtggcaaatatattgcagatatgattaagaattttgagactgagatgttatcctgattatctgagtggccttaaatgcaatcacatgtatatttataagagggcggaagaggcagctttgaccacacagagaaggcaacaggagaaaatagaactgagagaggtttgaagatacgaaccttgaaaattggatgatgtgccagatgataaaccaaagaattctagtagccattacaagctggaagaggcaaaggacacattctccactagagcttctaaaaggagtgtggtccctttgataagtcaattttggccaagtgatactgttttagacttctggcctccagaaatatgacagaataaatttttgttgttttaagccaccaagttttggtaatctgttacagcagtcataggaatctaatataggtaccatgcatcatgtatacagaaaactatagtagcaactgggttaagttaagccaatataattctcatatgtctcttccaaattcagtattaaccaataagaaaattttccttctaagtttctattattcttataaaaacctgcattctgtgttgctatgcttacttaccataattgattaactctctggttgtacttttgaaagactatatccaatcactaatcaaaaagcagccattactcagtatgatacccagttggatgagttcaagtaatttgctcaatggggagaaatctcaaacggtttaaattgtgatgcctttttagccataatgttgatgctatattgactaaattgtaattatattatacttgtgctatttttggcagtgagaaaattttttattcaaattatcatactcattacatatgtaactattgaaaaataagttttgaaggcttgtaatcatgttgctttatttcatagctggcatataaatgtaaaaccacactttgaaactttaaaactattccagaaaagtttttacattttgagtttggtaacattttgttaagattgatcgtgaatacttagtctttttttcaactactgttaaaaaatgatggaaaatgtatcatttgttagcagacttttgaaagtcctgtaggcttgacatacaaaagcatgaattattttgtatctgtaagaaggtttctacatttgagagcagcaaagcacaatcaaggaacagctaatcttagaccagaaagaaactggatgaaccttctttcacatcctgaaaactaactgactttttttgaagatcaaactttttgaataccaacttatgctaaactcataatcttacaattgttttacgacataattattcatattcccattttaaagttaaaataactaagtctcagagtagttaaatatcgcctccttggagtactaagtcggaattaggtaaccaggtctgcctatgtcttttctgtctccatgcagcactatcttaagtaatatagccactttatcaattagtgagataatctccatagtttctaggcactttaactttatttacacataagaaattaaattttgaataccaacacctctttcaaaatccatcttcttttagaaatgacagggaaaatgtcattcaacagacagtaaaacagtgcccagtgtagattaaataaaaacaaaatgttctgttctgagttttgcaatgtggtataatgagtttttcacaagaaaaaaaaatggccgtaataagaagtgcccccggctctcatacttttaatgttattaaattaagttcctttgaccttaccttgaaaattccattccaaagcacactaacaagctatttgttactttttaattatttcaattgttatctgaaatgtgagcaaggttaaaaattttttgtgggaaagtattaaaacttcgagttctcattaagaactgcaaaatttgtcctttcagtcttctgaccaacattctccattcattactgtagagtttccctctgaaagaggactacagagataagatgaggtcagtgataatggcgatgatgatggtgatgatgatgacaaatctgacattaaagaaagttcaactgtggcgaattctattgtgcatttccagtcacctctaggtcaaagtcagatttttttcatcatatatacttttttgatcttataagccaattgtatcagttaattcatcatcattagactgagtttaatgaaagagtaagggtataacattttgagtgcttattatgttttaagcactgggctagccccttgacctacctgacctcaaatggccactgtcatctttagtatcattaatggtggttttctgcccttgctgcatgtcaggcttatcaagggacattaaaaattattgatggcttaggctctatgacagaaaaattacaacagaacatttcaaaaggtcagttacagccatcagtattttttaaaaattaaattaaaatttgaagccaagggaaaggaagtatcatcaccttcaagataaaaatgttattccctcttatctctatttggccagtttagaaagttcagggagactttcttcactaaactacctttccagcaaaaaataaccctatgaagtatgagatattgaaatattaatttgctttgcttttctccgttcttcctcatagtcaaaataaatcaataattataaaattattcacccaaggactcttgcctctgagtctgatatgcttttgtatgtcttttctgtactaaatttactgtttccttttataagtcaaaagcatgtgtctggtctagggaattcaagtgaagagaattcaaaattagaatgaggaacataaaacatagcacctggctgtgcccagttacttaaatcaagcaagctaataactcaggtagaaccaactagccttgtttgataatcctggcatggaaagttactaagacataaaaatcaattaaaaatacataattaaaaaaatacgtgttttaaatgagtttctatattgtttgtttgtttatctaacatgctcatatggatagcaaggtttattcccaagtgggttgagttcctttgacttgtgtagcacctttttttatctaaatatttttttttttaatggagcagacatagagttactagaaaaattcagctaatgctcttcacagaagaagcacagaagagatctcacaaacagaaaatcagccatcataaaatgatactgtcaggggcacctttatcacctttatctatccatttaaaaatgaagacttaaaactgaagtctacacacttacctgtaatcccagctacttggtaggccgaggcaggagaattgcttgcttgaacctaggaggcagaggttgcagtgagcggagatcgcaccactgcactccagcctgggcaaccgagcaagaactccatctaaaaaacaaagaaagaaaaccaaaccaaaccaaaacaaaacaaagcagaaaacacacttaccaaagatttctaaaaaattaaaaatctggccgggtgcggtggctcacgcgtgtaatcccaacactctgagaggccgaggcgggcagatcacgaggtcaggacatcgagaccatcctggctaacatggtgaaaccccgtctctactaaaaatacaaaaaaattagccgggcgtggtggtgggtgcctgtagtcccagctcctcaggaggctgaggcaggagaatggcgtgaacccgggaggcggagcttgcagtgagtggagatcgcgccactgcactccagcctgggcgacagagcgagactccgcctcaaaaaaaaaaaaaaaaattaaaaatccaaaaatctacttttagtcgtcagcaccttatgtccaatgaattggtttttagttttattgtttttaatttccattttgtttgtgtggcagaagatactactttttaattacacttcaaatagtttgcaaaagaaaataatagtagcagtaatgattattatgtaaaagtgggcttttcaatagaggtagacgttcaaatatgttaatgaccaacatgctgagacagatacttgagaagctacattgctttatccaacaaaaatatagccactatttctgtgacacctactgtccaagacattttgcatatattaaacgacttagtcatcataaaatgtgctccttatttccattttgtaaggatgataaacgaaatccagagaggttaacgaactgcctgagaggtagaccaggtgattccccacctgtgtcacaccccacaccagcaggctttttgctcctcaaggctttatgacacattggtagagagctcattgctgtctggctagatcaactatttgcttatttgtttaggagtcatgaaatcctctttgactttctattgggttggaactatatataagactaatgtatttcctacaattttacctgggaataaatatattctataaagactgtatgtgagttgttaagatgtctctagtatggtgaaatacctagcatatttgacagctcatttttaacatttttctctataatacaaaattattttcattaatagccatggaataaaataaatgataataatggccataaaaataatacaaacagttaaaaaattattgaacttttatgtataatctgccagaaaaatacctacaataaatgatatagtatgaaaaagaaagtaacatgttaatacttttaaattacattaatgtattggactaaactaagtattagttatcatagtaatggattaaaatattgacatttctgtttcttgttttagcttctgcaaatttctatacttttaattaataaagaatctaaagatttacccagaggtatagaattaaagtaaatcaagcccttcctttattttggtaattgtgttattagtgtttatttctaatttatcatttaaatgcagaaccaggtggtaccacagaggcacaaaatgcacagaaaaaatcgggacaaaatattatgaacttaccctaaagacaatttttgtgtagctgggtctgtgagtgttggatatcagctgtgtaggcaatagttatttgaattaacttccatgtactatacagtgtttattagaagattagtaaaaatgtgctaatttaaaatttatgtgcctatatatgtatataagtatatgtatatattaattatgctatatgttaaattatgtgtaaagtaatatatatattaaactacttatttatatagttaaaatacaatagtaaccacagcagttttttagaactgtcctgtctgatatgacagccattggccacatgtagctacttatactaaacttaaatttgtcaatatttaaagaaactcaagaatattaaaacttacttaaagaaaataaaatttcaattcttcagtcacattagccatgtttcacatgctacatagctcatgtggctagtaactactgtatatgacctcatagatacagaacatttccattactgcagaaagttggttgggctgcattgatttagaatttatatcgtccaaagattttcttgattagaaatactttattactaacgttgtttagaattaccagtgggagaagatgaaaaatcaaactgacttttagtaggtattattattacataacatttgtctacaggcagtgcaacccttattcctttcaatgggggccatccattcccaccaccttgtcctgcggttgctgttgctccagtgacccattaatgcttctatggctttcacattcttgtagacaactggtgccttgccacttaatcagaccttatgcagagtattattggtgtggttttgatgccaagttgttctacttcctcagaggacacaccccatcaatcattctccatcttttctctctttactgtcaattcaccatgaatcgaagcaagctgtgtcttaccttcatacaaatttacattattgtgccttggtttattttctctgtctagtcaactttgaaccattttcatatcctacttttctgaaattgaattttatgattctgtttgcctcccagtcattcctagtttcattataatctgccttccgcctaatctgtcctggctattgccatcccaatctctacaagaactcatccctgaccgaaccctatggactgagccctgacaccatgatcccgtggtgtctataaaacttgtcacggtatacttgaaaggtggatttgtttgtctcttatgggcaggacaatgtaaactcctagaatatgtaagtaattctgagccccaggaccaagttcagcttttttttttttttaatgtagagatcactaagcaaatatttgtagaaggaagggaagaagggagggaattttgatattattttgaataacctagttgtgaactcaagtagggggcaagaagacaagcaattaaaataaagaccatgcatgtctgctatcctcaagactatggagtcctcaagatgatatactatgatggcaagcaaattactctgcatttgtgaagatgcacctcctccaatgatcagatgtattacagatgcatcagtgatacactgtaaatcgataccttgaaattgtccatggctctattcatttaatgtaagaagtataatgaagggtttgctttatgctaagcattgtgctagaaactgaggatagcaagatgactaagacatttcacctgcccttaagaggtaaatttatttgttaggaacaagacacaaatatttaaaataattatgatgataatgatagttaatgttcatttagttctcctaattttccagcactaaatgcttctcatatattttactatataatttacttaacagcatataagtattaatgttattacccttttataggtgaggaaactgagacagagaggatgagtaaattgccaaagataatacaagtagtaattggtttagttggaattgtatccaggtagcctggaaacttggaatatttgtaaggatttataagactccatggaatatatttatataagactttcattttaacccaaatatacgatgtggcaagagaaggagtgtacaggcaagcatgggaagtctgaaacacaacaaagtgcaaactcctcccaggttcttagtcacacatggatggactttgcctccagaaggaaccacgttgaattgtgccataactcttggctccaagtgaactcaaggtagaagttaccaggaggatatgtcatgtccctctggcttctggtcaagctggactgtctaacaggttatgctgggtgcaaagcatcagtaaacaaacttgtactgcagttagctagggagttctggactttaaacagcacatcataaatcccactattcttatcttgaaaaagattcaaagccagtcatccaggcatctccagaaataagaaacaataattctcagtctagctttgtatttactctatcctacgcagaagagctaatcatggtgatggggatacaagggagaaaagtttgggaaaaagcatactgatgatccatgagtgaaagcatatacaaaactgcagaaacaaaggctgttttcctagtgctctgctgggacaaggggtggacttgaaatgacattaattactctaagccagtaaatgtgttcagcacttcaggtatgtaatatttatccacataacaaccccatgaaatcagtttcccttcatttataactgagaacattgaggcttagtgagaagaagtaattcgtcaaaacttagatgaagagaaaatagagaagcgctatcaccctgtctcaaaaataggtgattatgatttttgcaatgttgtctgcaggtaaatgtggaaagaattgaagggttgtaggtaaaggtcaatagagacttgtggttttatttatggccaaatgcagtagaggatcttgttggtgactaatagaattttttttttcagttcttgataactttaaagaccttgatgaaaatattgggagtagtctcaggtcagaaagacttgttctcattcaagagtccatcctctttttgtctatcaggaaatgccaggactggctggatagcgttatgttttttattgctctcataccaatgtttagcatgtgattgaccgtcactctcctgaagaaaaggactttggagacaattgttgtttttttttttttttagttttatcaagctgtatttaattttggtgtgtcaatatgacagatgtcaaggaaacttcttggctttttttcttaatctcttcagcttaagggggtgtctggcagcctgattttggtgatgagctggctgtcacagctgtaagtagcgccaaggagaatagataaaaagatttttgaaacttaagggtatattggtagaattattgtgaacagaagcagtccattttctgaagtggtttcatgaatatactctatcatgaagatatagatattgatatgaatgtatatatattatatatctatgtgtatatgtgaatatatgtaaaatgatcaaaataatttatgcctggactaactttcaaacttcttatttttattatttttcttaatctcatatctcaaagaaaccaatttctaccaattcttgctttcattaaaaaaattctaacagtcttagccataattgattactattgtccattcataagcattccattaaaaaagaaagaaaccaggctgtgggttttaatttaaattttcttagcttaacaaataaaatttaaaaattgagtaaattgttcttcgaatgcttaaaaagtaagtttttattatttccaatgtaatgggtgctacttcttccttcagtatcttagcgtgtttggtacagaacagaatgagttaacaacagtagcctgtctatgcctcctttgttcaagtgactgcaactaactgcaaattttagaggtccatgttgaaactccaataatctaaaataatttaaaatgaataatacataatatttatgaaaaaataaaatgcattttatgccagatatatattttaatgcatgtcggctacatgctcaagactgtagggcactcaagaagatacactatgatggcaagcacattactctgcctgtgtcaaggttccccctgatgatcagatatattacagatgcatcagtgatgtattgtaaatcaatatcttcagattgtccatggcaattcaactgatttgagtttctggcaaaaaatgacttgactaacatattggtattctggtttcatgaaatgttaatggattttttttttaagaaaatgaatttcttggagggaattgagtaacttgacatttcagcttttttaacatattagtgtacaatatgacagttttcttgatgaatatcaaagagaacagtgctgtatactgggttttcccaatatatttttggaataaaggtatttctcaaatctctctttaggaggaaattcttgatggctgagtaaaccacagccatgggagaaatactgaattacaccgtcttgagactactgggaagtgaagctaacaatattttgggttaaaatcaatctccaatcaatacacaaagaaatccccacacacattgtggagtctctgctttattaataatctctactgtcttacaaataatatactttggaacttcttcatgacaaaaacttagaatgtccatcaagagaatatcattaattattgaaaaagaagtaccagaattttacctctcattattagaaatttttcttctgctttctgcagatttttgaattatggtatttgtgtgtgtgtgtgtggtggcccttttatttttggaacacataagactaattcacatccttttatagattcggagtacggagattctttatttatcaaccttttctgaaactaagctatttctcttctttaaattatacactgtgtgatccacatgaagatttgtaggccataaaagcatcattagtatactgagatggtaacatgataaatagatctcacacagatagatttaacttttgcaactcagatctctcacaggaaaatggtacctgctctgcctacctcacagggatgccagaaaacaaacatgaaaataatgcaatatgtgtgaaaatcttttgtaaattgcaaagcagcctacaaagacaaagaactttaataatgataatgatcatgactcccaactgtacctgatcatttctggaaaatagaacagcttataagttagccaaagacaaacatcctctggctcaaatagagattgtgtcaaagaatatgtttcctttaaaacataattcattttaggaaaacactagaggagaaaaataaatatcgatattgatgttcaagatatttctaaaaattcagaaatcagctctttaagaatctatgaatacaaaaagaattgagatgagtaatctttgtttgtttgtttttggtctgtttttcaactatttttcttcttataacattggaagagcacaaatcccaaaacggtatttttttgaacgttattgtgttgtccaaggcagagttatcttaagtgaaaaatctctgaagcagtaaagaaaatatactgaaagtgcctcaatgatcagaatgttttcttcttgagaaagttatatagtacttttaaaagtacaggtcagagtatgtctttgcactcaattttgatttttatataaaatcctagatgtttctaccacagctggatctctaaggaagtagttaagaaaagaaaaatgtaagcgcagataacatatagttctttttagtcccataggaagccatagtgtcatgttactgaataaaatattttgaggttcacacaattcacatataaatctgtcttaaatataattaatatatttaatatttttcaaaataaacatgacggtattaggtttgccattaagtaatggcaaaacagcaattacttttgcaccaacctaatactttctgatgataaattcagacaataaaaaaggtaaaagattatttaaaatccatttgtatctgtaagtatgtataattattattttcatataaaaacttcaggatttttttctaccatttttgatcagttttactttagaaaaatgaaataatactgtgcataatcttttataacttgtttggcactgaagtacttttgtaggtatttttgtgaacatcataattatgcagcatagtatttagtatgtatatccaattctattgtaattaatagtgtaatttttaataaattccttttgggcgtttgaatgttttgattttttttagtataaaatctaattggtgaacattgttaaactaacatctttgtactttagacaattatttatttgggttaaagtcctagacatgtagttgttaagcaatattaaaattgaacacatataaaattgtatacttattgctggatcttcattaataaattgtagcaatttctccccaatgaaagctagatttaaccatttcacaatgtatatatactttaaaacatagtattgtacacaattagttatatagaattttatgtgccaatttaaaataaatacattaatttgaaaagtatgtgagaatggcctttagcccatccttttatcattatgaaagtgttaacaagaatgtttttttctttcccagtcagatgcagaaaatgtgaaatctcattagctcagtctgcatttattttattaataatgaggttgaacatctttttatgtttatcagccattcttttgctgtgtgtgaaatatgttaatttctattttttctctttttcatgttaatttgctcatatttttctaatggatattaacacataactagtttaacatattttctcatctctctgttttttctacttctctgtgtaactaaatcactatctttgcatttcattaaaaatcaaatactctttttattctgtaaatgacaggaatccctaagggagtgagaaccagctctgtaaaagagaccctgatacacgtaaaatgagaccctagttgtatcatgtctgtggctaagtgcctcatgccaaggtgaaagcattcacgttcatgtttggttgagtgtttctgagagtgtggtcttagccctccttgcagcagaattcattgtgctgactgctccacaatagattcctgttccctctgtatccttgttatttccagggacaggcctagaacctgcatttaataattaggtatttcttatacctgctaaagtttgataacctgtaagttgaataattcttgggtattaatccctagataaattcaggacatcatttgaagactattttttacgttcagtgccccctcctccatgaatggatcattatggaaagagatccaccttatatattcaatacattaaaacatttaagtaattcaataaagtgatattattgttttgttagatgagaataatatatcatcatatttcccttgtcagtatggcttccagtaagtccaaaattaaaatcaatgctcagtttaagaaatctcattgatttacatttctttaaaccacaaagtacaacaaaacatttgggaagccaggaagaaatgaaaataaatgtgcacttcccaagcaacctaacataacaggatattaaaatgggctcctctctttctagctggactaaggcttccaagattgagaacaatacagtagttctcagagtcttagatgagtaatagctaacattttcagtgctcattacatgccaggcactctgctaagacctctaaatttattaacccctcaaatgatttgatgaggtagaatactattatttactattatttccattcacaaattagaatgttaggcatagagagtttcagtaacttcctcatggttattaagcagtctgctaggaaagctgggatttaaacacaggccactgggctccagagcacgtgctcttagctaccaatccatgctggatactttatatcctgggagattataaaattagtgccagtggcattagcccatgaagacaaaaatatatatttgggtgagtaagaagattcttaaggctaatgatgaggaattcattattcagagaagaattatattccctttaatttttcatggtaaaattgtgtgtagacttctccttcaccttaaataaggaagaagtttaaagtgaacctcttggaaactgtaatatatattcccagctgttggagggttatacagagattagtgtcaattttcaccaagagaaaatgaaacagaaaagactactggagtggttttcctggccacagagtgaagagggaggatctgcatcccaattgaaaggtggctgcgggtccctttatcttgcaggctgtatgagagagttatgtttggaagctgactgtggcccatttgccatcctaaaagggacttgctcctggagaatggctgaaacagaagttacccaggaaaggagtaggaagccagcttggaagaaagcagctttctgaaggagacattgaccatagtaagggaatagttatatggaagatgacctataggaaatgttccttagaaaccccagatgaaccccaagaaggaactagagagggggcatctgtcacatctgcctatgatgcaactgacaaccactccagctccatgaaactttgctcatcttcgtgaatcttctatttctccttgttctgacccctgaaggttagaaatagcatcatgaaggataaaaggggtgaaatgaatacgagagaagacacatctccaaatacagcattacgagactgggactggcccatgctgaggagaggggacgcctttaaagaatacattgaacatttttaataagaatgaatttgattccttcttttcattttaactagaaaacaaaatgactatttactttttcagaatgacaggaataactaagaaacatgaggtgatttttataccaaggtagagaagatcatccctacaaagcgtctagggggtgtcttattactaaagaaacaatcatctaagcagtcttatcccaatcttcctgtattttaggaactgaacgaccaaagtttatgaaattcttttattagttttgtgtaaaactggaatatagcttatacttttgaagaagtgttacatcagctacttttaaactcactcatttctattttctgtatagaagcaggggagcacatttcataagttgtcccttcttcagaatcttgtctgccctccttataaagggaagttcatgtatctgagatctttgatttgtgggaacataaaaatcaaattgactttatgcagcatttttatagagaattatgttttttgaaagcccaatatcaaagtctgctttgttctaatttaaaagataatcaaaatatcttcaacactatgggaagtctcccagtaaacatggatttatatttagcacaatttatttgaaaaccagaaagtctgccaaagtggtataaacattaacttattttgattttagaagacagatattagtgagaagtaataaaatattgccagccttcataggcaactcatcatcactgttaaaactaaataagaagaaaagacccagttatgcctaacatggaccgatgttggttgaaaggtagatagaccccataactggctagccacatttgaaggctataatcatagaagatgggtgaaggaaatgcacaacaccaaatttgcaacatagactcatttgacgaaggggaaaatatgggacattttaaggaaaatgtcagaggaaattgcttgatagtatgaactacttatgtgtgattcttaagaaaattgtctccttaggaaattgtgttctcaaaatgtcttaaataaaaatagacataactgaatattctatattgtggtcagacattagaaaacttgtttttacctgtcataactcctcattctcctgaggaagacttaggatttgtctgagtttgagggttctggagacgtactcaacctgtttcccattcaagcctgataacacgaatcttaggctaagaccccattaaaacctaattggataattttgtacatgaataactaaatgcaaattcaaatgcagatagcatatataaactgcataaaggcaaggtgatattacctatatgattattacatgcatataacaatctccacttattcactgagagtttattgaaataaactcaatactgttctcttcatgggaaggataaggaagtcctagctttcaatgtgctgaaaggcctgtagggaaaagaaaataacaggaatgagaacacacgcacacatacacacacacacacacacacacacacacacacacagtttgatgcaatgagtaattaagtgctacattatagaacacaagactataggtgttcagaaaaaaataaatcagtgagaactggaatactgcagaggaattttctgaaaacaaaacaaaacaaaacaaagacgctatcttgaagtgtgccttgaaaagtgagtaagttatagaaaaccagactggaagtgaggaaatttcaagaaagagaaataaaatcccacaggtccaatggaggaaatgacaaggaaactggactagggaagcagcatagcacagtggctacaaacagagtcaggagccagatttacctgagagtctcagctccactacctactgctgtgaccttaggtattatgtcatcattctgtacacacttccattgtcagtaaaatggaggtaaactatcatatcaattttttatgtgagcagttttgagaattaatgagttgatatatgtataaacttatgctaggactcagtacctagaaagcatccaacaatattgttattattgttgtgcaatggtagaagatgtaattgtcatggctagaatgaagccaaattatgtaacaatagcaaatgccacttgttatagactaactgagcaatagaccctaggctcaatgcttcgtgtacattttcttccttattcccaaccacagtgctgagagggaaacatcatttctctcactttagagaggaaggggctgagatttcaagaagcaattttcttaagaattccactgctggtaaaatacagccaaagatttgcagtcagatcttttggcctatgcaccagtgtttttatctgctgcattataatgccttaacctaaatctaagagggctctgagatttaggcagggggcgtgtatctcagaccgaaatttactggatgggtttgaagcagaaaagagttcatattctggaaaaccagccaggtggcagctggaggctgttggaatactctaggaagggaggtaaatgagcttcttgtctattggcagtgctgagacctgcaaaggcagaaccaggatgctagattggttcaccacaaatttttcacactaattttcaaataaaatttacactattttagtctgggccctgaagatgagacttcagttaagtatgactcttgtttgtagagcccacctgactaaggatatggttgcttctgaaaggccaacactgagaaagcctgcacaagggacctaggttcctttcacataaggccagggttaagagagtctggtgttagcccatatacttttcacagtgctggctgggtgcatctaccattgccttcatgagactggtaatgagctttcctgttaccttgtattgcatttcacttgccccatgggagctcatgttcacgttctctgagctgtgttccatacaaaagtcacttaagaaataacaaagttgtcctggaagacagtgattgctcctaatacagttgagaattctatgctttgtagccttagaccctttacaagcaaatagtagaaataaacgtcatggctaatgcacttcggtaatataaaaggtttctacaaggaaaatactgctaacagtaaactgtttatatatagaaaagataaatcataatggagtggtaatttcagtttattttgtatctcattgtgtctctccttggggaactccaagtgctctaaagacactatctcattactattttgagtacctctgaaaaatatgcagaaagcattttctccaatttttgtttaaggatctaagtcacggaatttatgcagcttttcagtggatgaaagtggattactccttttcacagagaggattgtttcagtgaatggctgattgtctggtaagattagtcacccaatttaagaaaaacaaaaaaagaacactgtccccaacaaaaacaaataagcaaacaaaaaataccctgttaatctatttcaatacatgttttggcaacattttgtagacttgtttgaacgtcataaatacagccaggaacagaatgtgtttttctgactttatctgctaagtaaccaaccacattgttaggtgaaagttgttgataagtaagatgaaatttttaagaaaaaaattaggagacttgaggtttccagataaatgtgtaaaacagtgggaatggagctgcttttttctgttttctgctatctcagtgaggccaaccctaatcaatgacatatcaacatccctaacagagcataatctctgcatccagaaacaatgaatgaagaatggtagatcacttccttagagtttctaaggaaattgtaacagagcctactaactctttcaggcatgtgactccctaaagcacctacctcttcatgcatagctggagggtttgatgttgctgcttctctgcccacctttcccacagcgttcctgcttccccaatttcctgccttgactcagttgaatagattcaggaattacttaagttgcagcatagttctggaagatgctagtgcttgtcttcttggttgatccttttgggtaaattctttgtagaacaacttaactcatctttattaccagatataataacccatattttattgctcttaattttatgtataaccaaacatcctgttttttttttaaccgtctttcaaagagaaaatgtttttgagctactatgtactgtgaatgctgatctctggctaataattaggaaaggtaatgtgcctgttatttttggtcagttttattgcattgaccttactcctttcaataaatatttcagtggtggaaaaagagatatttgaaccgtaaattctacattagtgttttgttaaatcgttctacataggcactagttttcagctacaaagtgattagaaaatattcgttgtatttggtcattaatgaactgtttcaaagcgaatcaagaccaagctcaagcatccatcaccatttcttttccatgactgacttacaatagaaatctacagatgttaatcaccaagatacttttcctgatttgtaaaacctgagaaagttgggcattctcttatggctgctttaatttgcatatttccatatagtgtaaagcctaacagaagccaagaaattgcttaattatttgctgatcttgaatacagcccaaatgttgcttgaaatgtctatgcaattgtcttctctgcatgatcacctactaagtctgctccatgactcctccttcacatctactgatagtcagattttcttctgtttgtatcaagatttcatgtgatttatcacatttttttactttaaaacattataattgagtaatatttgttttagcttatgtagctatttcctatcactttacaaaggtctttgttaggttgtaaatttttttaactacacaagccattagatgtgtacatactcttacatctttcttgttctttccataaaacgtgtcctatctgatgcacaaggatgatattaaggtgaaagctttttatcatctaattttcattttactttcacagtcagactggattttcaatatatttttgttataaaaaactattacatatctcttgtctactttaggcatcattccacctattcctgtataacaggaaatgcgaataggcctctcactagcttagatgatgttctataagagagaagacaagatcagttatttttatatttctaaacacatttgagactggttaaaagaatataaagctatcttttggcttaatattctttattgatagatcagataaagtagaaaactgagaaatagcaaaaatttatgtttttgaatttcttaaccttcaaaaatatttcaaaatttataaactttgaatttatttgtagcttgctaacatcatgtcctgaaaactaacaatatagctgtagatataatgttgattattagaatttataagatttttagtataacttcaaatattttaaatattcttctttgcttcctattgaagagaaagcaagctcaggcatgagtatctcttttagttgaagatctcttgcctgtttgtgttgtgtgcagcctaattaattccattgaaaagaatacttaccatattcactgtattcaggtaagaatgctatttctttgtgtgtgtatttttttgggggggtctcaatttctttactgtgataaaatatgaataatataacatttgttactttaataattgttgaatgtacaattcaatggcattaagttcattcacatttttgtgcatttatcactactctctatgtcaagaaatttttcatctttctaaactgaaactctggattcataatacaataattcccctgccacctttcccccagcttttaataagcactattctactttatctgtataacttgatgattctaggtgcttcacatcagtggaattctacaaatcatacaatcattttgtatctggcttatttcacttagcataatgttttcaagggtcatttttgttgtaggatgtatcagaattttttctttttaaggctgaattatatttgtgtgtgtgtgagtgtgtgtgtgtgtgtgtgtgtgtgtgtgcgcgcacgtgtgtgatgatttggctatgtccccaccgatatctcatcttgaattcccacaagttgtaggaggcactgggtgggaggtaattgaataattgggggaggtctttcctgtgctgttctcatgatagtgagtaagtctcatgagacatgatggctttgtgaggcagagcttccctgcaaaagctctctttttttttgcctggtaacaaccacgtaagaaatgacttgcccttccttgccttctaccatgattgtgaggctttcccaggcacatggaactataagtccaattaaacctctttctttctcaggtatgtctttatcagcagcatgaaaacagactaatacaataaattggtaccagtagagtggggtgttgttgaaaagatacacaaaaatatggaagatattatggaactgggtaacatgcaggggctggaacggtttggagtgctcagatgatgttaaggtgaaagctttttattatgtaattttcattttactttcacagtcagacttgattttcaatatatttttgttataaaaaagtattacatatctctgaaatttggaacttcctagagacttgtggaatggctttggcgaaaattctaatagttatatgaacaataaggtccaggctgaggtggtctcagatggagatgaggaatttgttgagaactggagttaaaggtgactcttgttatgttttagcaaagagactggcagcattttgtccctgccctagagatctgtggaactttgaaatttggagagatgatttagggtatctggtggaagaaatttttaagcagcaaagcatttaagaggtgacttgggtgctgttaaaggcattcagttttaaaagttttaaaagggtaacagagcataaaagtttggaaaatttgcagcctgacaatgtgatagaaaagaaaatcccattttctggtgagaaatttaagctggctgcagaaatgagcataaataatgagaagcctaatgttaatcaccaaggcaatggggaaaatgcctccagggcatgtcagaggtcttcagacaaggcagcacccctcatcacacaccgagaggcctagtagaaaagcatggttttatgggtcagaccatgagtccccaagctgtatgcattctagggacttggtgccctgtgtccaggctactctagccatgactaaaagggccaaggtacagctcaggccatggcttcagagggtgcaagcccgagccttggcagcttctatgtggtgttgagccttcaggtgcacagaagtaaaaaattgaggtttgggaacctctgcttagatttcagaggatgtatggaaacacctggacatccaggcagaagtttgctgtaggggcagggctttcatggagaatctctgctagggcagtgcagaagggaaatgtgggatcagagcccccgcacacagagtctttactggggcactgcctagtggagctgtgagaagagggccattgtcctccagacctcagaatggtagattcaccaacagcttgcaccgtgtgacctcttgcttcagcgtgacctggatgtgagatacggagtcaaaggagatcattttgcagctttacgatgtgaccgttgtatctaggaagtaacttacttgctttttatttacaggctcataagcagaagggacttgccatgtctcagatgagactttgtactgtagacttttgagttaatgctgaaatgagttaagacttcgggggactttggagttaatggtgaaatgagttaagactttgggggactgttgggaaggcatgattggttttaaaatgtgaggacatgagatttgggaggggctagagatgaaataatatggtttggctgtgcccccacccaaatctcatctccagttcccacatgttgtgggaggtactgatgggaggtaattgaatcatagggggaggtctttcccgtgctgttcttgtgatagtgaataagtctcatgagatctgatggctttataaggcagagtttctctgcacaagctctctttttttgcctgctgccattcatgtgagacatgacttactcttctttatcttccaccatgattgtgaggcttccccagccacatggaactataagtttaattaaatgtctttctcttgtaaattgcccagtctctggtatgtctttattagcagcgtgaaagtggactaatactgtgtgtgtgtgtgtctatatgtgtgcacgtgcacgcatgtgtgtgtatacaggcatacctcagagatattgcaggttttgctccagaccactacaataaagcaaattttgcaatacagtgagtcaaggaatttttttttgttctctcatgcatataaaagttatgtttacactatgctgtagtctattcaatgtgcaatagcatcatatctgaaaacaatgtaaatatcttttgaatactttattgcttaaaattgctaataattatatcagcattcagtaagtcataatctttttgctggttgcggctcttgccttgatattgatagctgctcattcatcagggtggtgggtgttaaaggttgtggtggctgtgtaaatttcttaaaataaaacaatgatgatctttgtcacatcagctgactcctcctttcacaaaagatttctctgtaacctgcaatgctgtttgatagcatttcatccacagcagaacacctttaaaaatggaatcaaccctttcaaaacctgccaccgccttattaactaaattgaggtaatattccaaatcctctgctgtcatttcatcaatgttcacagcatcttcaccaggaatagattacatctcaaaaaaaagaaaaaaaacactttctttgctcatccataaaaaaacactcctcatccattcaagttttgtcatgtgattgcagcaattcagtcatctcttcaggctccgcttgtagttctaattctcttgctgtgtccaccacatctgcagttacttcctctactgaaatcttgaactgctcaaagtcatccatgatggttagaatcaacttattctaaactcctattaatgtagatattttgatcttctcttatgaatcacacacgttcttgatagcatctagaatggtgaatcttttctggaaggtattcaatttaccttgctcacatccatcagaggaatgactatctgtagcaactatagccttacaaaatgtcttacttcaataataagacttgaaagtgcaaattactttttgatccatgagctgcagaatgaatgtttgtgttagtgggcatcaaatggcattaatcttgtagagatccaccagagaaacaggatgaccaaatatgctgtcaatgagcagaaatattatgaaataaatcttttttctgagtagaaaaaaaatcctggacttaaaatatataaaaccatgctgtaaaaagttgtgttgcattccaggatttgttcttccacatatagagcacaagcaaagcagatttaccataattcttagtggctctagcattttcggaatggtaaaggtgcattggcttcaacttataggtgctttagcctataacaagagaggcggcctgtcattgaaagctttagagccagattttgacttttactctctaactatgaaagtcctagtatttcttatctttatccaataaaaggcaatagaaggttccttatgctacattgaaaatgtgttgtttaatgtagtctatcaatgatcttaactagatctcctggattacttgctgtgcttctacattatcacttgctgcttcaccttgcaattttatgttatgtagatggctcctaatgaaccaacctctgctagctgctgacttttcttctgcagattccttacctccctcagccttcatagaattgaagtgagttatggccttgctctagattgggcttttgtttaagggaatgttgtggctggttgatcttcaatgtaaaactttcttgttatcagcaataggcttttttgcttttttgtcattcatgtgttcattgtaggagaacttttaattttcttcaataatttttttttacactaacagcttggctaagtgtttgataaagagacctggcattcaatctatgtcagctttcaatatgccttcttcaatgagcttaatcatttctagcttttgattaaaaatgagagaaatgcaactcttcttttcatttgaacccttagaggacattgtaggattattaattggcctaatttcaatattgttatatccccaggaataggagggccaaaggagaggaggggagatggggaacagcctgtcagtggagcagagagaacacacagcacttatggattaagttggccatcttagatgagtacagttcatgtcatcccaaaacaattacaatagtaacatcaaagatcactgattaaagatcaccataacaaatataataataattaaaacatttaaatattgcaagagttaccaaaatgtgacagagagagaagtgagcgcatgcttttggagtaattgggctaatacccttggtcaacacaggattgccacagatattccatttgttaaaaaagacaccttctgtgaagtataataaagtgaagcacaataaagtgtggtatcttgttcatatatgtgtgtgtattccattttttattgatatattcatcaatggacatttgggtaatgctcaccttttggttattgtatataatgctgttatgaacattagtgctcaagcatctgttcaagtccttactttcaattcttttgggaatatgcctagacatggtattgctggattacatggtaattctatgtttaacttttttgaggaatcaccatattgtcttttgcaatagctttaccactttatattcctaccagcaatgtccaagagttccaatttttccacatcttgccaacactcatcttctgtttttctctttttaagtaaagaattttaagtgccaaaaacaatatatgggagatttgtaagtatattttttttctaggaattttgaccacagcaatatctaggaggggacttccaaaagctcctgaaataatagaattgaaagataaaaaaagaaaaaatatataataataataataataataactgtatttctcaacataaacttcatcaagttcaagatagttttgtaaacaatgataccagacatttattccatccctaaagaattgagggtcctgagaatgtaaccatgtcaatgctatcttttttacattattaatggaagaaaaacaagtgcctttaaagatttttttaagattaagaaacaaagcagtagccagaggagccaaatcaggactgtaaagtgtatgcctaatgatttcccatcaaaactcttgcaaaattgcctttattggatgataggactgagacggagcattgtcctaaaaaaaaagaaggattctctggtgaaggtttcttcagggtttcttttttgtttgtttgttttttgttgttttttgttttatttttcttttgttgttgttgttgttgtttgtttttgctaaagatttggctaaatttctcaaagcactcttacaataagaacatattattgttctttgaccatccagaaagtcaacaaacaaaatgccttgaacattccaaataccattgccatgacctttgctcttggcagatgtggttttgcttcaagtgacttcctcctcttggtatccattgctttgattgtgctttgtcttcaggattgtaccagtaaagctatgtttcatctcctattataattcttggagtaaattttcaggatcttgatcccacttgtttaaaatttccattaaaagctctactgttgcctgtggcttgcctgggcacaatggttctggcacccattcagtggaaagttagttcaactttttcagtcagaattgggttgagatgtttatgatgttggctatttttttgtgctattaattcttagttctcttcagttagaatactgatgttaccaggaattctgggttgagatgtattatttaactgaggacatccacagaactggagcattggaccagcaatctcagtttttgtgatagtgaacaaagaattgcaaactaacaccaaaatgcaagttcaaagcagagtttattgaagcactgtaatatactctcagagggagagcagacctatttctgtgaagtgaaatcagcccctctttacaaaactcagaggactttcatggaggttttgtgggaggagttgaggtttgggctatgtgtgagtgacaagatgaagtcatttgattggcagtttacggatacatagctaaaattaaactgtacatgtttttacccataatttgttaagaaaagccaagttggagggtgggggggttggtaaagccacatgtaaattttattataacgatggtataatgagcttgggatgaacttgaggacacagttctgtgttaggggatttccacctgtgccctagtttctccttctccaggacatgttggacacagattttattacaaactccatcctttaggatggatggagttagggaagttctggggctgaatttagatgagctatgggctgtcttagtgataacctttttgttctcttttcttacccgctcccagcttctaatatctatctaactacctaacactaacaaaattatatttttaaagacatagatgtggatgatctgccactttgggattcatcttcaacatcaacttatcctttttaaaatgaattatctatttgtaaagtgcttatttctttagagcattttccccaaaaacttttttaagacataaatgatttcacattcttccactaatcttcaccataaatttgatgtttgttcttgctttagttttagcagaattcaatttgttctgataggaactctcttcaaattgatgtcttattctttttagtgtctcaaactagattctgttcagaaatgctataacaagtaagtatgagtttatttaggtacaaaaatgtttaaaatgtatgcatagttttttcataatatgcatttttcatgaactttttgaaaaccccttgtatcacattctcttcccattattctaacatgggctggtggcaatagccttaaattaatgctggtataaaagtcaaaccaagtagctatattctctccaataatattagctacatcttattacacccgtctccttttctaaaaagtgtctagtcataattactcctactgaatgaaaaaaagtagatatttatttgtgtaaattcttataatacagtatttatgaaacctccacaattctccaaaagcagagaatatacatttgaattcatttaaagaaacaaaacaatttcaatttgattcagatagatcacataaacttaatcccctctttatatttttctttattttcaatggatcctataacatatatatgtcatttctattttgagaaaaaagtcatacaaatagtcgtaagctttaagatctggattaatatgcattattttattttaaagtaatgagtaggtgaaagtcagtgttatctagcatggaatttgatcttattctgctctttcaaaaaagaaattacaactgtaagtaacatattttaagaagactattagccaggcatagaaagaaaaatattgaatgatcttagctatatagagaattagaaaaagtggaactaataggaatgcagactagaaaatggttatcagaggcggggaagggtgatggacaaggaaaagggagatgttgatcaaaaggtataaggtttcagttagacaggagaaataagatttagtgatctattatgcaacatggtgactagaagaaataataaggtagatttcaaaattgctaacataatagattttaaatgttttcactaaaaattaagtatatgagttaatgaatttgttaattagcttgatttaatcatccaacattataaacatatatcaaaatgtcacattgtatcctatgaatatatacaattattatttgccaattaaaaataaaatttaggctgggtgcctataatcccaagcatgttaggaggccaggagttggagctcaggagttatagtccaccttgggccaaatggagaaactccatctctatagaaaatataaaaattagctgggtgtgatggtgcattcctgtagtcccagctacttgagaggttgagatgggaggattgcttaagcttgggaagtggaggttgcagtgagccatgtttttgtcattgcactccagcctgggtgacagagtgagactctgtctcaaataaaatttaatttaattcaaaaaaacgaaaataaatgatataaactacaacaaataagactgacatctaaaatgacaatataattttaataaatcaaattacacttaattatatatttaatagtttaaaaaatattgccaattaactgacaactgaaaagcagagaaggagccattattcatagataacagatgggcacatttaaagattcaggagtagaaccatagctatttcttgataagacaataatataaacagtaaggggcttttccacaaatgaaggcactatcttaaaatagagatattttaaacatgaggttttgattgctttaatgacctaatgcattcatacatttaaaatttacttaatatctactatgtgtccagtactgtgctaggcaagagcagactcaaacaattctttggttttctaattcaggtattattcaattctttacagccatcatatttttatttaagaaatggcttgtactacctaaactaattgtaaccttaaatgaagtaacaacttataatcaatttaatacattcattgactaattccacaaacatatacttatttcccactctggaccagaccttatgctccatgttagtgagcaggtatgatgcttttccctccctaaatagttcagagacatttcattataattgattctggatcagtgcactaatccagaggataaatcctcttttttcatttttggttagttatataaagcttaggataaggaatttaaaaaaaagctatttcttaacctttaaagacacaagagattttctatttattttctcaattctgtgctgcattagctaatctcaaaaactttctggcatgataccaaaatgaactgagatcttcagcatgctttgaatcagtctccaaataaagagatcattgagcttccaaatgatgttgaaactcattatcctccaacagggaagcattaagccattatcccctggaaacattattactatgaaacatctgcaaacatcagtacatggtcagagattgatgagatccacttttttgtaggtttaaatatattcaaaagatgaagaaaatcaatgaacatttataagtaatgagagaaaaaagatcttatagcttaagcccattttgtaggatgtagtaatgtacccataaaactacagaattacttataagcctattaggatgtgacattaatctaaatgtggggataatgaacatagctatagaaattgacaatcaggaatttgtaagagtgaatgcattgaaattatgagccatctaaatgaaataaattggaaatcaacaatggatataattgacaagctggaagtagcttccctgttagaggtcttgtagacttatggaaataaaataaagtcattcaaatattaatagtcaatttttcttcctaaaatctttcagataaatagaaaactctcaaaatgatcaaccttgaaatatttcagaagttctttcagctttcctaaaactaaggaaatcaaaatattcagaataactgtaaatgagatagaactgtattctgtggctcagtcgaattaggataaaaagaactttatgtaaattaaattaagatattaaaaattaataagataattggccaggtgtgttggttcatgcctgtaatctgagtacttcgggaggctgagacggggtagattgcttgagctcagaagttcaagaccagcatgggcaatatggcaaaaccctgtctctacaaaaaataacagaaattagctgggcatggttgtttgcacctgttaatcccaactacttgggaggtcaaaatgggaatgatcacttaagcctgggaagtgcgggttgcatgagccaagattgcgccactgcaccatagtctgttgcagtgagaccctgtctcaaaaaacaaacaaaaaaaccccagagtgagaccttgtatcaaaaaataggataatcaggtatatatatatatatatatttaatgtttaaaatattaacattaatatacatttagtgtaataataaacattaatatacatttaatgtttaaaaagtacaggaccacaaagtgattctgtgagcagtccttaaaaacatctgtcatattacagctacgctgtgagtatgtttcaaaatgttgaacaattatcacctgaatctttaacccaggtattggagagcaatgaccagatccctattggctttgttggcaattaaaaggatggtaaagatttcttttctcatcttaaaattgtgtttgctttcctattagcaagtattaacataatataaaaagtgatctaatattacagatcaaggtgtcaaaattgttttcatgttgaattaaatcattgttttaaattattgaatgtagaaactagcaattattacattatttcacatacacagaacaagaaaaaatgtagagtatagagcagtggtccccatgccctgggctgctaccagtctgttgcctgttaggaaccaggccatacagcaggaggtgagccatgagcgagaaatcttcatctttatttacagctactctgcatggctcacattaccacctgagctctgccacctgtcagatcagcagcagaattagattctcataggagaacgaaccctattgtgaactgtgcatgcgaggaagctaggttgtgcgttccttatgagaatctaatgtctgatgatctgtcactgtctcccatcacccccagatgggaccatctagttgcaggaaaacacgctcagggctcccaccaattctacaatatgctgagttgtataattatttcattatatattacaatgaaatatataatagaaataaagtgcaccataaatataatgcatttgattcatcccgaaagcatcccttgccctgtctgtggaaaaattgtctttcatgaaaccaatccctggtgccaaaaaggttagggaccacctacataggctgtgcttaggagtcattttgatatagatgaatatgccagctctgctattttttatacctgtaatctgagacaaatctattaaactttctaaatttaaatgttctcatctgcacaaggtatataatatctatatcttaggattgttatatatggttacttcttataaaatacttagtagaccacctcacacatagtactcttccaaaattattagctattattagtgattattatttaatcatattagttactagtgaaagtgtttgcagtgtgtatggtataactgtggcttccagatacttgtagcatacagatagcaaataagagtatttgagcaggaaaggaaagagaaataggcaaggcattcattctcttggaaaattccatgtcattctatttgcattttacatttaactatctctgcttgaaacacagaaaaatgtcacttatactatttgaagttattctaaaataatgttatgtatttaaaaatattaatacaagtagttgaacaaaataaagctaatttgaaaattaaatcaatattatctctaaagatataaaaatcccagatttacccaggaaaacttctgctattgaaatgtagtcacttaagaggtttgtgaacagaatttttaaaaatcccagtccacaaaccatcatgtcagagagacaatacctagaaaatctaataaattatgttgtattgactacatctgctgaatagtcccttatgtgaattcattcaatctattccattctttgatgaatatccttgttctaaaaaaagtctcaatttttatttcttttctttctattattggctgaaagaagctagccataaacaatcaggtccacagctgcctatgagaattatgaggctctttcagagttattgggaaactccctgagttgctgccctgcagacttaggctgattttttgcttttggctccttatcttgtcactcaatagaagaaggcatcagaaggttaccaccaagctgaaactgaaatagtctccactgaccccatggcatgaacctttcattttgttctctgggatgggtcacatcttatttgtccattgtaaatttgtagtgtctattcactgaattccctttcagtattttaaatcaatttctcaggggcttcctaggaaaacaagcacaaaagaacagaatttgagatgccactcatgaacttacttgtcttgtctttgcaagtaggatccagtccaaataaaggtacaaagccttggtcaagaatttcagttttttaaaccttatataaagaaactcacaaatctgtcattcccttaagttaattatagttaccctatgtttgccagccttatagtgtatataaaattggttataaattaacattacaaataaagttattattttacttctttgaaagtaattaattgatacatagtgaattaatatgcacaggcagttttatttcatcaactattctattgcaaaaataccaagtcacttttcaaatcttaatgttagaatagtcattatctaaaacttgagataagagtttcattacttaacatatagtgaaaaagaattcttaattctattttcattgtaagtacttaatctctgagatttcacccttccaaaatttcccacattcctgacccaatgaagcaaatggtgatccccattttggcataccagattggcaggagcaagaggcttttgcagggattcctaaaattacatgaagtcattactgatatttgcccagtaggtacttatttcacatattcactgttgacagttggactcaactactggtctcctttaggactagacttgattccactctcattggtccatatctgtgccatgataattgttaattttgaatgcagtagtctacccccactatccatggtttcagttacttgcagtcaaccttgatccaaaaatattaagcagaaaatatcagaaataaacaattcatgttttaaattccacgccattttcaggagtgtgatgaaatcctgcattgtcccactccatccctttcagtcatgaatcattctgttacctggcctattcagctgtatttactatttgcccaggagtcaggagccatctaggttactagattgaaaaagcctaggagatacagagttcggtaccatccgagattttaggtattcactaggagtcttggaatatatgcccctaggataaggggaagctactgtaatatgtattgttgccccactagaaaacctgatgctatgttgaggcccaggaagctacaaatgtatatgcacacgcattatttctctttcagattctagtgagtgcacttagagagaaaagcattgtcttgttagaaaaagcatgggcctgggaatttgtcatcctggcctccagacgcatttttgcattaattaaatttctgcccttaggtagatcatttaaccctgtctgcattccatttcatctggaaagtgtgaaagttttaagtgtatataaaagatttaagatttatagagaggatatatgtccatctaatatgcttttcatttaaaaattatatttccattttgggtcattgctaagtagaagagatgcagttgaaaaatgaaatgcttacctatcagtggacaaaatgagaaatgttgaaaaaagtccaaatgaagagtgagagacgctggaggggaaggaaagacagagagcttggctgaggctttctaagaggccagtccttcccagagagcatggtaggctctttggatggtatacagatattgtgaggcctttagttatcatttgacgagtttctacttcagtaattagtgcacagtttaagcacttaaataactgaactcttgtgcttaaggtgtaattagtctgaagagcaaaggaaatattattaaaaataagattgactttgtacatcagaactattaatagtacagctcctattgcatatgatgtagtaggtgctttagaaaggaaagaaagtttagatgtaagagatctggaaatcaaacggttagattataaaatataaatttaaaggcagcataatcaattaaatatatccaaccatcactaaatctgaaatttggaatactacaattgactcctcttctagcaatttaaggaaacaaaatgtggtatataatggccattgaacatttatcattattagtaaagtctgaacaggaattgtattgcttttattttattagaaactttttgatgccatttatatttattcactcaacaataatctgatctagcattaacgtcatcatcctcccatccccatatgattttgagacatattgtacaatctagaaataacactggtaaacattgaaaacacctgtaatcacttcatgacttaatcatcaacgtagaattgaactcacagaaaataatttgtttcactgagaagagagaccatggatgttgtccatgattattgccattaaatttcatcattcattatgtgtttctggctacagaatgataaatgaatttactgtgaaatgtaaaactgctacatattcaggaatataaaataaaatgtggctgagaataagcatctaagtaaacttcttcagatctcctgaaaaaaaaaaataattttcctgaaagtgagtggcacagccccataagccaaatttaaagaaccttttgttaggctctttaacatggcaatggtatgatgttgggggaagaggggatacatgaaaattcacactcataggctatgatctacctcctaggcaggaactactgtctgagggtcacatgataagatacctaagtgggtttgtttattggtttccctgttttagtcttgtatgggtgtggaatattattgaatgttgggcttttttggcatcaatttttataatcttttgttcttgttttttctctgtctctattttgtatgtgttaacatatgaatagaactagcagaactatcagtgttaaactaccctggtgttcctgtgattaacccaactgggatattatgcagtattatttatatggatttggcttaccatcttttgcttagaatttttccatctattttaagtgagataagagagctaagttttaaaaatatttcatagcaaatagtcaagtaatgtttcagactactgcatggttttttctttttttttttgtatttgtatacatttatggggaagaggtatgatttagtttccctgaaactacctatttgctttgcaaaaattttcttcttactgtggagagatattttaggaactaataggtctttttaaggaaacagttgtcagaagtttagaaaatttttcagcttcagtttttttctattaaattcaattaaaattaaaacatttttattaaaaaatgtgtatgaatgtgtcccatttttcaattcattatgcattctatctgaacatatgcagaaagaggtgtctaaataatgtttgtacattattatgatctttatgtttcagttttaggtgattcaaaattttatttagtcatttctagttcataaatttatgtcataatcatacatggttttatcagcaaagaaagctgtaattctttttaaaataaaatatatagttacctgttttcttgcctttaacatcaatgttgaggcaatgtgcctcaatattttctttttctacaattaagtctaaattattatcactgcaaattgacatctttgtgcataacctgcgcatatgctgggctgatgttccaacgacaagcacccttagggtctgaaggctagggtctgcttgagatccatgaccatctgttctgattggcctttgcccctgccacctttgtctttaaacatttgggctgtcatccacaggtgtatgaaagaaaatattaactaaacttaaatgtcataaatctttgtaaataaagattataaaataatattattataaactaagactcaaaagcaaatactatattttatttttcaccatcagcatgaaaataatgtgtgaactaagagttcatttattatttgcttgtttgaaacctgaggaaaactgaccagatgacctcgctcatagttctagcagaatgaggcaatgaggaggggtaaaaaaagaatcatgaggaaaaatgacttgagttccagatttgaaaccaacagaggtcacccaaaggaaagaagaagaagctatcaattaccatagcaagatgttgattctgagttggctctcagatcttcccgtctccctgctcctttcttgtggcagtcagggaccggtgaatctgcttctttttctgatgctggtactttaacactactactaatgatgatgatgatgataataataataataataataataataataataatttttgctctattttctttttctgaatagacgtttacttttgtaccttacccaagagcaaaaatgaatttccgaagcctggttattagtctctagagatataataaggtttttcactactagcaataatagcaaagaaaaatttaacatttctaggtatcataagacaagtggtcacgatgaaaactggaatcagacctaggaccagttctgtggaaaagtagaatcactttctcacatcagattttactttctagttctttgcttgcttctacttgtatctctcctctgagactgttctattgaaggtcttcagttatatcaatgcaagaattaagtatatacacctttcagcttttgactgaaattatttcatttctctaggcacttgagacagtagcctattctgttatctgtgaaaggttcttcatagatgctgagacaacttctctcatttctttccgttttgaccattcactcagatgcttctttgcttatatgctgtagccttccccatcaccttttaaaaattattctgttcagaatatgtaaggaacacaaacaaatccataggaaaaaatctaataatccaatcaaaaaatgggcagaagttttaaatggatatttctcaaaagaagacatacaaatggcaaacaggcatatgaaaatgtgctcaacatcattgattataataaaaatgcaagttaaaactacagtgagatatcatctcaccagttaaaatggcttatatccaaaacacaggcaataacaaatgctagtaaagatgtatagaaaagggaacacttatacaccactggtgagaatgtcaattagtacatccactatagaggacagtttggagtttcctcaaaaaaccaaaattagagctaccatatgatccagcaatccctctgctgggtatcagtatatcagagagatatctgtatttccatgttggttgcagcactgtttacaatagccaacatttggaagcaacctgtctccataaacagatgaatggataaagaaaatgtggtacttacacacaatggagtactattcagccataaaaaacaatgagatcctgtcatttgcaacaacatggatggaactggagatcattatgttaagtgaaataagctacccacagaaagacaaacatcacatgttctcacttatttgtaggatctaaaaatcaaagcaattgacctcatggacataatgagtaaaaggatggttaccagaggctagggagagtaatggggggctgggagggaaaagtcgggatggttaatgtgtaccaaacaaatagtaagagagaatgaataagacctactatttgatagcacatcagagtaaatatagtcaataatcaatatacatttaaaaataactacaatagtataaatatacatttaaaaaatcctgtaattgtgttacaggattttttgtaacacaaaggataaatgcttgagaggatggatacccatttcccatgatgcgattattacatattacatgcctatatgaaaaatgtgatatgctccatcaatgtatgtaccaactatgtacacaaaaaattaaaaattaaaaaatattctatttaaaaaatccatatatcttattgtatgtttcttctagagtcaccggctccaccctgatgctttcaaaaactacctatttgttgataaattgtttcagatttctctcttggggtttataactgttaatatctactcagtttttggtttgatatcactggctggctgctgcatgttacttcacactggataaatccaacagagccattttatcatccaacaagaaaaaaggagttagctcagatttttccctttgctgaatgttccactttcgaacagcctctaattttataaatgatatgatttctcatccataatatctcatctttcacctaaaaacccatgctgttctcttcgctcaacatcttaccatctctctcacctggataattgcaatggactcctacctggtctctcagcttcaaaccttatatcctcagatctgtcctgtactctgctgtcagtaaggcttctaaaacacaaaactaataattttgttctctttcattgttttggtccattttctcctgaatcaggtatgtatcatggcaaatgggggcccttcattatctggctctgtgccttcctttcactctgtcccgccttgcagtttgaacttcaagcaccctgaattcttaccagttttcggaagataacaaactctgttgagttgttgtgtctttatatcattgcccattctattatctttctctagaatgccttcctctcaataggaacatttgctttttttcttcccagcactttgtttaaatattgtcttttctaaaaaattccttgaccacccctttcttcctccttccttctctctctttcttctttctttctttctctttctttcccttgctttccctttctctcccttcctaccttccctcctctgtctctctctctttccttccttcctttccttctttctttctttctttctctctttcctttctttctttctttctttctttctttctttctttctttctttctttctttctctctttctctctttcctttctttctttctctctttctctctttccttctttccttctttcatggagtttcactcttgttgcccaggctggagtgcagtggcacaatcttggctccccacaacctccacctcccaggttcaagcaattctcctgcctcagcctcccgagtagctgggattacagccatgagccatcacacctggcaaattttttgtatttttagtagagacggggtttctccatgttggtctggctgatctcaaactcccgacctctggtgatccacctgccttgggctcccaaagtgctgggattacaggcctgagccactgcacctggccgaccacctctttctcagaaggaatttactcagctttatttcagtgttacttccattgtaacgtttgtgtacatcaatactgcagtcctaataattcactttacaactacaacatggaaataatatagaactctgaaaattgctgggagtgtaaaatgagataagtatgtgaaaatgccaggaacatagcaggtgctcagaaaagcatgaacttttttttttctatctatatatttacagaaactgactatctctggagcaatttttgttatttttattggtttctctaattaaatggttgcttttgcaccatttctctaatgcaaaaatttaaaaatatattttattttgaagtgtctgtatgtttggaagataatgacagaattgtgaatgctggcgcctagatatacaaagaacaacacctatcaaggtgtttcttacatttctttttcaaagatggcaattactgaatatttaattgctgcattaagaaagattcggaacttgataaccagtgagggaggaaggaggagggagaaggagttgtggggtctacccttttcgcttatctcttcctttccaacacacctgccacttgaaatcaccctcatttactcgagactgccacagatgcaggagaaatagtaagaaaatcttttttggtacaggctctctattggtgatactgtttatatttaagtcagcagtaaaataagatttgcttaaaacaaatgcctagggtagcttcctgtgaatatgggatacatttaggttggacatagttaggttcaatatttctcttattctgtaaagtcactttaaaccaaaatcatgttatctgaaatataaattaattaacacatcctatttaacaaaagaaaatgtcaaggtctcctaagctaattagtgattcatctttctcaactatcatttttcatccacaattagagagaaagcttttgattgttgtagctatcatttttctttttataagttgtaaaacatgtactaggacacatctttggtgaacatattgtcatctaccaatataatggcacattattttttttcatcaaaatgataaagtcttttgatgaacatattctttgattttataaaagtgatcaggtttccagtccagtgactgcaattttaaagggattcattaaacacagtggactaattatcttgagcagtcatctttctctgagttttgaaaagccagtccaaaagtgaattttattatagagttattacagagaaagatctgtaagtacacatccaaatcttttctagtgtctagttcaaatgtttttccatcttttttttggtttgtgcacacttatttagagaaggtaaaagacaggtcaggtgtgtgactgtgacctgtactagaattctctgccaggaaagcagttttgatttgaaaaattgctttcaaaaaagtctgaaaataagtaattgaaactaaagtggaaaatgtactgaaagttaataccgtaagttgagcaaataatttcttgctcaaatatacttggtttaatgactcacagcataaaatacaattattgtaaagtaatagcctattcttctaatgttttggaatatgtatgttaatttcaggaagcctcataagcgctgttttttttcatggcaatgaaaccaacttaaccctaaccttaaattggggcttaacaaaaggatgcatctcaacaatctcataacatgattctggtttgaatcactttcttggctctggcctcaaactctcttcagctccagattctggttcaaacatctactaaatgttctgaagttcttcaatgaaaaagatttgtcactgactttcttatcttcttaatgcaaacatcagactgcattctctttaaattaatggcactgccctccgtataatcttcccagctaaaattctcagagtgctctttagtcctcttcctcccttagccctccacacccattccctgaccatatcccgttagcttcatctctgaaatacttctcagatcattttctcttttccggtctcaggaccattgtgtcaattcctgctcccaccttctctgaccttgattattgctcttgttttctaactggtgtatctgcttcacccttacctaatttatttttattttaactgccaccaacttaatggaatagaatacaaatcttcttcatcttgcttaaatacctagtttttctcgatgaattatagtttatactcattaaagtatgtaagttagtgtatgaccccaaactattttcctaagggcatctcctgcacttcttacttctctttccagcccaacttttcatcctccaggtctttgcacaaactttctttctattaaaaattcccttttgtgacttgacttgtacctttctttacctatcacattgatagtcattttaagacagttaaaatgttccatttattaagatccccccaaaaattgaacctctctctattgtgaacctcatcaatagtttgagaaaatatttttcatatcatataatacagagattgtccccaaacttggtaattcccagaataacttgaggaattttaaacaactgaatttcacatgcctagattccactataaatttctgagttattattctgaagatgaggtcctacaggctccctagtaccttgagaggagtgaatttactaagtcatctctctattctcaatctcctggatgattctttgtacaaaaaagtatcttaatgagtagttgcaaaataaaagatgaactaattagttatttagtttttcattcaaatctacaagctcattctgccctactctccatcctaaatctggggtaggttgggctagtgtctactgaaacttgacgagggtatttggagatcctttggctcacagacctctgtagtgttaaagagaccctgttaaagtgaattgagcaagggctttagaaatagaactggattcatgcttggctttactttttttagtactatgatcttggacacattacctaatcaggctgagccccagttacttcacatgtaaaatggtgattagattaaatgctacagagaagagagcagggagaattaagttaaaggagatggtgaaggtaaagcatggaacagagtgggcatgtatcatatggaggttcctattacaacaaatctttagtcattttcactaacttcatgagttaacatctgataatagttcatcaatgaactctttcttccaatatttaacacattaaatctgtaactataggcacagaattttgctcaccaatttgaaataagatacacagctctcactcaattatcattcaagaggaaaacatcaagggtaaaataactccgcatctatggtctacagtcctgctttcgtctagggaaggttaaagaatgaagaccaatttaggggatataaaatatttgggaaagtctttggacacctatcctttgtacaaggccactggaacactttctgagctcccaaaggaaagaagagtccactcacactaatatgtggtgtagagatacgtctagctgagcgatgatataagaacatttgtgtatgatggaatgatgttgcagcatttatatctactcatcactctctcttaatcttgatagacttgaacaatagtaattccaaggtaagccatatcatttagaatattccattgttaaacatacttcagaggaagttattaattgataattaattattctattttaatttggccaagaaaacctatcattttggcaactgtactttgagaccatgcttcacatgatatttttgtttacactctacatctgtgcctgtgtgcaataaatcaggctcaatagtgtctttcctgtcacattccatcatgtcacactaataaaatttgacatgctcagggatgtggcgatgaataaccgtatgtgatgacaccttggggaatgcttaaaaatgatgctctgtgatggtttcaaaaccttatgtatacttccaagttgtctaagtaaccttaactaaatacattgttccagccatgaaaagatcaatttagttctttagcaccaatgtcactaaacgaaattaacatttaagctgattagtaatcactaaataacacaggatcataaaatagagtacacctaatatttcaaaaaagctctaccatatttcatgtgaatgagcagaccaaagctgtaagacactgataaggaaaaacaaagacatttatcataggtttaaaataataaccatttgggacttttgtggttgttattatcttctttattattatatctcctaaaatagtcattatttctataactactaatctggcttctgaactaaatcccctcttcatgctaagaacatcatatcatctagtctttgtcaacattctgcgtcattattcccatttactagttgactaaacagagactgaagaaatggaattaacaagctgaaattcacatagctgataagtagcagaattaaaactagaattcagatattttgtgctgtgtccaaacactgcaatttccagatccttccagtctcttgtgccccttggagctgaacattttcccaggacaccatatccttgtgggactccaaccacctttcctggagagattgccttgtggttaggattctcttcaccaagagaagaagggctagagatctctatctgagaactgagagctgactcctacaactgtgcagagaaacctccgcagcctgtgaaagcacactgggcaagcctactctgattagtagcacattatgatttctgaagtaaagcagtctctaaaacccagcaggatgcatctagaggaagtcctctttacactcttcttgaacttatatatactagatttggtgctaagctttgaaaatgaagccaacagaacattacctatgttacatgatctcaatagtctacagttttatattaaaaaccacttccccattggaataaactaatccacatgaaataatggcttatgtaatataaactattcctgattttactactatttaacttggaagtggtgaaagtggaatatatactgtagactattgagatcatgtcacccaggtaatgttctgttggcttcattttatatgtatcttttacagagatggggtttcattatgttacccagactggtctcaaagtcctgggctcaagcgatcctcccaccttagcctcccaaagtgctggaattacaaggcatgaaccaccacacctggccttaataggcaagtttttgtaaagaatttcttgctttttatggagaattggtaaaatatcctaatatctggttaaagttgacattatatattccagtttggataaatattatcaaaacattcactcatatgtttgttatttgtaatactttttctgatctagaaaatgcaatatcatagtgatttttaggggtagtttctgtagcaatatgagatagtaaattttatccacatttattatatatgatttgtcataaacagcatgttgataatgatctacacagataatgaatgagtaatgtgatgaataagaggaacatatttaggatttgtcatatgatatgtcatctttgaaaagctaataatattcttcactctctagtttaagattagtatctgtatatttcagtctgtagcatgtggacaacatcccttttcaggggcggggggaagtcttattgaatgggaatataatttgctacagctggtcaccattttttaacaagtatagatacacatctccctagcccactttcttttactttttttaaaaacattcaattccccaatgagttctgaagatttatcatgatttcatctcataaacaaatacaaaactttaaatattgggattgaaaatgactatgaagataccatctaactgtgtagtttttccaaatgcattttatctgtctaaccaaagtcaaattcctaaatagcttttgacccaaaaatagaatctagaaaaatatagttcatttgttgattcaatgcaatgtaaggtagatctgaaataaaattcccaattgtttgggaaaataatcctaatacttctcatttactaatacctttaattttgttcctaaagtgaaaccacagctaccagcaaaagcatttgttgggttgaactttttttttttaataggttgggcatctttttatatttatgggctttaaatattcttttattattattattattatactttaagttttagggtacatgtgcacaatgtgcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgaattctcatattcactatgagtgagaatatgtggtgttcggttttttgttcttccgatagtttactgagaatgatgatttccaatttcatccatgtccctacaaaggacatgaactcatcattttttatggctgcatagaattccatggtgtatatgtgccacattttcttaatccagaacttttatagttaaagccacagatttttttagaaagttcttaatcaaaatggtaaagataaagccaagtttggtattgagtaaacacatgggaacatattttcagtattgtttaaagacatgatggagagtgttaccagtaagtaacattatcatcaagaataataaaaaccacggattttgtacctattgtgtccctatgccaaccaccaaaataagagcttcatgtaaaagctttatagttaaagctcagtattttttaacttacaagttttgtttgttgaatgtcactttttgaattgtgaaaccttgtttctgttattcctttcttcttttgattttttggtgggggtgagaagtaaagggcttaatttatcaattttttgccttcagaacagataaattattaaagaatcagccaaatgcaatggcttattatgtgttttatgaaaaataggagagttaactctaatgtttccatttcatttagtgttatctttttttcctttgcttatctgtttgatttctatcacttctgggttatcagtaataagtctagtcaaaagcagttataacggaaacagcattggtcacttttagcaaaaaaaaatgtatttttaataatttatgaattttcaatgactaaagttgaagtggatagtagagcagtgtgttgaacctatacctgcttcataaacattttctgcatagatcttcagttgaaaagagacaataattctaaatgcaggtgtcgtcctttaaatgaattagatctattttcctcttctctccctttcttcttatttccttccccttttcatttttcttcctttgtttctttcttcttcctctcctccctccattccttcccactagataggttggcaaatataagctgatatttttacgcaagggaatgaccatttttacattttgttagtttgaaaggatttttttttctacacctaaattactatctctcaaataatgcttcttcaagcattcttcaagggttttaaaatgtaccaccgaaaatactcattttgttataaaatgagctttgataacactacatattctactatagaataaccttattagcatgtaagtgactcctagaattactatattaagaaaacctgatcaaaaatacccctttcttgactattaccatcttgtgaagtgtcacaagatgtcctatgtgtccaggacagtaatttgagaaacactaaactcagccaattgtagttatacatcaggacccatatgttctcacaagtgccttgtttctttttattttgaaagaaactatcgtggaaaactggggggaaagtcagtaaataaacttaggtggattggtattttgtaaagcaatcaaaatgctagacaattctgtgtcggttgccatagaatgaatggtcagctcacagggagaagaactcaggagtttacatgaagctcttattttgatggttggcacagggacacaataggtacaaaatccgtggtttttattattcttgatgataatgttacttactgataacactgtccaccatgtctttaaacaatactgaaaatatgttcccatgtgtttactcaataccaaacttagctttatctttaccattttgattaagaactttctaaaatttcttctttcatgttgtaatcatataatttggatgtattagatacacagcataacattatgttgctgtctgaagcattaaaataatatctgtaaacttttagatatcagtaccattgtctctaggctaaataatgagattaaggataataatagcacaaatgtatttggtgttttttatttgtcttgctctataccatatattttacatatgttgtgttatttaatcctcagaacagccatatgaggcacatgtcatttcaaggtatacatttctgtgttactttaaaatatgaagaaaatgtgattcattaagagataataacttacccattatcacaaggctgttgcgtagaactttcgggattcaaatcttggtctatcatattcagagctggtgttccaaactgattattctgcttcatgctacaactgtatggctaaaaaaagaaatcaatttgacttttgtagtgcttttctgccattcttacagtctgaaattttaagcataattggggtattacatttaccactcagctatctctgaatttcaagtgttctgctgatgagacatgaactatacagatggtgatatgtctggggtttatacaaaagatagaggatacacaaagaatgacttcagaaggtgatatatgcaagcaggttaaattgaattgatgaataaaatgataaaattgtatttcacaaaaaagaaaaacataagaaaattgcaaagcagaatgggagaaaccaagaacaaatgagaaagcttttttggcacatttgtcaaaaaatgtatatatgaataattttttggaaggcagaatcccttaagataggagttttagcatgtaacttaagggaagacatatgtgcaaacccatgtcatgctaaaattaataaacacactgtacgtaaaattaaatgtctttatatacacagtctgtaaagaactcctgcacttcaaacggaagatttggtttaaagagtgtgattatgaagtactgtatctagtttagactccgggaaccagaattaaaaggcaacttcaacttggttcaacttttcttaggaactaggaagtaaaacaagccaaacatacaattatgctgttagatgctttcagaaaagaaatgagagagtttctaaacagaatcactgcatctcaatgttgacctattgtatatcataccatgtgtttgttatcagaatgtgttttgggaaagttttacaaaacattttaatttataccttgaaaatgacattttatttgtatataagttttatattactggtggctattttctgttaaagaaataatttcagaatgtcaccatattttccacaattgtgaaaaagactttctagattggtgtcctgtcccctggcgtccacaaatgcaatgccttcaagttagactgcttagtgtgcaattattttattgaatattcatttttatgcattgggattccaacataaagtgaattcctgtgcttcaagaaaatatagaacttaatcaccaagttgtacatttaacctttgagcaatgtgggagttaggggcaccaaacccctgcacagtcgaaaatccaggtataattttaaaacgtaactactaataacctgctgttgacaggaagttttaccaataacaatatattaacacatattttatatgttatgtgtatcacatactgtattcatacaataaagtgagctaggaaaaatgttagtaagaagatcataaggaaatactctagtatatttatcaacaccttaagtttgtgttgtctgtttgcaagacgaattgtctgtctgcaatagtaggcaaccacagctgcagactttaatccatggtacatatcaagcaattcaactttttcttgtaatatcatgacttttctctgatttttgagagtactttgagcatcactactggtgctttatgtaagtcccatagcgttatttaaggtttatggtattgcactaaacatgacgaaaagtatgtgaaaagtggaaagatcactttttacttccatacacaatttattggagagatgaacttcccaagtggagatgattaacagattcttgtaatatttgagctcaccacaatagtagtaggagagggttatgaaattattacagcagtatgtacgtaccacagttatgttttatccagttatgaattaatactgcatctttacatttggttatatttctctggactgaatggtaccaggtagggtcggtatttgtgtgaatgagttttcataaattttaactttttataatagatttgtgtatattttaaatgataaaatagactaattttttgcattttttaatgcatttatgacatacctttttcctttttatatatattcttagactatgtggtttgtctgctagtttttttgaattgccacaaatttccaaagaactttccagtatatttctagaaaataattcatgtatgggaggctgagatgggtggatcacctgaggtcaagagttcgagaccagcctggccaacatggtgaaactctgtctctgctaaaaattaaaaaaaaaaaaattagccgggcgtggtggcaggtgtctgtaatctcagctacttgggaggctgaggcaggagaattgctggaacccgggaggtggaggttgcagtgagccacgatcgtgccattgcattccactccgggccgaaaacagcaagacagtgtcttataaataaataaataaataaataaataatccctgtataagtgaactctcgcagttcaaactagtgttgttcaggagtcaactgtattttgaacaaagcaaccaattcttgaaaaatgaagttggaatataagcagggtgtactttctataacgcttttaaaggattgtgaacaattgggaaaatagtttctagaattaatgatttttataaggagaataaaagaaaaatactgcagtaaaaatgtcttagagtttgaactctgtgtattccagctcaggtgaaactgcaaattatggtagctattattaaactaagctaaaatctcaaacagaaaaatgagaggtccaaatggtgattgttaagttatataacttgtcataaagttccttattatataagtaacctcatcttttattatatcttaaatggaaactaaagaaaccacaaaataagaccttctgtggcaatagcagtaaagcaaaataatcattaaagcatagatatgaagatttaataatatcatacaatatctatttcaacagaaatagtacattgtagttgactttaagtaccaataatatatatttaagcttgtttctattcaatgaaatgattagggacactaactgtcttgttagcaaagaaagccttatccacagagaaaagaaaataactatcccagtactctttctcagaacgggcatttttcttctgtatttctctttgtagcctttatagtatttataaactgattatcataagctttttcagtagtaactcctgttaagaaaacacaaatcaatggtactaaaataacttaaagctacatgaagtctttttagtgtgtttgtgcatatgtgtgtgtactgtgtgtgtgtatatatatatatctatatatgtagatatatatacaaactgttccactgcattattttagcatatctgtgagctaaactgaaggagggaaaaagtaaaaggattcagctgtagttgtactaagatacttaatttttatttattttaggtgtttaagagcaaactttatatttcttgctgtgtgcctcaaaagtcctaatgggcaatgaaaacctttctagctaatgctattaggacttgtggtcagttggttagtaaaaagtaaccccttaaagcttaaagaaattgtaagatgatacacacagagctaaccattttaacttaagactatccctgaatcccttgtagtagagctgaatactttttttttttttttttttttttgcacgggcctgctcatgctcaaagtggagttgcacattgtcttttcttgcataaaacatatccttattcatcaacaataactactaatttgggttcttcaaagtacagtgagaacttaattgatacttgtgaagctatattgttacaggccagtctttgttcttggagctcccaagatgggggcgggccactcccaagatggcaggaagccttttgttctctgacctggggttcttggcctcacagattccaaggaatggaaccttgggccatgtggtgagtgttatagctctattagaagccatgggtcaaagaagagaaccgtggaacccagtgactagtgttcagctcaatcaggacgaacccgggcacttagccttgcaggaacaattgcgaacctttagctggattgggagcacagtggacaccctgccccatccggaggagtgaaagtcaatggcaggtctgtgatggtggggaacagcagtggtggacagtgaacgaaacctcagctcgagctggaacaaacacggacctgaacagtgtacacttgcaagatttaatagagtgaaaacagagctcccataggggacccaagggggttgccactcgcggctcgaatgcctgagatttatatcccaatcattgtccctccacctgtgctctcaggcaatatatgatttgactatttctttacctcctgcttttagcctaatttgtattttagtgagccctctttactacctgattggtcgggtgtgagctgagttacaagccctgtgtttaaagttaggtgtggtcaccttccccagctaggcttaggaattcttagtcggcctaggaaatccagctagtcctgtctctcaataggaatgtaaaatctttctagatttatactatttcttcaatagtctaaggtcattgttctcatacataattcgataatatctattcctgagcctttcgaaagcactgaacctagttttcatagaaatagctctttcatttcaaaaatattttatcagtaaaaaaatattcaattaacttatataattagaagtaacaagtataactgccacaaacaggttggggaagaaatatatattcttataagcatacaggtttggatggtgggaagtcaagtgctcaagtgcccaaggatggtatacctgtcacctcatccgagctctagatactatggtttacagagaaataagaagctattggtaagcctgcaagtcagttatttagtgataagttaagagagattttactgaaaaatttcgaaggccttggataaaataagaaaccaacttttaatacacttcaaatatacttcaacattctgtttggacacttagaccccagactgtgcagatctgtggaatagttatttagaaggcatgcatttactgattttaaaatgaagtcactaaacactttattttctttgataaattttgtatgaaaacacatttcaagttgaaattgggtatgaccagaaatccaaaattttactattcatttcaaaatagggaaaaatggatattttatctcatttaggccacagtgatactttaagttttatgtcatggcccaaattgatttacctaaccaatgaaagtgtcaatccattgcctttgtagatgcagaaactacggccttgttctttgcaatagtaaacacaaatgacaaactgcttctagacctccctgagcatgggtaaatctttgttaataaacctatgaaatgtgaaaaagtaaaggtttctttcttttagtttatatctggagtgagctgggaatattgaagttgagggagttgtagggagaagtattggacagtctacccccttcagtagaaggatttgtgagtctccagtagaatcaagctttgtaacacaatctcttactgaggctgaattttttcttgttttcttgttgccttttatgtgcttgtttatttggttttccctgaggtccttgccttggtggtaggtttgtaaagaaaaagtcacataatccccattatattgtttgaagcaaaagagaacactcagctctgcttcaacactttctcccctacaggtgccaccaccagcagcacactgccaatgggctttcccaagttatctctgttctgccttcacacttcgcagatgggtttcctctgcttcaacaatactttgctcattcagaaacccaaccatttttttactcatctttcacctctcagccccaaaacaaacatctcctggccttgcattatttacccagaaaaatctggcatgatcaaatcctgggcttattcttggtaggattaacactatggaacaaaatgcaccaggaaaaaaagtgtttatatgaatgaccaataaggctggtctgcctctagccttaactgaactgtggtttccggtcaatttataacatgtggttatggtgtgaatttctatttaaaaatgcaacaacagcagtaataaattatttggggttcaaagtattcattagggcatttatgtctattaccttatttgttccttgtagtaactcaatgaagtaggcacaaataatgctgctgctgcttcttcttcttcttcttcttcttcttcttcttcttcttcttcttcttcttcttcttcttcttcttcttcctcctcttcctcttcttcctcttcttcctcttcttcctcttcttcttcttcttcttcttctccttctccttctccttctccttcttcttcttcttcgacagagtcttcctctgtcacccaggctggagtgcagtggcgctgtcttagctcactgcaatctctgcctcccgggttcaagcatttcttctgcctcagcctccggagtagctgggactacaaccttgtgccaccacacctggctaatttttgtagttttagtagaaaatgggtttcaccatgttggccaggctggtctcgaactcctgacctcaagtgatccgcctgccttggcctcccaaagtgctgggattacaggtgtgatccccatgtgtgggcagctccatatttttatagattaagagactagggctttgggggattaatttgttcaaattccaatagctagtgttggcaaatgtgatccgagcctggatcatcttattttgaagtctgagatcttaatcctgaaagacattgctgtctctaattaataattgagttattttagacttgggggaactctgagatgccaaacaataggattttgaaatcacaaaaggatctatttgaaatatagtccctgacacttacagaaattgacttgttgtataattgacctaaagtaaggggtgactggcaaaagatgtcatggtctcatcaaaccctgtagctgaaagggcactttgagttcatggcactatataataaaatcagacaaaggaaggaagcataataagttgtgaactagtaactatgacactcagagaccaattgaagaaacagagaacattctagaatatctggatgaggatttagaatatgtcatttgatttgtaaaatatgactttttgacaacattcaagagaatagttcaagcaaaagatggaagagggcaccagtttgcagtagtaaaagagtaaatgggaagtgagaaaatgacagcagttagtataatctacctttcaaaatgtttagcaagatatcctagttaagcaattcagttaagcaaaaatgttgagagtgattgtggctatgtcggtcaagttaatctatacacaggaggtcatttaccatactccttgttgattcttctcgcctatgaaattattttcttttgccttgtcaagtgttttactaactgtacagccactttttctccttcctgaatacagtaaactaaaaatttctttctgacatgttttatagcaatgtaacaaatttaatgttcttaatatacccttgtagaacttgaaaattgaaatataggtatttataaataaccagagtttattatggttaagcaaaattcagggaattgtatctcacttataatttgaaatttaaatcatttgaatcttcgttttctccatctcattttgaagtaataaaacatgatcttagctttggaattggtctttgactagaataaaaatttaagtaaacattttgatccactagtagtgtatatttcattctcacctccctcaaaaggaataaactttaataagtagagctaattatatcacagtgcttggtgaaaacgcattcaacagaaggtaaggagtatagtatgtctagtggtaccaaagaaaaccagggctttgagagacgataattcaaggcaatgattacaatttgaggctgctgcatgggccctcctggggtatgaattaatcctttgaacctttctgtttcacattatttaacaaaggacctaaaattaatggtaatacctctttgactcaaaaagttaatccctgactatgtgaaacatgtgtctggctctccttataaagttagattcaacattatgagcttttattattttataatccagcctacaccattccacaataagttcctctcttctctgtatttattaattgttatagaggtagctgtttttttatatttacctgaattttaatatttgagtaatttaaataagttaaattattttagattttagaatatcacataagtatgaaaataattatgttaaatctatacatcaaatatttaataaagctgatcctatgtgtaccctatgactcagcaatcccactttagaaaacaagttaaagaatatttattgcagttttgttcaatttagtttcaaactagaattaacctgaatgtgcttcaagaatgaaatggataaataaatagtgctatatttctaaaatagaatactgtatcagagtgaaatgaataaaatattgtcacaggcggtcatatgaatggctctgaaaaccataaatgtgagcaaaagaaaccagacacatatgctgatgaatccacctgttatctgtcttctgtctatccatccatttatcatccatccatttatccatccatccatccatccatcatctagctgtatatctaatcaacacaagcaaaattggcctatagtgggatgaaaagttagagtagtgattcttatgatgaaaagggactgtgacacagcatgatggatattacagaactctaacaatattctatttatcttttttaatgttcaaatgatatttttatttatatttttaatttttacaggtacttagtaggtatatatatttatggggtatgtgagatattttgttacaggcattcaatgtgtagtaattacatcagggtaagtaaggatccatcgcctcaagcatttatcatttctttgtgttacagacattccgattatactgttttagttcttttaaaatgtataagagatcaatgttgaatgtacacaactttttgtgctatcaagtactaggtcttatttattccatctaactatatacttttctgcccattaacaatctccacttactctcatcccaccactcactacccttcccagcctctggtaaccatccttctactctccatctccctgagtttaattgttttaatttttggctcccacaaatgagtgagagcatgcaaaatttgtttttgtgtgccttatttatttcacttaatatattctacagttccatctatgttgttgaaaatgacaggatgtcatccctttccttttttatggctgaatagtactccattgtgcatatgtaccacattttctttatctctctgttgatggacacacaagttaattccaaattttgcttactgtgaatagtgctgcaataaacatgggagtataggtatctcttcaacatactcatttactttcttctgggtatatacttaaaagttagattgctggatcttatggtagttctatttttgcttttttgaggaacctccatagtactctccatagtagctgtactaatttacatacccaccaacagggtatgagggtttccttttccatatctttgccaacatttgttattgcctgtcttttgtataaaaaacacataactagggtgacattataactcattttagttttgatttgcattcctatgatgttcaaggatgtagagtgcctttttacatacctgtatgccatgtttatgtctacttttgagaaatgtctattcagatattttgccaatttttaaattgaaacattatttttctattgagttgtttgagctccttatatattctacttattaaattcttgtcagatggatagtttgcaaatattttccctcattttgtgcattgtttcttcactttgttgattgtttcctttgccatgcagaagctttttaagttgatgtgatcttatttatccatgtttgctttggttgcctgtgctcaataaatctttgcccagactaatgacctggagagtttccccaaagttttcttttcatatttttatggttggaggtcttaatttaagtctttaattcattttgttttgattttttcatatgatgagcaataggggcctagttttattcttctgcatatggatatccaattttctcagcaccatttattgaagactgtcctttccctaatgtatgttcttggcacctttgtcgaaaatgagttcattgtagatgtagggatatttttttccgggtgctccattctatttcattggtctatgtgtttttatgtcagtaccatgctcttttggttgctatatttcagtaagataatttgaagctaggtaatgtgattcttccagttttgttctttttgctcaggatagctttggctattctagctctgtgattccatatacattttaggatgactgttgctatttctgtgaagaagttcattggtattttggcagggatgcattcaatgtgtagattgcttttggtagtatgcacattttaacaatattaactcttccaatccatgagcataaaatatcttttcactttctgtgtccttttcaatatttttcatcaatattttataatttttattgtagcaatctttcacttatttggttaaatgtattcctaggtattttattttgtttatagcttttgtaaattagattactttcttgatttctttttcatattgttcacatttaaatgctaccaatttttctataatgactttgtatccagcatctttaatgaatttgttgattagttctaatagtttctggtagattacttagatttttcccaaatataagatcatatcatctgaaaacaaggataatttgacttcctatcaagtttggaggctctcaatttctttctcatgtctaattgctctaattaggacttccagtatgatgttgaataacagtgctgaaagtgagcctccatgttgtgctctagatcttagaggaaaggctttcagtttctccccattcatgataccatgaatgggtatcatggtatatgggtgtatggtctgtatatgggtctgtcatatacagcttttattgtgtagaggtatgttcattccatacccagttttttgagggatttgtttttaatcatgaagagaggttgaattttatgaaatgtcttgtcagtatcagttgaagtgatcatatgattgtgtttttcattctgttgatatgatgtagcacattgactgacttgcatatgttaaaccatctttgcgtgattggaataaatctcacttggtcatgatgaatgatctttttaatgtgttgttgaatttatttttaaaaaatatttttttgaggatttttgcatcagtgtttatcagaaatattggcctgtggttttctttcttttcttttttttctttctttctttctttctttttttttttttttttcatgtttccttgcctggttttggtattagggtaatactagcctcactgaacaagtttggaagtatttcatttttctctattttttggaatagtttgagtaggattggtattagttctttaaaagtttggtgtaattcagctgtgaagttatatgatcccaagtttttccttggtgggagactttttattacagccttgatctcattatttgttattcatcttctcaggttttgaatatcttcatggttcaatcttggtaggttgtatgtatgtagaatttggccatttcttctaggttttcaaattaactggcatatagttgctcatagtagtctgtaatgattatttgaatttctgtggcattagttgtaatatctcctttttcctgtctgattttatttacttcagtcttctcctttttttgttagtctggctaagcttttgtttattttgcttatcttttcaagaagaaacttcatttcattgatattttgtattttttgttcgaatttatttctgctctgatttatattttctctactaattttgggaatagtttgcttttgcttttttagttatttaagatgcatcattaggttgtttatttgaagtttatcttcttttttgacataagcacttatagctaaaacataaactttcctcttagtactaccttagctgtatctcacaggtattggtgtgttgtgttttcattttcatttaagacactttaaaaatttttcttcttaatttcttcattggctcactggtcttttagaagcatattgttcaattaccatgcgtttgtatagtttctgaagttcctcttgttactgatttgtagttttattcccttgtgattagatacttgatgtgatttccattttttcgaatgttttaatgctcgttttgtggccaaatatgttatatccttaagaattttacatgtgctgaggacaatgtgtattctgcagccattgaatgacatgttatatagacatctattaggtccatttggtcaatactgcagaataagtcttaggtttctttgttgattatctgtctaggtgatctgttcaatgatgaaaatggggtgttgaattctccagctattattgtgttgaggtctctctctttggctctaataatatttgctttatattggccaggtgcgttgctcacgcctgtaatcccagcacttttggaggccaaggcgggcggatcacgaggtcaagagaatggcatgaacctgggaggcagagcttacagtgagccgacacagcgccactgcactccagcctgggtgacagagcgagactctgtctcaaaaaaaaaaaagaacaaaaaacaaatatttgctttatgtttataattactatatcctcttgatgaattgacccctttatcaatatttaatgacatttttgtctccttttttgtttgttgtcttgaaatttattttatttgctataaatatagctgctcctgctttgtggcttctatttgcatgaagtatctttttctattctttcatttttagtctttgtgtgtctctataggtgaagtatatttcttgtaggcagcagattgttgggattgcatttcatccatttacatactctatgtcttttgattgggtagtttcatccatttacatttgaggttattatcgataagcaaggatttactcctgccattttttttttctggtggttttgtggtttcttttccttcctttcttccttccttcttataaaatttattttttatagtgctatattttaatttcttgatttttattttttgtgtatctgttgtagtttttaaaatttgagaggactatgaagcttgcaaattacttcttataacccatcattttaaactgatggtgacactgattgcaaaaacaaacaataaaacatgcaaagtgaaaactaataaaaactctacactttaacttcatctttccactttttgacttttgtttctttttgtgtcttattatactgtttatatcttgaaaagttgtcacagttattatttttgatcatttcatctttaagtctttctactcaagatatgagaagtttagataccacaattacggtgttataatattcatatttttctttgtgcttactattcccagtgagctttttgcatttaaaagatttcttattgcttattaacatctgtttctttcatattgaatagctctctttagcatttcctgcagaacaggtctcctgtttataaaatccttcaccttttgttcgtctgggaaagtctttatctctccttcatgtttgaaggatatttttctggaacaattgattctaagagaaaatattttttccttcagcatttaaaatatgtcatgccactctcctaacctgtaaggtttctattgataagtctgttgtcagatattttggaacttctttgtatgtatttgtttcttttgtcacttttaggattctttctttatccttggcctttgggagcttgattactaaatgttttgaggtagttttatttgggttaaatctgcatggtatttaataaccttcttgtacttggatattgatatctttctctaggtttgagaagttctctgttattatctctttgaataaactttctactccaatctctctacttccactgtaaggccaataacttagatttgcccttttgaggctacttcctacattcgtaggcatgttgaattcttttatattctttttttgtctcctccgactgtctttaagctcactatttctttcttctgttaaaaaaaaaatctgctattgagagactctgatgcattcttcagtatagcaattaaatttttcagctccagaatttggttgattttttaaaagtatttaaatctttctgttaaatttatctcatataattaattcctaatctgtggtatcttgaattttgtttaactttcttaaaacagctattttaacttatctgcctgaaaggtcacatatttctgacactccaggattagtcactggtgccttacttggtttgttttgtgaggtcatgattttctggatgatcttgatgcttgtgggtgttcatcaatgtgtgggcattgacgacttatgtatttgttgtcctcatcacagtctgggcttgtttgtacacgtgtttctttagaagactttccaaatattcaaagggaattgtgtgttgtgatctaagtttggtctctgcagccacatctgcattagagggtgccccaagcccagtaacactgtgactcttattgacttgtagagatacttccctggtcatcttggctactatcctggagaattacccagattatcattcagagtctcttgtcctcttcccttaccttttcctaaactaactgagtctctttctccatgctatcctgcctggagtttggggaggagtgaaacaggagtccctgtgtccaccacactgggaccatgctgggccagacttgacgtcagcacagtactgagtctcacccaaagcctgtgttgactattgcttagctaccattgagatttattcaaggtccaagggctctttagatagcagatggtaaagccagccagggttgtgtctttctctgcagggcaacaggttcctttctggcccagggttggtctagaaatgctgtctgatagctagggcctgaagtcaggaacattaggaatttacttggtgctttagtttgctgcagctgaacttatacccaaattgaaagactaagtcctttttactcttctgtttcctttcatcaagcagagtgagtcttgccccatgttcacgcccaccccaggccaatggtgggtactgcctgaatcctgataatgcatattcaagacccaagaaagaactgggtcctttctttcaaggcaatgggctccctcctggctcaaggtgtgtctagaaatgttgtccaagagctaagcctacaatgggggtttcaggactctgcttggtgctttattttactgtagctaagctgttatccaagttgtatgacaaagacttctttactcctctccttcctctgctcaagtggaagaaaatagtctctcctggaaatgttagctgcactgcctggggttagggaaagggtgatgcaagcactctcctggctgccctggctggtgtctcactaggtcatgtgccctgtgaacagaggacagcaccaagacttgcccaggaattgcattccttgtgatctagaatgccttttgtgtttatttaggacaccagagtgctttagcctgtggtaatgaggctaactggaactcaggttctgacaagtgagatggggagtcaccctctggctagtgctggcctgaatgctccctctgtgggtattggtctgaaatgggggccttaaaactctgcctggtaccctactctactgtggctgagctagtatccaagttgaaaggtaatgtcctccttattctcccctatcttttcctcaagtggaaggaaagagtctcttcctaaactgtgagctgcactatctagggttggggatggggtaacataagcactcccttggctgccccagttggtgtctcactgggttgtgtgaaccccaagtccactgactgcaagcccagcatggcaccaggacttgcctaggaattgcattccttgtggcttagacattctttcaaatttacgtaggaccccagcgcactttagcccatgttgacggggctagccataacttatgttctgacttctgggatggacaattcctctctggctagggctagtctaaatgctgccaccatgagtgcaggccaaattatgccttgtgttgcttgcgctataatagagcagcactgagttccaatgcaatgtcccacggtccctgcagtctcccttccccaagcacacagattatttcttcgtgccatgcagacacttctgcggaatgggggaggggtggtctccacaattcaagactgtctttcttcagtggctctttccttgatatcatgttaaaaccaggtactgtgattgctcaccttgttttcaattcttatgaagttattttttgtgaggatagttgctcaatttgctattcctataggggttaaaaatcactaaaggattctatttagccatcttgttttgcctactcccttaaagttctattgatcgggttgctggctataaggatgtgtttacttcatgaaaactcactgatcttatgatttgttcccttattgtgtataatttatgttgtaataaaatatgcactttaaaaaatttgtgtgctaagagcaacatcctaagagaccctttatataccagtttattctctattttgaaccagaccaatagaatgctttaatatttcaacctgtaatctttctgaattgacaactaattgaaatggaaactgcagcaaattaacattgagcagatgacatttaattcaaacagtatcaaataggaaattaccctttctttaaagtgctattacaaagaggtatgctacctaatcatagatattaaatcactaatttttattcattctgttttcaagaagcatagtattgtggatataatttatgcgtctaaaattgagatgccatgtaaaagacacttagagatatgttaaagcacttattccgaagactaagctaatttgaatttgaccttttcagcaatcaaaattctgctaatacagcatattttcctgttcataaaaagatatgtgacaatagaaaaatttagttcaatatatatcaaaacatggagagggaagactaacacagttgtagctactgtccttgataatcccatgataataaaaaccccattaatatttccctcttgctgttgaccaacactcttgagggaatgtgttttctaattaattatcagaagcacaattttgaaattacataaaagaagaacaattaagttcactttttcttgatgaccttgtacaaaataaacttgcccattactccagagaactcaaaaaggagctgagtttcttctctccattactgtaacagtaggtagtatagagctgtgcaatggttatggaaaattattattctctggaaattattagaattgaatggaatgtttttattgctgattcatatactctgatttgagcgccaatcatctgcttctgcacaggattgtactttggttacatctagagttactttgcccatttcttaggggaagatattttttcaaaaacatatatgagtgcattgcatgtctactctgcaccagaaaatttgttaaattctagcaagatactggaatgaatgcattatctgtgttttcaataaatttatactaaagacaaggcataaatgcaaggaagaaattaagaaattgatacaggttatatgtaaagaataaaatacaatgggggctcatgtctggtaaaaattagttttggcaaaagtgaccggagaaggctaataagttgagcctttcatgttggctaaaatataaacatgtggcaataggaggatagcattcctggaagaagagttagaacaaggtgcagtggagaaaaaaaatgggtattaatagtaataatgagtcataaaccttgacaggaacataagctatgtatgggagcaccctgaggaacagaccaaaaagtgtaccgaagccagatcctggagaaattaaacatttgtatgttgttcattagataagtgacctaaatggtattcattttatggtaattatatttaaattaaactagagagtaaaaaaaaagatcctaaaaacgccaaagaagtaatcgaatttggtctgttcatctatgcaggagaaaagtaaggataaatactgatattaaaaagtctgcaaaaatcattttcttttaaaaattatttgttctttctctcagggagaaatgctgtagatttctttccaatgtgcctaaacatttttccccttagcttcaaatactgcattcctaagtacatccacaagttcaggtagagcaaatcttagatgtgtataaaaagttgaatgattttaattttcaaataataccttcttttatggcacaatggctgtgacaagattagccagaatcacagcactcattttatgaagaaaaatatgaagtcagtgacagtcattttatttatgcgtctgtctgcacattcacgtctaaatccttctggcatttgaatatacagcttccaaattcaggatcttgtcgggaggcatgagtcattcagaatccagcagaaatgacaagcgctggaaaatctttttgtgggtccttaatttcagtcttttatagagttagcctttttataagctgatgtcactgtggaaccaagcaaacaccagtaaacaggcaaacagcttcttggctctctaacatgcaaaggctggtctggtctaagattagacatatggaggccggctccaaattaaatcagaatagaatgatggaatcatttagtttgtgatgtaaggagcccttagagatggcctacttgagcattgacactgtgcagacatgttgtggagtactatggacaaacttatggagtggtaggactgcaatctcacacacacatattttaatcaaagcaatgtcctctgatctgatctaatttaaatacatttctagattttcatctgatgaataattcagaaatctgcaaaccaagtccagcagcttatggaatccaggttctagattcatcttatagattatgcaacagttagaaaaagaataaatggcatgtgtaggatcacaggttatttcccctcagccttctcttagagaagaaaaaatggttaacaatgtagtctgtagtatttatgatagcgtaagttaactttaaatgtcagttctttctcttgttaagttctttatcagtttcgtgttcatgtgatttcatgctttctatttattaataataatttagtgcatatgtttctcttttatttaaggaatactcataattctctccctttactacagaaatggatttgatcactgatttctgttgtttctatcactctgtgttatctttatgcaagttattctatccaccttttatcatttttaggaagtgactcaagttactctagagagctatatttggaacaacccacaagttatgtatgaacttagataccaatttaatatccatattataattaacatatttgccaaaactaattgaaatgtacattttgacaaaaacgtgtatattcctatgggcaactagacagaatatttgactgttccagaaaatctgggagaaaattttaatatatttatgtggatttaacagtgacttggcttagacaggtcttaagtcaacagtgacttagctaatgacttagactgacaagtattgatcaatgataagtatccattattgaattatggactctaagggatacaaaataagtagcagaaagaatcttctcaattttacaaaataatgagcaaaataaagcatatttaaagatagcaattagagaatgatacacaaatgtaattacagcttaccatatatgtgaacagatcgatttcagaaagtgaaagagagtttgggacaaggagtccattaaacacatggctgaagctataaacttgatttggactttgaaggaaaaatgtagtttggatatagtacctaacacagaagtcttacgcatagaagatacaaaatatttcttgaagtaaacattcttccagagaagcaggaaaagcatggagtgaccatgaagtttcactgttcctataaaacagtgggaacagagagaacacccctgtgccatagtaactctgaaccttttctgtgtaccttagacttacccatttataaaacagttagtccagtaaatagtgaaagtgagagaaagttcgtcttcaagtctcaaagtaagctactaaaacgacgtattgaaaagacaggatctggtcgggcgcggtggctcatgcttgtaatccccgcactttgaaaggacgaggcaggtggatcaactgaggttgggagttagagacaagcctggccaacatggtgaaaacctgtcttactaaaaatacacaaattagccagatgtggtggcttctgcctgtaatcccagctacttgggaagctgaagcatgaaaatcgcgtgaatcctggagacggaggttgcagtgagccaaaatcacaccactgcactccagcctcagactactgactgcattccagcaacagactgagaccctgtctcaataagaaaaaaagaaaaaaaaaagacacaattttaaaaagttagtccttatataagacttagtgcatccaaaactgtggaagtcatgtagaataatacgttcttatattaaaatctattatggctgcacacagatattgacaggaaaaactgaccatttgaagttgatacttatatagtgaaaagttaactcttaggaagaaaaatatgaaaaattaacaatcagaaagaatatgtacatattatcaattttattagtgataaaataattttgtaaatagaaattataagaacaccatttatgcacaaataaaaagaaagtatttataaaacaaattatccctaacacaaatgagactatcttagaaatattatacacagtatagctaaaagactaattcctattctatctaaaaaaataaaataaaatggatgcatttttaaaagcaagtttgctctgacctacctaaaagttaggctttgggtgaataagaagatataacaccttttttattttgtatagaaaaagtctttgcttgtttgatatagtaagatttatatgatagtattttataagaactagccccatattagcagaaaaaaaggtgaaaacagaaagaaataaagcaatttctgtcatgtggccaaatgcatgtagccaaaactaaacacttaagtatgaatactttcagattttattttcccctgtatttgcattgcttttaagtgttactttttttttttacaatcttcttttgtatataaaagggcaaacaactttgttcgtgtctgaggaatagttcctggtaaaccctctttcagccacctggttttgaaataaatgactttcactccttctgcaatagtaatctgttcttgattttaaaaagatgtttagaaaaagaaaacaaaatacttgttcacctacatgagcctggagtaatatgatatagcagttgtgttgcatttttggggaactgagaaaatcatttttcttctgctcactttgaaaataataagagccctttgcaatgtaatctccctgaggaaacaacacggggacctccacaggcaaaccacttttctagcccctgcctttctaatctaaatctttccatcaatatctgatatattctgtcaaccttgatgactgtcttggaatgtaattccaaatttactctcagcattttatttgcaagagcacaaatatcagagtcctttgatttttttagagattggcttaatctttaacactagacttggaatgttgctatgtggggctctacatttgaaagcaaaacacttggcagggaattaactttagcccttagtggttggaattgaccccctcagtttccaaatctttttcttttgtttctaacatagaaactcatttaaatgaaagagaatatattttcttttgtacaaattttgatggatcatattctttctcaccagtcgattgcaaatgggaaagtacatcagtaaaatcattacattttagtcacttatcttgaatgagtagaaactaagggagctccaaacaaacaaaccatgcagaaaaccaaaataaagtaaaaacagtctgaacaagtggttttcacacattcaaactataattgtaaatcagatgtcttttggcacaaattattagattaaagaaatgtgggagatattaatgtgagacataaaatttactgtaatctcttcttgtgtcttggactttgtctgcagtggcaaagtttggagaagcaagtgagtattcattttttctactgagtaaatcattgtggaaactagtgagcctgaatattcagattcctttccctcgaattcttgtctcactttcatattttattgtcaaaaatattatattaactgacttctttttctcctcaaacataactttgacatgtaaggatcttgttccaaagtaacaaaagttaatgacactgtgttagagttcaaaagaaacttgtcaattaaccaaacccctcttttagaggtaggaaaattgtgaatgaaggaagtcatcacttctagctggtagtaaggccagatatagaccagaagtctccttgatctcctacctgaaaacaggacttataccacatttgcttgtgtgggttgggaaagtcatttgattgtgtttcattttactgtgtttctcagatactgcattttttttctttttttttacaaattgacaaattgaaggtttgtggcaatgccgcatcaaacaagtctacatgtgccattctcccgacagcctgtgctcacttcttgtctctgtgttacacttcggtaattcttacaatatttcaaaccctttcattattattctatttgttatgctgatccatgatcagtgatctttgatgtttatattgtaattgtttggaggcaccaagaaccatgttcatatagaactgtgaacttaaccaataaatgttgtaagtgttctgactgcttcactgagcagcagttcccctatctctctccttctccttggccctccctattccctgagacacaataatattgaaattacgtcgatttttaatcctgcaatgacctctaagtgtttaagaaataggaaagtcatagttctctcacttcaaagcaaaagctagaaattattaagcttagtcaggaaggcatggcaaaagctgagatatgctgaaagcgtggccacttgaatcaaacagttagcaaagttctgaatgcaaaggaaaagttttcaaagaaaattaacagtgctactccagtgaacacacgaatgatgaaaaagcaaaacagctttattgctaatatggagaaagtttgagtggactaaagagaagatcaaatcagtcacaacattcccttaagcaaaagcctaatccagagcaaggccttaactctctttaattctgtgaaagctaggagaggtgaggaagctgtagaagaaaagattgaagctaggagagggtagttcatgaggtttaaagaaagaagccatctctataacattaaagttacaaggtgatgatgtagaaactgcagcaagtgatccagaatatctagctaagatcactgatgaaggtggctataccaggcaaccggttttcaatggcagatgaaagaggcttctattggaagaagataccatatacaactttcatagctaaagagaagaattcctaacaggggataatgtggctggtgactttaagttgaagccagcattcatttaccattcagaaaatcccagactcttgataattatgctaaatctattctgactgtgctctataaatgcaacaacaaagcatggaagacaacacaacattttacatcatggcttactgaatactttaagcccactgttgagccctattactcagaaaaaaaaagattaatttcaaagtgtttctgcccattgacaatgtacctattcacccaagagctctgatgaagatgtataaggagactgttgacctaaaagaagaagccaaggcacaaaatataattttaggtagtttacttgaaccaagatgaggcagctgctcggaagcctcgatccaagtaaccttgtggtatgagccccatttggcctttgttacaagcaggtttttagaggcaaaaaagacaatgagcgggctgatacaaagttattttttaggaatcctcatcggtttacagaaatgacaatgattagtgattatctatacattgtgaactagagtgtatgggccacagtgtccagcatgtggcattcttaggttaatttacagctatttgtggtgacagtctagagtgcatacagcaagcagcttcaagcggggaagcagattgtgactgctgcctcattcccatttctctctgggactgataattccaaatggttggaattcctcagataaatttttttctttcttaaaattaatgtttttatgcttgctaacacaacatccactctgtagcctatgtaatttcaactatcaagccctactatttaatgaaatacatttcataaatttataatgccatagatagtgatttctttgatggatccgggaaaggtaaattgaacaccttctccaaagaattaattattctagatgccattaagaatattcatgtttcatagaaagaggttgaaatatcaatattaacagaagtttaaataagttgtttccagccctcataaacgactttgaggggttcaaaacttcagtggaggaaatcactgcagatatggttttaatagcaagaaaacagccaggcgcggtgacgaaaccctatctttactaaaaatacaaaaattagccgggcatagtggcgcacacctgtaatcccagctactcagtaggctgaggcaggataatcacttgaacctgggaagcagaggctgcagtgagccgagatcgtgccatttcactccagcctgggcaacaagagcaaaactccgtcttaaaaaaaaaaaaaaagcaagaaaactagaattaaaataggggcctgaagatatgactgaattattgtgatttcttaataaaattttaacagacaaggagttgcttcttatgaatgagcaaagaaagtggtttcttgacatgcctgaaatgaatctacttctggtgaaggtgctatgaacattgttcaaatgacaacaaataatttagaatattacataaacttagttgataacgcagctgcaggttttgagaggtttcactccaaattcgaaagaagttctactgtgggcaaactgctatcaaacagcactgcatgctccagaggaacttttcatgaaaggaagagtaaatcaaaattgtcaactgtattattatctaattttaagaaattgccacagataccccaacctttggcaatcaccaccctgatcagtcagcagaaatcaacatcaaggcaagaagaccctccctcagcaaaaagatttttactcgctgaaggctcagatgattgttagcattttttagcaataaaatattttaaaattatgccaggtaccttgctttatggaagtaatgctattgcacacataatagactataggatactgtaaatagaacttttatgtgcacaggaaaccaacaaatacatgtgacttgcttcattgcaatgtttgctttattttcagtgatctgcaactgaaccaatgatatctccgagttctgcctgtgttgcattttcttcatacgaatgaatttttaaagttatacattcgatttaggaaataaaaatgtttcctaaacagagaatctaaaacaaatacccaaactaaatagaaacaagtcttcaagaacaacataaattaaaaactagctatgtaaagtattcatataaaagacaaaattatcacatatatttaagaaaagtaaattttgaaattataaaataaatatttgtcaatatatttaatttccagcattcattatgaatctatgaaatatgcaaacaaggacaatatgattaatttcaatatgattgttgattagctcagcagcaactgataagtggccataaggtgcaagaaattatctttaataacacaaaattgccatctgaatgcttttaaggcctcataaaccctgatagagtgtaagaaatagcccacaaattattgagtttgctatcaactaaattctgaataactcatcaacttttaaggttatgactagagggtatcgattaactgtcttacccactgaagcagttgttataactttagcaatattttaatctctctgtaatgaatcatgaaatctatattttaaaaaagtatttgaatgacattcagtggtatttgcatcatgaaattaaacattcattaccaccaccataaagcaaaaataaaatttaccaccaggacaaacagcctgtatgaaaacggagaaaattaattgcctgaggacattatgtagaaagcagaaatgtcaaagtgtgataggtggcagagagagaaatgtaaactggatgttttagcagttcatcccgtaagaatagcttacatgttaaattatactttgcttacagaaaggtataatttacaaaaactatgaatataattttcattttttgaatgaaataagaaataattataaactctaaaaaaaattgatcctgttatgtatgagataatatctgtctagaacttttctaaaaatgggagcttaaggattcttattaggaggatgaaaaataaattagacttatcattaactgttaacagtttgttgagatataatacactacacatatttaaagtgcacagtttaaccagttgtgacaaatgtatgcatccatgcatcactaaaatcaagatagtttaatgtatctatcacccttgagagttatctaatgcctttttaaaattccttccttctctcttttcaccccctttacccctgtaccgcttctttcccttccacccctccctgagttcaaagtaccactgaaaacaagctaattacccatccacaggggaatggataaaaaacggtggtatgtccatacaatagaatgccattcaacaatggaaatgaagaactgatatgcacaaaatggattaaactaaaaaaaaaagctaagtgaagtcagacaaatatagtgcatgttctatgattccatttatataaaatcttatgaaatgcaaagtaacctatagcgacttattgtttttgaaactaccagatgtatattaccattaccatttatactgaaactattccagaaaattgggaaggaaggactcctacccaattcattctatgaggccatcatcattctgacaccatacctagcagggacacaacaaaaaaagaaaacttcaagccagtgtccatgatgaatatcaatgcaaacatcctcaacaaaatactagaaaaccaaatccagcagcacatcaaaaagcctatccaccatgatcaaatagtatttatcccaggatgcaaggttagttcaacattcataaataaataaacatgattaatcacataaacagaactacaaactaaccacatgattatctcaatagatgcagaaatggccttcaaaaaaattcaacatcctttcatgttaaaaactcaataaactaggtattgaaggaacatgccttaaaataataagagccatacatggcaaacccacagccaatatcatactgaatgggcaaaagctgggaacattcaccttgaaaactggcaaaagacagggatgccctctttcaccactcctattcagcatagtattggaagtcctggacagggaaatcaggcaagagaaagaaataaagggcttctaaacaggaagagaggaagtcaaaccatctttgtttgcaaataacatgatcctatatctagaaaaccctatcatctcagcccaaaagcttcgttttttttttttatagtctactttctatctttatttttttttattcgtattattatactttaagttttagggtacgtgtgcacaatgtgcaggttagttacacatgtatacatgtgccatgctggtgtgctgcacccattaactcgtcatttagcattaggtatacatcctaatgctatccctcacccctccccccaccccacaacagtccccagagtgtgatgttccccttcatgtgtccatttgttctcattgttcaattcccacctatgagtgataacatgttgtgtttggttttttgtccttgtgatagtttgctgagaatgatggtttccagcttcatccatgttcctacaaaggacatgaactcatcattttttatggctgcatagtattccatggtgtatatgtgccacgttttcttaatccagtctatcactgttggacatttgggttgattccaagtctttgctattgtgaatagtgccacaataaacatacgtgtgcatgtgtctttatagcagcatgatttatagtcctttgggtatatgcccagtaacgggatggctgggtcaaatggtatttctagttctagatccctgaggaatcgccacactgacttccacaatggttgaactagtttacagtcccaccaacagtgtaaaagagttcctttttctccacatcctctccagcacctgttgtttcctgactttttaatgattgccattctaactagtgtgagatggtatctcattgtggttttgatttgcatttctctgatggccagtgatggtgagcattttttcatatgttttttggctgcataaatgtcttcttttcagaagtgtctgttcttgtcctttgcccactttttgatggggttgtttgtttttttcttgtaaatttgtttgagttcattgtagattctggatattagccctttgtcggataagtaggttgcgaaaattttctcccattttgtaggttgcctgttcactctgatggtatttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgattttagatctaacatttaagtctttaatccatcttgaattaatttttgtataaggtgtaaggaagggatccagtttcagctttctatatatggctagccagttttcccagcatcatttattaaataaggaatcctttccccattgcttgtttttctcaggtttgtcaaagatcagatagttgtagatatgcggtgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttgcttccatatgaactttaaagtagttttttccaattctgtgaagaaagtcattggttgcttgatggggatggcattgaatctataaattaccttgggcagtatggccattttcatgatattgattcttcctacccatgagcatggaatgttcttccatttgtttgtatcctcttttatttccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaggggatgtgaaggacctcttcaaggagaactacaaaccaaaagcttcttaagctgataagaaacttcagcaaatcttaggatgcaaaatcaatgtgcaaaaatttctagcatttctatacacctacagtaggcaagcagagagccaaatcatgaaagaactcccattcacaattgcttaaaaaaaagaagaaaatacctagaaatataatttacaagagaagtgaaggacctcttgaaagagaactataaaccactgctcaaaaaatcagagaggacacaggcaaatggaaaattattccatgctcatgaataagaagaatcaacatcatgaaaatggccatactgcccaaagtaatttatagatttgaagctattcccattaaactaccatcgacattcttcacagaattagaaaaaactatcttagaattcatatggaaccaaaaaaagagcctgaatagccaatacaatcctaagtgtaaagaacaaagctggaggcaccacaccacctgacttcaaactatacttcaagactacaataaccaaaagagcatgataccagtattaaaacagacccataggccaatgaaatagaatagaaactttggaaataaggccacacacttaaaaccatctgatctttgacaacacgtagaccaatggaacagaatagagaattcggaaataagaccacacacctacaaccatgagatctttgacaaacctgacagtgataagcaatagggaaaggactcctatttaataaatggtgctgggaaagctggctagccatatgcagaaaattgtatctggaccccctccttacaccttatacaaaaattaactcgagatggattaaagacttaaatgtaaaacccaaaaccataaaaacccaggagaaaatctaggcaataacatctgacataggcagaggcaaagatttcatgagagagatgccaaaagcaattgcaacaaaagcaaaaattgacaaatgggatctaattaaactaaagagcttctgtatagcaaaagaaactatcatcagagtgaacagacaacctacaaaatgggagaacatttttgcaatctatccatccaaaaaagggtaatatccagcatctacaaggaacttaaacaaaataacaggaaaaaaaccctattaaaaaatgggcaaaggacatgaatagacacttctcaaaataagacatatgtacgatcaacaaacatatgaaaaaaagctcaacatcactgatcattataaaaatgcagatcaaatctacaatgagagagcatctcacgccaatcagaatggctattagtaaaaagtcaaaaaacaacagatgctggcaagtttgcagagaaataggaatgcttttacactgttggtgggagtgtaaattagttcaaccattatgggagactgtggtgattcctcaaagagctagtggcagaaatactatttgacccagcaatcttaatacctaggtgatgggatgatttgtgcagcaaaccactgtgtcacacatttacctatgtaacaatcctgcacatcctgcagagatagccctgaacttaaaataaaagctgaagaaaaaaaattatctttatatctttcaactactaacacctaaaacaaaacaaaacggaacagaacaaaaaggcctcagtgcctgactgcagcagttttaaaagtttttccagggacaatatgcgttgccacaaaaatctgacaggaagaaaataaaaagcagatgcaaaatatgtgaaaataaaagtgacactaccagctctgcctttgttgatggcttccttttgcaaattgtcttccactaagtaatgtagtctgcataaaaatcctttcatttttcttcctcttttcttccattggctgtttgattataatattttgtatatactataagagttttcatattatctacttttttgtaactgctacatgaaaataaaaagagaagcacttttgaaattttaattatgagaaaaccaggaatcttagatcttgattcaatctatgtcactcggttactcattagaatttatatttttctcttaacagcacgcttagattcttgatttttccttttcttgttataatagtatatgcacaggttagtggatttagatttagtttcgttatatagagttaaagatatctttagttaaagatagttgacatttttgtacactttagttttgaatactgaagaaatacctcatttctatgtgaataaattattcttcaattgagtagcaaattggatgcttagacattactaaaagttatttaaataatgacaccttattagtatgtttccacatacagatctggccattaaatattgatgagtagaacactgaccttagaatgtccaagttttcatgaaaatattcactaaatgaacaataggattagcaaacaaacggattattaaacctttgcaaatagattattaaatctttgcaaatacatatttttattgcaatactagcttgatcaactaatgatatgatttaaggcatataggttaaaatggggatagtttatggaaatgctactcacacatatggagtcatatgtaatttttaaagcttttaactattaaacaggcaaaataattggtgtgaatctagacattcttttagttagaaatgttataaattgatacctttcattttactatttatagtaaatgcataaagcccaaagtaatttctaatcaccttgcatgttcatgctcactatttatgtttacaataatattaatagcgtttgtaagactacatattttcttctaatgaaagcattatagaatcaattagatcacattgcaattagtgaaaaacactataagctagtgtgttttatactaaataaaaaataatgtgaccttgaggttacctgtcactactcaaggaatattttcactgtaaatgcaataaaagttaatacatgtaattacagagtgattaaacattatttattgttcatctttgagtagatttatctgttataaattgataaaattttaaataactgcttttttataaagtagtaagaatacaatagaaaatatataaagctttctatcaataacaaaaacaagtacagaaaaacaaaaaacctagtccatgtgtactccagccaaaggcagaaatccaaaagacacagtagcaaaaggtcatgtcaggatgctagctcaccatctgtagcagaaagcagagcctgttttcagtaaggaaaatgtatgtttaatgcaaagaacattatttctaacaagtaacttatcgggaatatggagccataaggagtttagaagtaaaaaagtcagcaataaagggcactggtgtccctaaaaggccatgattaagtgtctggctgaggcttctgcttgcacaggattttttcttccctctcttagtttgcagcacaaagactggccccactggaagaaaaacttgttatccatatagtgtatcactcagttgggtacagataactacatctcttccttgtgggaagaaatcctttttattaggctttgtgggcccattctttacttacattgtttgggtgccagttatgggaggccaggctttccctttcccactggagtcagcattcttcagggcaatcctcaaaactcctgcaagactccattcccaaaccagactcttctactctaacctgccaatttttaaaaaattattacagtacagcacattcaaatctaatgtcatgtttttatattgctgttaaaatctgaaaaagacaaaataacccaaaacaaaacttaggaaatatgaacaaattaacagcataatagaaatataaggcttttactatactaagtatttacttgaattgtttctataatcaatatattggcctgatgtgttagttacacttacacattcatttaacagatgacaaaacagatcaaattgctgagtgccccacacccatgagaaaccgaagctctgatttaaactcaggctgactccagaacgatactcctaaccacaaggatgtactgccttttcatttttaataactagtttcaaaactcagatgttcctagatattattcctactggcatctttctatttttgtcacttcctcagaatttatgacattttatatacatatacacacatacatatacatataaacatccatatatgtgtgtgtgtatatataatatatgtatacattatatatgtagtatattatataatatatgtataatatataggtatatgtgtatattatacaatatgtgtgtatatgttatatatacacatatatagatataaatacatctataatatacatatatatatttaaaaatgtatttgttcacctttgtgtggtgctcagaactgtgccttgtgcttttcatgtttgaacttatttaatcattagaaccattctgtgagagtgatattgttatcctcattttatagaggttaagtgatgcactgaagatcattgagtttgcatatggttgagcttggattaaaagacttttgtcccaatctctgtacaacccaaatgctctttactcttaattagatgtaacatgcttccttcgtttctcaagttttatctctattagttaactatacattatttaatatagggacaataccttccaagtcatatacaattcctatagcccctaacacagtaagagtttaatacatagttggtgaatttatttccacccttaggattcctgtcctggtttgtagaatctccagctgagatcataaatctcctcttaaatttactacaaatacttagactcctgaaaaatgtctcatgacgacaaacttcttaccaaggagcactgatgattttgatcagacccagagaatgtcaaggtgaagattgatacaacaaaatattgatgcccatagatgtaaatattgttgaccttcctatactttcaagtttctaccaataaatttcaaatcatgaacaatcttagaagaaatatgtcccccactcccacacaaatagcctttggctaaaaaattatctaggactgaggaaatcatttatggtttctttcttctgtccaccgccaacatatgatttttaaattgtactttacagcaccgcaaccctgattctttcctccattcattttcttttttaccctttggtcacaagggaaatctggattcttttgcccacctgaggcatctgttttctctttctatctccatgttttcatcatacttctcatgtatgttttacttccccttttttctttcacttggcattcctccctacatgggcattccagtgtgaaaccatagtgatattcaggcatgcaactaatgaagaggcagattcttatctgagcttttgctgacactcttagggaaagcttcatcgtatttatttagattttttaagatatagttgtttcttatcaatgaaagttatttttttcattttatattacagaagagacattttctactaaaaagagtgtaaatgttccctgccatcactgcagtttcacagaatagagatttgctgataaatataaccactaatgaggacacagattccaacccagagtagtaacagagcatgtaagctgacaaattccagaattaggattttttatagcataatggacagaagcaaaagattctatagaaatcaatttttaaaatcacttacttgtgctttgaccaattcgaagtgaactcaggacatacaaaatggaataacagacactggagactccaaaagtgtcagcattggaaggagagtgagggatgaaatattacctattagatatattgtacactacttggttgattggtccaccaaaagccgagacttccaagaagcagaaagtccaagaaagaagtgctgggaaaataatcaaaaggagcatgtagtggaataatatgaaaaggatcataactactacctaagctactggtcagaaatagtgaccagctgtaataaaagagaaaatgggagatagtaataatatactctctaaagtttgtatgacttcctctttattaatacatggagtaaaatctgtatcattctcattaccaaatgtaggtttattatttctcaggaatactttggtcaccttcttaagccccagaattaaaaatctcatcaagtgtcattcatttcttatatatctaagagtcaaattcaagcctattaatttagacccattataaaattgtaacttaatgaggcttattctgcttaggtatgtacctgtgttccagagcagcatgactatttcctttctctaaatacacacagtactttaaatgcctaacatacgattttgtaccctttatgttgtcctttgtatcttatgaattaatcctatccttgcaggtggtctgtgagtttcttgaaaatagggattgtgtattattatcatgcacagtaaaatggcacagtaactcatccaagcattcatatcataactaaatccctaccctaaaccaggctctttcaagagcaccatagaaatgtgaagacaattttaaaaataattttaggtgtgaattcttttatcttttgatttgatgttttcctttcatgttagacatccctcctatatcagagaaaggtgtagcttcctcctttctaaaaccagtttttagaactggctaagttcagtgctgaatttattatagctacaactagtgatctatggactagcaaaactctaaatgcattttttaaagcttagggggataaaggaaagaggaggtctctattggggatgattctgtcttctctaggagatggcttgaaacagaaaacttttatctatggcatcccaagaatatgaatgttatttctaaatatgttgttaaatagactttgattttgattacatggtttgaagaaagaaaaaaattctacatctacattttaaagattccagagatccatgtatatgtcttgagttttagagacacaaaaattctattccttagaccaacctcattttccagatgaggaaatagaccctcctgaattaattgctctgccattggtctcaaagacaggagtcaggacttgaattctcattccagatctgctatttatcatcttgcataaacgtttgacaagccaaagaacttttcctggattaattttcttaaaagattgtggagattgcttccaattacctacctgtgtgattattctaactttctattttacttttttacaatgggcccacaacttctattcgtattgtagctacaatagacgtattgtagctagacgtattctagacgtattgtagctacaatacgtctctttttagactagttctctacacagcacacacacacacatacacacacatgtacatactcacacaaatgcacatacagaatagattggagcccaactcagtatggcttgttgagttgacaccagtggtaacagtaagtatggattctccaagagctgaagcagctgtgacaatcttggacaaatgtaggctgtttgccacagtatgggtgggctacaccatcagcgctgccattagaatacagataaacattggccccagtttccagataattaggctttctgactccagctcacaagcatttttagttagttctcataaatgcaggtatatgtgcataaactgatgtacagaacttctttttgaggttttctgacgtcacttatccaagttttgcagttgtatgcgaagactatttaatagacaagcataagtagtttatagcggctcttttggcccttgtaaatatctttctctcaaagtaaactagcattttttaaatttttttctcactttggcacattttctcagcttaaagttagtattttagatttaagacatagagcttctgtaaagcataatttttttcacaatttctagtattctctaagtttgaaattaaattacccactagaatttcaacagatagaagcctggagccgccagtttgaaataatggtgtgcctttgtgaacacaatcactttttaaacatctctggtacagaacaagtaaaccaagcagcagacttattattagacataatagcagacgttcaggagaatagagagatgtccttggtgttttgtaattcatctgacttgctttttcttaaaagcaaagccattggctttatactattttaatatgtcatcttaggagtttgcaggcctgtgtttagcacatgtagaacataaacacagcagagattaataccagaacaatttaagaagttcagaggaggaaatcttacttgaaattcactgaatctatttgaagggaacatatttgcaatcaattcccaaggaaaggtgaagcagtggctagatcagcattgtttaatggtcatttctctcatagatgactctcacaaattttaaattaaaagaaaaatggtttgtaactgagcaggtatcactagcaactttccagaaaacttagttgtccaacgtttttcattgacttttcttatattagaaaatgaaatgtcagatgctattaattgcatttttacaataagtagctacatcaggagtaatggctaaacgaaagtacttcctgtctaatgcacaatagatatattcatttaaatgtattcaatttagatgaatgcaatatgtctatattcattacagttatacctacctgtgggctgaattgatgaggtggtaattactacctttataaatggaacagcattgtgagtctggaggaagaaaactcattttcttatcatgtttcacacacccacacagtagacacattccaaaatctttcttccaatcataaagattttacccttgaatttccagtggacctaatgattgtaaacatgatcactcagtaggtcctgcttttccggagggttgcaaagggttggtctcatgggatatgatggaggggaactgagagtctcaaaatctcttcatgcaaagtaagtctcatgtttgttattctgcatgcctgcagtgcagctgtagtcatcatgtggcatggatttgattattcttataccatacattgttttctgagttcaatgaaggtaggactattaaaatgtgactttgttgaatacttttatttttagaacactgttctaaaaatatagtctgctaattagaaaaagcaagtacacatagttcctatacactctgcccaaccctaaatagtttctcttattattatttggcattgtgtggtgagttagtgtattagactgttcttatgctgctaacaaagacatacccaagactggatgatttataaaggaaagaggcttaattgactcacaggtccacatggctggggagacctcacaatcatgacgaaaggcgaatgaggagcaaggtcatgtcttacatggcagcaggcaagagcgcatgtgcaggagaactcccatttataaaaccatctgatctcataatttatattcactatcacgagaacagcacaggaaaaacctaccctccatgattcaatcacctcccaccaggtccctccaatgacacatggggattattataattcaaggtgagatttgggtggggacacagagccaaactatatcattctgcccctggttcctcccaaatctcatgtcctcacatttcaaaaccaattatgccttccactgcccctcaaagtcttaactcattccagcattaacccaaaagttcaaatccaaagtctcatctgagaaaaggcaagtccctttcacctatgatcctgtaaaatcaaaagcaacttagttacttcctagatacaaagtgggtacaggcaatggttaaatacattcattccaaatgggagaaattggagaaaacaaagggggtttaggccccatgcaagtccaaaatccagtggggctgtcaaatcttaaagctccaaaatgatctcctttgacctcatgtctcacatccaggtcacagtgatgccaaaggtgggttcccatgatcttgggcagctccttccctgtgactttgcagggtacattccccctcctggctgttttcatgggcagacattgagtgtctgcagcttttccaggcacacagtgcaagctgttggtggatctactattctggggtctggaggatggtggccctcttctcacagctccactaggcagtttcccagtggggattctatgtggggggctcaaatcccacatttcccttcttcattgccctagcagaggttctccacaaggccccacccctgcagcaaacttctacctggacatacaggcatttccatacatcctctgaaatctaggcggaggttcccaaatctcaattcttgacttctgtgcatctgcaggcttaataccacgtggaagctgccaaggcttggggcttacaccctctaaagccatgacctgagctgtactttgtccacttttagccatggctggagcagctgggacacaagacaccaagtcccaagactgcacactggaagaggggcttgggcccggcccataaaaccatttttccctcctaggtctttgggcctgtgatgagaggggctgccatgaaggtatctgacatgccctggagaggtttttcccatggcttggcgattaacattttgcatctcattacttatgcaaatttctgcagccagcttgaatttcttcccagaaaatggggttttattttctattgaattatcaggctgcaaattttctgaacttttatgctttgcttcccttgtaaacataagctccatttccaaactatgtatttgtgaatacataaaactgaatgctggccaggcacggtggctcatgcctgtaatcccaacgctttgggaggccgaggagagtggatcacctgaggtcaggagttcgagaccagcctggccaatgtggtgaaaccctgtctctactaaaaatacaaaaattagtcaggcatggtggctggtgcctgtgatcctagctactcaggaggctgaggcaggagaattgcttgaacccaggaggtggaagttgcagtgagctgagatcacgccattgcactccagcctgggtcacaagaacaaaactccatctcaaaaaacaaaacaaaaaacaaacaaacccacaaaaatgaatacttttaacagcacccaagtcagcttttgaatgggttgctgcttagaaatttcttctgccagatgccctaaatcatctctctcaagttcaaagtttcacaaatccctatggcaggagcaaagtgctgccagtctctttgctaaaacataacaagagtcaccattgctccagttcccaatgagttcctcatctccatctgagaccctcagcctgggctttattgtccatgttgctgtcagcattttggtcaaagccattcaacaagtctctagaaagttccatactttcccatattttcctgttttcttctgagccctccaaattatttgaacttctgcctgttacccagttccaaagtggcctccacatttttgggtatctttacagcagcaccccactctactagtaccagtttactgtattagtctgctatcatgctgctaataaagacatacctaagactgggtaatttacagaggaaagcagtttaattgactcacagttccacatggctggggaggcctcacaatcatgacaggaggttaatgaggagcaaggtcacatctcacatgcctgcaggcaagagggcatgttcaggggaactcccttttataaaaccatcagatctcatgagacttattcactatcatgagaacagcacaggaaaaaacccacccccagtgacttgattacttcccactgagtccctcccatgatacatggggattattacaattcaaggtgagatttgggtggggacatagagccaaacaatatcagttagtatattgtagttgatgaacccgtatttatacattattattagcaaaatctacagtttacattaagactcagtctttgtgttttacagttatatgagtttttataccaccatatatatttcaggaattccagttctctcccctttagcatattaaataactggataaaaataaatcaatcaatcagtcaaatgtattcgttctttcagtcactacatttattaattcatgtattctttaatagacatttggtaaacataaactctaggtcaagaattcactgtaatttaattgcttcaagcgttttcccgactcaggcttaatatgcatattttttagtcactctttttccttcctcactcaaggatattgtctgattttactggtgagcgctgatatgttctgtattagagaaactgatagtctttccattttggtgggctaatactgcgttgtgtcagcaaaagttcattggtttatgtgtgttatatttactattttattgggtttttttttttttttttgagacagagtctctctctgtcgtccaggctggagtgcagtggcacaatctcggctcactgcaagctctgcctcccaggttcatgccgttctcctgcctcagcctcccgagtagctgggactacaggtgccagccaccacgcctggctaatttttttgtatttttaatagagacggtgtttcaccatgttagccaggatggtctcaatctcctgacctcgtgatccacccgccttggcctcccagagtgctgggattacaggcatgagccaccgcgcctagccctgttttattggttgttaagcaactctgcaaaacaatctacagcctttataaacttgtgcaatgtagcatctgtatctgatcattaagaaatctggaaattatatcttccctctttttccttccattagacagataagcatgattaagcgattaagcaataaagcagtagctgctgttatgattatctttggattcacctgcacttccttatttcctttctaacttgtttttctggtggaggaactgtatattaattcatgctgaggaagatgaaattggtggtggccaacgttgataactgtggtcctaacagaaatgcatgtgttcctaaaaaataatccctgtttagactgggcacggtggctcacgcctgtaatcccagcactttgagaggccgaggtgggtggatcacaaggtcaggagatcgagaccatcctggctaacacggtgaaaccccgtctgtactgaaaatacaaaaaattagccgggcgagctggcaggcccgtgtagtaccagctattcgggaggctgaggcaggagaatcacttgaacctgggaggcggagcttgcagtgagctgagatcgcgccactgcactccagcctgggcgacagagtgagactctttctcaaaaaaataaaataataataataataataatccctgttcaattgcagtcagttaagaaacatctccaaaataggcaattatttaagcaaactttaaatatttaattgtttcttcatgtacagaaatgtagtcaacagtctggcatcctgcctgtaagtcagaaatttgtcattctttccaaattagaaacaatgctgagttgtccctagggaacgccaccgagagacaatttcacatgtttaatgtgcttttatttatcttttaatgtgggcatctttgatgaatcattaataggaggagaaaaaaatccctttcaaaactagttagtggctgacatcacaccttacctgggcattgatggaaaagtcaaattttgtttatgtctcattccaagtctggctaatggatagttggttcacactgaactataagaaaaacaattgattatggtaaaatgggaacagcattggaaaacaagaatctgcagttctgattatggatttgtgtgcaattgccactctccattactttaggaaaactcttcaatatgcaacatagatctcagaatctacataaaaaagattgttctaaaagtctaaaactaccatgtgtttggaattatacttacctacctactctaacattattccaacagtctaattctccgtgatatgaattgtgttgccagggtaggccatactgtctatgtgtgtaagagaaaagcattctctgcctttttattattattattaatttcacttttcaataaatagttactgagtttttctaagtaataagtaccatgttagatgttgtggaatgcaaagactatcctttttacaaaagaagtcaatcagcccagcacggtggctcacacctgtaatctcaacactttgggaggctgaggcaggtggatcacctgaggtcaggagttctagaacagcctggtcaacatggtgaaaccccatctctactaaaaatacaaaaattagctgagcgtggtggcatgcacctgtagtcccagctactcaggaggctgaggcaggagaatcgcttgaaccgggaagcagaggttttagtgagctgagatcatgccactgtaccccagcctgggtgagagtgagacttcatatcaaaaaaaaaaaaagaaagaaatcaatcataactttggagaaatcaacattagtaatattaatgttaattaagtacatattatgctctcttgactatgtttggaattcttaaataggtaaaagtaaaaaaaacagagattaaaaactcctgaaaaccctaattatgcaaagaaaattaaatttgctagctttatttttatttttattttacgttcctgggtacatgcgcaggatgtgcaggtttgttacataggtaaacgtgtgccatggtggtttgctgcacctattaacccatcacctaggtattaagcccagcatacatcagctgtttatcctaatgcactcccatcccccacccaacccctggagaagccccagtatgtgttgctctcctccctgtgtccatgtgttctcatcattcagctcccacttataagtaagaacatgtgacatttggttttctgttcctgcattagtttgctgaggataatggcttccactccatccatgtccctgcaaaggacatgatctcattcattttcatggctgcatagtattccatggtgtctatgtaccacattttctttatccagtctatcactgatgggcatttgagttgattccatgtctttgcgattgtgaatagtgctgcaatgaacatggtatgcgtgtatttctgtaatagaatgacttatattcctttgggtatatacccagtaatgggattgctggatcaaatggtatttctagttctagatctttgatgaattactacactgttttccacaatggttgctaatttacattcccaccaacagtgtaaaagtattcctatttctctgcaaccttgacagcaactgttgtttcttgactttttaagcatctccattctgactggtgagagatggtatttcattgtggttttgacttgcatttctctaatgatcagtgatgttgagctttcattcatatgtttattggccacatgaatgtcttcttttgaggagtgtctgttcatgccctttgcccactttttaatagggttgtttgtttttttcttgttaattcgtttaagttatttgtagattctggatattagacttttgtcagatggatagattgcaaaaattttctcccactctttaggctgcctgttttctctgatgatagtgggttttttgttgttgttgttgtttgtttgtttgctgtgcagaagctctctgattagatcccatttgtcaatttttgcttttgttgcaattgtttttggcaatttcatcatgaaatctttgcctgtgcctgtgtcttgaatgctattgcctagattttcttctaggatttttgttgttttgggttttatatataagtccttaatccatattgagttaatttttgtataaggtgaaaggaaggggtccagtttcaattttctgcatatggctggccagttctcccagtcctttcccaattacttgtttttgtcaggttcattgaagatcagatggttgtagatttgtggtcttatttctgagttctctattctgttccatgggtctatgtgcctgtttttataccagtaccatactgttttggttactgtagccttgtagtatactttgaagtccagtagcatgatgactccagctttgttcttttagcttaggattgtcattgctacacaagctcttttttgaatctatatgaattttacaatagtttcttctaattctgtgaagaatgtccatggtagtttaatgggaacagcactgaatttgtaaattactttgagcagtatggccattttcatgacattgatttttcctatccatgagcatggaatgtttttccatttgtttgtgtcctctctgagttacttgaccagtggtttgtagtcctccttgaagaggtccctcacttcccttgttagctgtattcctaggtattttattctctttgtaaatttgctagctttgtatgagatagtggactaaaggtgataaaaattcctctcacctgcccaaatttccatcaggaatttgctttgtagactcaggggaaaatagtattttgtgaaaaataattttatagtgtcacatgcattcagtgatacacacacacacacacacacacacacacacacacacaaacagactgcagaacatccaaacattgagtacctatataggggaagaaaaataattttcttcttctcaagcgttctgctgtgacttcctgtaacaaaagacaaattaacaagataagaaacagaagtttgataacatgtatacctcttgtgcacatgggagataacctggagaaataaataaacttatagactaaatttcaaacaattgtcttagacttcaggcttaaatatcatcattctccaaaacaaagaagtacgcagtgaaaggtaaggtaagtacgcagtgaaaggtcaggttaagacccatgaaaagtgctactacaaaacaggaaagtgtttgttatgcagatttaaatctatgccttttccattgattaagagtctctagtaatttagagctagccctctcttaggttgtcttaggtgtcttaggagacacctttacaagtaaagatttcctttataggtgtaaatttatctagaaaagggtaggtaacttttcaaaccttctcctgtgtctataatttcttaaaataactagttcacaattatccttatgctaaggaggcatactggagtggcatagttaggtttcctacagtcatattttggggtggcatattctgagccccatcacctatatttgccatgtggtatacttagtacttccctaaaaattatccaattttttcttcacaacaatcttgtaagctacttattattatcccccttaatctattctgagataactgaaacctgtagagtttgaacttctgtaagacagaggctgacattcaagctagtcaggtctcaaagacaaagatttttttttcctattataaaaacagaataaataagtaaatgaaacctccaaagcaagttttctgttatccaagctgttacagagatgcagaaagatgatggatgccaaaagagtgttctgactcagcagcagccacttgattggaagaggggaaaattcactctctttgaagtaggatttcatttggggctaatataatagaacgagttagagaatattagaattcttaaagcaatctcttacacataacagtgaagggtcaaatgtgggctttcatgcaaagaatatgaattcaattctcacagctctgtgctggtattacccataaggagctatgaagaacagcaattgatttcttccctttcttttccataatcagagcacatattcacaaccaatgcaacaagactactaccttgcattttcctagtacccatctctcagcttcaagagcattatgcatttttaaaattataattagttctctcactcttcctgggagttaactgctccatatcatcccaaacccacaaatgagttagcggagacagcctggagttatatggcatctggataaatgcttagcaattggaacagccttgagtatggtgaatcacgcctctgaagtcaggcagatctgagctttaatccagtgaatgaatttctaaacatgtttgtgccttattttccatatctttaaatgagataataatagaacatacttcatagggttattgtgaagattaagtgggtgaacaagtgtgaagtgcttggcacatttctagtttacaatgtagttcatgaggagttaatgtgtaataattacaataatagtaacaatttgatagcaaacattcatatttctaagtgcattactctagtcaacactagccactttaaaaaacatacgtgttttacgcattaatgtaaaatttttggtgtgaaaaagtacatattctctccttgtacccaaaacattaattataaaaagtaattaaatactacagaattcatactgaatgacaacaaaaaatgcccattggcattaccgaatgttttaaaaatgactcttgttaagataactgtcatattcaatattcaatttgtaatttattttcaacctttaatgaatcattgagagtgattaacaagaagctttcttttatgtcatacattttttttctgtcagataagctttcaaaacctcttcctctaggcaaactgtaagaagggaaatttaaataactggcaaatgaatgaattcattatatatcaaatcttgtatctataattctttctttattttaaaactttactgatactgagaataggtcatcattttttactcctttcatatatgacacttcatctctaaatatatttaaagattgtgtaattatttcagagagtaaatcgtcttatttaccttcaggcctattttttcagtaaaagtatcctgtcattcaacaaaaagccaagaaatagtgtgtgctaataatgtgtatataatgctatgtgagagagacattaacttctaattattcttaagtagtctgatctaggtaacccttaatagcaatttgtgattatcactctatcacaacttatagtttttacctctttacatgtaattctttcccattaaactgtaaactaatgagtgtaagacccagtaagaaattgacatttagaagttgctaaataagagattcttgaatatatgaatacttaataaacagttgaatgaatggatggttacatgtgtggatagatcgttggatggatgaggtagcatggagacagtgaaaagcatgcccccctttaccattacctagccattagattttatacaaaacatgaaattactaaatatcagttgcctcttttgaaaaataatagagatttctatccttataattcagtctatgtttgtatgttttgtggtagaatttatactcctcctgttcactctttctctcttaataaagaggccagaatatgccctggagattgtcattagcaccttagaggtaagaaagataagaatatctgcataatttcctggcaagaataatgaagcaagaaatgtgatatgtagtttagtctaacgaccttgtaaaatataagtgttcagaaaaagatggtattaaacttaaattttggtgaagctgtcttaaaattgtaaaattttgaattaagaatcatcaatatgatacttaaagaacgttttagaaatatagaatgtttagatgaaggtaaacattcactcttgaccattgaactactgtcataaaatcacctacataatctgaaagaatataaaaatacatttttagcctcaaatctatcctgaattttcagttgttcccctacaccagctcatgaggctaaggtatttttgagcactaaggcagtgttgaccaatgtctaagaacattgtcagttttctaaggctgctgtcataaggaagaaagaagaactatgattaggccgggggcggtggctcgcgcctgtaatcctagcactttgggaagccgaggcgggcgcatcacgaggtccggagatcaagaccatcctggctaacacggtgaaatcccgcctctactaaaaatacaaaaaattagccgggcgtggcagcgggctcctgtagtgcaagctactgcgggaggctgaggcaggagaatggcgtgaaaacgggaggtggagcttacagtcagccgagatcacgccactgcactccagcctgggcaacagagagagactccgtctctaaataaataaataaataaataaataaataaataaataaataaataagaactatgattaaaacaaaggaatccctagtttcaatccagtccctgtgattatactaagaaaggacatgaaaaataaataaataaataccggctgggcgtagtggctcacgcctataatgccagtgctttgggaggccgcggcaggtggatcatctgaggtgaggagtttgagaccagcctagctaacatggtgaaaccccgtctctactaaaaatacaaaaaaacgtagctgggcgcggtggcgcgcgcctataatcccagctgctggaggggctgagacgggagaatcgcttgaactccgggagggggaggtcgcggtgagccgagatcgcgccattgcactccagcctgcacgacagagtgaaactccatctcaaaaaaagaaaaataacttagtgagaaagagtggagaaataatggtttcccttgattctaagtctactaaatcaagggatttagcaccatctcaatgctgtattcccgtctcacttctcaatagtgattgtatcagctggcaattttcctagttctttcaacaactgggttttgaccttgaaatcagtctccattctcattactggctacagcctgtccactaattttttatatcctccattattctagaatgtaaccaaattcttactttaactctcttaggtaggcaatccatatacttggtctagttgtgctgttagttaatggtatcattcccttctttctttttgccatgtgttttaccctcttatatttgggcttaaatcattatgttacacacgtctaaattaattgtcccattacttcaccccattctgaaaatatgcgtaaattatttctgcttactttcttttctggtcagctatttgcctatgatgtacacttatgacccgatttctttctattgagggtagtcgttttggagaaacaaagataaaatccattctttagtttgttcattcattctttatacatatttacttggtattctcaaagtgccagtcactcttttatttggtattgggataatagagcagaagttatagaatggtatgaggcataaatatataaaccatgattatccattaatttgcgtagtgcatattaagtagcacatattctgggctagacaacatgttgtttagtattgtgtaacaaaaatgaataaaatagcttcttccctcaaaaaattggtggaataaatagacatgaaaacagataatttaatgctatgtgacatatctggtaatagaattaaagaggaaaatatagaagcagggtttgataaaatatgatacaggcaaggtaagaagtttttctggtatattgagaaggttggctttaaaggaatatagcaaatcacagctgtttactaacaaaggagccaggcataggttgtttgaattcaaattccttctccgcttgttaacttggagcccatgagtgtgtaatctctctaagcactggttgatgcatctataatgcagactaaaatagaaccttactcatagggttgttgtgaggaatgatgagataattcatacaccttgtgcatagtttatactcagtaaacatttgccactattattctataatcaaagagattctataatcaaaagaggattttaagcaggagaattatgtagccaaaactgttttaagtggagcatactacaaattttcaggagaatattttgaagaacatggacataaacccattggtaatgtgcagcaggaactgatgcttgtggaggaggctttggcaatgttgaacataatggatacatcaggctctatctatagtgtgaatggggacacccatgggagagcatatgaaatggataaatcatttggctgaagatagaattgcataggacactaaaatttaagggataatatcagaaaaacagagggctatggaggatataaagaagaatggccagtgatgtgcttggtaataggcacaatcacaacctagaaatgggtggcaagaagaaggatgaggaaaaaccaagctccagaccagggctactttagaaatcatgatatgtcagttgataagttagggatgatgcaaaactaaaagttattctcacagtgtcatgaattcccagaaaacaatgtgctccgtcatatttctttaagttaaataccaccttgattaatacgagatctggttatgctattagagagaagtctaaccaacatttatgtattttttcttaaaggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcaggtaaggcaaagtgggaaaagtccttcatattcctgtatttataccttcagaacagaactgtatgaatttgaccttatttactgccatataagactgtgaggtaagaacattttatgtcttttttcccccctggaaaggttgtgttttgtgtttaaatgttatccaaagtcattttttcctagaactactataaagctggaggtaaacttagagataatctgagagtagactgacatatttattttagaattatattcagttaacccttaaacaacacagtggttaggaatgtcagtcaaaaatccacatataacttttgcagttaaaaatctgcatatgatttttaattccctcagaaatttactaatagcctactgttgaccaggaagaagtttactgtaacataaacaatccattaatgcatgttttatatatgttacatgtattatatactatattattacaataaagtaagccagagaaaagaaaatgttattaagaaaataaggaatagaaaatattgttactattcattaagtggaagtggatcatcataaaggtcttcatcttcattgtcttcatgatgagtaggctggggaggaagagaaagaggaggagttggtcttgctgtctcaggggtggcagaggtcaaagaaaatccacatgtaagtggacccattcagttcaaaggtcaactgtatgtagggaaaccaggacccaggaaaaataatgtcttattcaaagttacttaactagttagtgacagatttagaatcctggactagtactaggacagaatctattattatagtctacatctttgttcaagggtcaactgtatgtagggaaaccaggacccaggaaaaataatgtcttattcaaagttacttaactagttagtgacagatttagaatcctggactagtattaggacagaatctattacagaatctattatagtctacatctttcaaggattctaagttataggaaatattaggtctttgggaaagcaattctcaataaaagattacattttcctaagcatactctcttaagaaagtcaaagttgttatttaataaatgaaacattgaaaacaggcaaacaaaaaatccaaaagggaaaagcctaggggtaatcacaggtgaaaacatttcagtttatttacttgaaagatcatatgggcatctatattattagtgtggatatactacatatggctgcctaaattacctactctccaaatgtgaaggaagaggctattgttctcatctggttagatgttatccttgctgattgaggtatggcgatactggcaatttaggaatgttaaataccaccgactgagaaaaaaaatttcatgtggccaaagattattgctaacagctgtaacaaggtacacattcctgataccaaatggacctggcatgttggaatgtgtgggtaagtcttgtatactctatctcaaatatttattcagattaaacaaaaataaatctttcgtcagacatcactagcattatattgagtgtatactaaatatatatgtatatatatgtatatatgtgtgtatatgtagtatatgtgtgtatatatgtatatatgtgtgtgcatatatatgtatatacatatatgtgtgcatatatatgtatatacatatatgtgtgcatatatatgtatatacatatgtgtgcatatatgtatatgcacatatatgtgtgtatacatatatatacgcacatatatgtgcatatatacatatatacgcacatatatgtgtatatacatatatatacgcacatatatatgtgtgtatatacatatatatacgcacacatatatgtgtgtatatacatatatatatacgcacatatatatgtgtgtatatatatatatccttgggaaatgccagcctgacgaagacacagcttttatccctaaacgtaagatatatgtatatagttggcttcgtttctctgacaagggcaagataatgagataaactgttttaggattgtaattcccaaatcctagtgtgcataacaatgacctcagaatatgttaattgttcagattcacagaatcttcctcagatattctagttcaataattctgagataggatctagcaatctatattttaaaatgaattgaaaatgaaaaatttcaaacgtatataaatgtgaactaatggctatcacccaacttcaatgataatcaatcttgcttgatttataccatcatcgctcaccacacctccaccattgttacattattttgaagcaagtgccagatggtatatcattttatctaaaagtatttcaagatatatggtcatgctttaaaattgatgctttgattattatctaacctaaaaatcaacagtaaatttttaaataccagttagtgctcttgttaccttagtggtcttataaatgatttgtaaatttgagttcattgaaattaggatccctaaatatccacacttttggttggcatgtcttgaagtttattttggtatattttaatctataggtttttccatctcttttaaaattgtacattttgcagttccttttcacatttgggattatgcaaaattctactcactgttatctttcaacattttccttggtttccttttcactggtttttatggatagagatttggccaaattcagacatatttttttcatggcaagaatatattagagggtattttgtgtccttccataaggaggcatataatgtctggttgtctctctttttataatcttaagtttgatgagtgagttgaggtactatcagattattgatccatttatcattaagtttccactggcttttttctcactaatgatttcgtagacatcaatgatcatttgctcaaatatctttatttgtatttataaaatgatgattcaaattcttttacccctgctacatatattagatagattacgtctgtaaagagaaacttcttataagcaccaccgcctgtgggattttatgcaggtggctttcaggctgaatattaagaaaaatttattcagggatttggagaaataaaagaccaggaaaggtctcatgcaacagtggaatttgatttgtgccttacacacgtataaatggatgttaaaatagaggatcaaggtgagatggcattcttgtcagtgggaatagaagctaaggtgagaaaatcgaagagcatgaggcatcttttgagaactgtaggaagtattgaactacctggggtgaatcttccatatcaggtctgcatgccacagcatcccgtgtactctggaatcctgcctaatcaatttgtttttttatcattttcttcaatcttatttctattagctatctaacatgttgataaacaaccttcctcaatatttctattctattctattctattctattctattctattctattctattctattctattctatctatatgcacacttccatctttcatttatttgcttgtttcatttgtttattgactttctgtcattctaactttcctgggtattctccttcattaaacaatgattcggtttctactgtgtgctactgtgtccattgtgaaaaagcgacacatttggcttccaccttcagggagctggtaatctaaatgaggagaagacaaatcagtagatcttgtgatacattaatttaagtgttgtaaaaattttatacgtaggacacttaaaagagagcacacaaaactgattccagaaagaagagaagataaatgagctggatttcttaaagactgaatagaagctaactgtgtactcaagaataataggtcctatatggtagaaaacctattatcaaggcatgggggcagttaaaaagcgtaatctatgaagaagcaaatgattcactatggctgcttaaggccatcatcactatcttggggatcactttagaaatctttgaaactgcatcctatttacctctgctttttgcagtgcatcttgtcctcatttttcattttgcattctcatttccaccatcataattaatctcacttctaaattattgctgaggtcttcaaactggactccccacctccagtatttttcctgttccacaccaatccatccacttatgaccagataagtcttttcaaactatcccatttatatgatcactcttttcctaggaaatctttagtgcttgatgactgattttggaaagggtctgaactgcttatcatgctattcaaatccacaatctggctcttgactccgtttccagatttatcttctgcaaatccagaatttccttacagtttcttcaaacatgtcttatgctttcccacatgctcatcttggatcattatcttctctctccctgaagtgccctcttgtcttgtgtctctttttcaacacatacttctgcatatttaatgcagaaattgacaacttatatgggatattaaaatagctgagatttcatggtaaactaatttaacacagaattttaaaaataccttttgcttgaaatctattaatattattgagaatttttgtatacgcttcccactttaaaaaacattggaataattaaatttgctataaactttgttagactgctttcttggataatattgaaatacttccatttaaagatttattttagcccaaaatattttgaaaattacctcaattttggatgaagctgagttacactgaagtaaatcatgcaaaagtatatattttttcaaatttcaaagctaaatctgtccatttggttctttcttctttaagagctcttcttgattatgataatgattataatggtggtggtggaaatttggctattttttggcctgagtaacgtgaacagttgccataattttactttccatgtagattcagatgaactagctggcttcttctgttgaccttccaaaaatatgctctttttggtacacttagaagtaaatccaaatgctcatgaaatccattctattactcatcaatagaacatcttagatctgataacgaaataatctatgaatactcttctctgcttttccttcattcatgtataattactcaggatcccaccgcttaataagtaatttctgaagcatttgttattatcgtctgtcagcatcatgtgtttattttatcacaaagattatattttcatggttatattgtaattctagacgagtaagtcaacacacaacttcaagaaataaagtaaaagagtatgtgatacatatatttaaatgaattccattggagctttaaaaatatttttctataatttgaataaaaattaagattatttatttatttatttatttatttatttttgcctcatggcactccactatgggcaacacagtgagacctgtctccaaaaaaaaaattaagatattttcttaagtattatttgtagagaaaggcagctcatcaataacacacctgattttttaaatttcttcagtgaggaaaaataatgaatttctagctttgacaagccactctatatatagctcacgtttttggaaacaactcaatatcttagctattgccttgaacttcttaaaattctgtgtaaatgttgagtattattcctaatgcagtttgaatgtgtatacaaattataatcacttagataaagacagaactgtaactattaatataggtaacatgtcaataacagctaattccttgtgagactacctagaagtcataatccctttctcaagattgttagctgcaaatgtattactgggatgaataatacacatcctcacatgcagcagaactctctcctgccccagggacattctgactcatctcaattttgaaaaaacaaatgagccagatccctgtacaattaacccataaaaaatatctttaataataaaaaacaaatccactttgaaaccctccacatgtgacgcttcatccttctaatctccatttgcttcacaataggatttatttttacccagaaggagctgttcacttgtcaagccctggatttgaactccaacggattcattgtttaaaatactgttttggattcaccccatctctacttgctctggataacatatcaaaacagaactaccattgtcatcttgaccttaagaggaaaataccccaaaattgctaaaagaatttaatctaattccctttttttgtttctgcaatttgatttatattttccccaaatactgcccaagtgatatatagtatgtttaagttattagtcctctaaaagtgctaacaaaatgtcaaagtgtagatgagtggtagggtcagcaacattgaagaaataaagactggagtgcctggaatgaataccttcagtaccataaaataatactctctcctgttccattttgcattctgtaaaccaatatttctggcaaagtatgtgtgtgtgtgtgtgtgtgtgtgtgtgtgtgtgtgtgtatgagtgtgtgtgtgtgtgtatcctggaatcacccagcagtagttgcaacctttattagcagagaagtataagacaaaagaaccaaaggtgatcttagcttcctgctcctatttaactctcccaaattactgtctgtatcttagccaagaggctttttgctctcaaggttctccttactgaaaaatatattaaaaattctgcattctggctccttctgacttccagatatatcaagtagtttccttctaccttatgacactggctatagctgactgttccctctgtctggaaaattcttctatctgaccttcagtgttctcgttctcttcatttgtgtctcagcttagatgtcacctcttcagtaggacatttcccttttaccttaagtagtcagttaccaattttccagttctaatgtcctgttgccactatcagtgggggtgtaccttgtaatggccagagccagctgttcaatattcaagaactttgtgagctggttgtttaactattggtagattgaaatcagccataataggatatctacaaacactacaagtcagggctttctgtgttttgtttggttttttgaaagagttgatagaccagcagaaaactgcttattattctttaaaaagaaaaaaaattactttttaaattttgtcctcatactccactcccagctattaaccttataaagggaagggcatggttctattagccactgtgtctctagaacttagagcaatttctggcacatagtaacattcagtagattttttttaaatgaaaaagtagctgaataacttggtttttagagtagaccatttcactctgtcctatgtcaatacattgacctatcattgactaatcatttcttaagtgaacagagtaaatactgtggtaaacatatggggtgcctaatctcaagttatttatgattattgaacaaaaggtgtcatgaaatgacatttttataatttaagaaaatatttgatcccatattattgttgacaaggtgtgccaccccagtatgttcagacttgactttgtggaaaattgctaatcttcaaggacttttaagcaagcaaatgatatgactagatttgtgatttagaaaaataatcctaaaagcagtttatgttggtacacaagaaggagagcttggctctgtgatgagataagcgttcaagagttcaagagagacaataggagtctttataacaatgacaatgagggaagagaaagggatagattctaaaaattgtcaatggattacaaaatgtgaacacatgttttgcataactagtaatcaactaatacaaatttgaagagattttaaaaggtaaatatgtcaagcgtgaaaaaaagaatcataccacccggtgttgacaaggtgtgagaaaacattgcttatgagagtataaattgtcttaattcttcagcgttccacttttgattattatgaaaaggcttaaatttaaatttttcttactaacagttccatttggtaagtatcctaggaaaataatcagatgaatttcaaatatttatgtataaggatatttaaactagaaaaatactagaaacaatctaaacatacaatgaagagagagtggctaaattatggtggacttaaactggaataatatgctagaattaaacttaatgttttgggtctactaaaaatagatgatgtaaaatgtaattcttaaaagttattattagataatttatgttaaaaatcaagaaatacagaagtgtagaaaaatatttaaaattatttaataataatttggttcacatcttttcagataagtctctaaatgtttactatccaatcacaaactatgatgtaacaacataaaatgtggttatgctatacataatagtcttcatatattttcacttaatgttatatctcataagtccatagagatctatattttattgtgttgttaaataaatactcggaatttacattattgtgacttgtaaatatttttccaactgagcttcataacatactatgatgactttatgagtatatcttcttcctggagttagaaattgcttgactcttatatttcatcaattttgcatcactgcctattactcattctttcctgaattatataccatatataagaacaaagtttcattaaaaacatcacataagtcagataatcaattagtcctttctccctcttcccttacacatatatagtaaaggcctccgtctttctgctccaatcctgacaatttgttcatcaggtcagatgcatagctattgttctaggacttattttcaccattattttgtaaatgcttttgcttctatcctggattacacttcttgtttccttgatcccatggctatgttttctttatttcctgattttggtggaacctatcctctagggcttcctaacaaaggatacatatgagataaaatttggggatccttgtctatcagtaaatgtgtttattctaccctcgcagttgatttattttcaaactgagttgtaactttcagttttattgttgagaagctatatgccatcttgtatcctaattgttcctttcaggaaacctttaaacttttcatcatctcttcctacaacaaaaattggtctagtgccttctgtatgcccagcaccattccaaatgctggagattcattatggagtgaaccagacaatcatctccatcctcatggagctaacattatagagagtgtataaaaaagaaagtgaacatataaaatatgaaaaaatatataggatatcagatgttctacatgctatggagaaaaataaaggattgaagtgtacagagaatacagtggggtaaatagcattttcattaggggttttagtaaagaccttaattaaacagcaattatgaacaagggcctaaaggatatgaaggagcaacccatagagccatctctctgagagagagagagtgttccacacagagggaatgccaaatggaaagtttgggaaatagggccatttagtgttccaaatactcctaacacattaacagtctagaacaacttgcctttggatggctttccagttattgtgcagggcattccatgagatctctcaacagggaaaaaaatatgtcatttgttttagaaaagtggtattttaatattatttctttgataatatcttcctctacaatctatttctctgttttctttcaaaatctgaatacacaattaaaagacaaagactgtcatagtgtgtccagaattggcgggttcttggtctcactgacttcaagaatgaagctgcagaccctcgcggtgagtgttacagctcttaaggtggcacgtctggagtttgttccttctgatgttcggatgtgtttggagtttcttccttctggtgggtacgtggtctctctggctcaggagtgaagctgcagaccttcgcagtgagtgttacagctcataaaggcagtgtgtacccaaagagtgagcagcagcaggatttattgcaaagagcgcaagaacaaagcttccacagtgtggaaggggaccccagcaggttgccactgctggctcaggcagcctgcttttattctcttatctggccccacccacatcctgctgattggtagagccgagtggtctgttttagcagggcgctgattggtgtgtttacaatccctgagctagacacataggttctccacctccccaccagagtagctagatacagagtgtccacacaaaggttctccaagtccctaccagagtagctagatacagagtgtcgattggtgcattcacaaaccctgagctagacacagggtgctgattggtgtgtttacaaaccttgagctagttacagagtgctgattggtgtatttacaatccctgagctagacataaagattcttcatgtccccaccagactcaggagcccagctggcttcacccagtggatcccacaccggggtgcaggtggagctgcctgccagtcctgcaccatgcgcccacactcctcagcccttgggtggtcgatgggactgggcgctatggagcagggggtggcactcgttggggaggctccggcggcacaggggcgcacggagcaggtagggggaggctcaggcatggcagactgcaggtccggagccctgccccgcgggaaggcagctaaggccgggggagaaattgagcacagcagctgctggcccaggtgctaggcccctcactgcccagtgccggcggggccggccggctgctccgagtgtggggcccgcggagcccacgcccacctggaactcgcgctggcacgcaagcaccacgcacagacccggttcccgcccgcgcctctccctccacacctccccgcaagctgagggacccagctccggccttggccagcccaggaaggggctctcactgtgcagcggcgggctgaagggctcctcaagtgccgccaaagtggaagcccaggcagaggaggcgctgagagtgagcgagggctgtgaggactgccagcacgctgtcacctctcaatagttcacaaaaaagactcaactctgagatgtctacaagaaacccacttcaaatataaagaccgattaaaagaaaactaatagagaaacatgcaccgtgaatactagctggaagagcagcattaatttcaggcaaagctgagttgagcaagaagcaaaattttcagagataaagaggaacattgcataatgataaaggaattatgtctccaagaagacataatcttttatgtgtatgtattcaactcacaacagagcatgaaaatatgtgatgcaaaacctgatagaaatgcaaagagaaacagatgaatccactattttacttggagataccaatacctgtttgtcagtaactgacacatctagcaggcataaaatcagtaagaacatagttgaactgaacagttacatcaatcaattggatctaacttatatctatagaatacttcatccaacagcataagagtatacattcgtctccaactcacgtaaaacattcaccaagaaagactaaattatgattaaaaaatacacattaaaagtttttaaataaaaaatcatacaaaatatgctctcaaatcacaatgtaattaaactagacacctgtaataaatatttggaaactcacaaaacccttggagattaaaaacacacgaattaaataaatatcaaaaaagtacaaatatttcaagccaaatgaaaatgaaaatatgtcttagtaaaatttgtggaatgcggcaaagagtgcttagaaaaaattatagtgttgaatgttatattgaaaaaagaaatatcaaaaattgataatctaagatcttaccaaaaaaactgcaaaaagaacagcaaattaaattcaaagtaaacagaagagataaaaattagagcagaaatcaataacactaaaaataagaaccaatggtgaaaatcaatgaaactaaaagctgactctcttaaaaagatacagttaatgtatctttaatcaggttaactaaggagagagatagacatggggagggggagagagagagagagagaatgagcgagttaggataataaagaaatagtataagtgactctgtccccccaaatttgataactttgatgaaatgttaatttcttaaaagacacaatctatccaaactcatacaagaagaaaacagattatctgaatattaaaggagaaaactaaagttggtgagctaacacgatccagtttcaaaaagtactataaaactaagtatgtaaataagtaaataagacggtatggtatcgtcaagagaatagatcaatagatcaacagagcagagtagaaatcccagaaatagacatgcactaatatagtcaactcttgctctttgacaaagaagtaaaggtaattccatggagaagatattctgttgaacaaatggtgctgaaacacctggacatccacatacatctgattttctaaaagaagctacaggccttttcctaactgtacattattcaatcattatagtatgtgtgtagtggtatctcactgtgatttgttttgattcctccaaaaactaataatatgcaacatattttcatttgcttatttaacatttacatatcttctttggtgaagtttctattcacaaattgtgctaatttttctaacttggttgcttgccttattgtttaagaatttttacagttcttcatatattttgaatgcaaatcctttatgagatacaaggtgtataaatattttctcccagaattgcaaagtatttttatatttctctgaatattttataattttagtttcctaatataggtctatgatctaattttgagtattaatttttgtgcatgatgtgaggcaagggcccaagttcaatttttttcttatagatatccagttgttccaacataacttgaggaaaatgctatttgtgtctcatggatttactttggaagcactgtttgaagattattattcataaatgtataagtttatttctagattctctatttcattactttgacttatatgtttatgcttatgccattaccacgctatcttatttgctgtaactttatagcaagttttgaaattagatagtatgagttctccaaatttgctcttgtttttaacaattgtcatagcgattctaagtcatttgaattttgatataacttttggattctgtttgcaatttctaaagcaaacctatttggattttgataggaattgcactaaatttagattaatttgatggaattttaatccttaaccatattgagtctcccaatttatacatatatgtctctgtttacttaaattgcctttaatttattgcagaaatcttgtgtagtttttattttacacattttttcttgttaaatatgacacatattttagtgatttttatgctatttgaaagggaattttaatttgactttctgtttgttgccactacatgaatatccaatagattttttatattaatattactattttatatcgatcctgtaattttgttcaacttggttgttagttctagcatcttttttgttagacttttaggattttatgtatataagaacatgtcatctacaaataaagccagtcttacttctttctttttgagctatatgcctgcacttatgttctttcttgcacagaattccaatgtggtgttgaataaaagatgcagaaatggccacttttgtgttctgaatcgtaggtagagataattcttttgacattgagtatgatgttagttataagtttttaatagaaaccctttatgagaatgaaagcattttttttactcctagtttattgagagggtgttttatttattttgaaattataaacgggcttccgtttagccagatgcttttttttgcatctactgagatgaatgcgtggtgcttgctctttattctgttaatgtggtataagatattaattgaatttttggatattaattcaaccttgcatttctggagtaaatctcactcatggtggataacatcttttttataatttataggatttaaaattgatgatgatttgttaaggatttttgtgtttctgttcttgagagaaatatagttcactttcttgagatatgtgtgtggctctggtatcgaatactagaattagaaatgagtgggaaatgtttcttgctcttccaattcctgagtttctgtagagttattattcattctttaaatgtttaatagaatttaccagtgaagctacttttaggtactcttttctttacttactgaaaatttattgagatcattctatttcttcttggctcgattttggcaatttctgtctttgtgtaggtattgtccagttcatgtatgttgtcaaaaacttgttggcataaaattatatgcaatattttatcataatacttttaatataccctatctaatatcccctacattatttgctttggtgacgcctgtcttctctatttttctcagtaagtctagctaaaggtttatgaacattagtaatctttacaaacaaaatctgttttcatttattttctttttaaaaatctacttgccattgatttctgatttctcttttgatatgtataatatactttctccttattttgtgtgtaatttatttatttttattaatttatttttgagatggagtctcgctctgtcgcccaggctggagtgcagtggcgcgatctccactcactgcaagctccgcctcccgggttcacgccattttcctgcctcagcctcccgagtagctgggactacaggcgcccgccaccacgcctggctaatttttttttttgtatttttagtagagacggggtttccccgtgttagccaggatggtctccatctcctgacctcgtgatccatccgcctcggcctcccagagtgctgggattacaggcgtgagccaccgtgcctggccaatttattcttttttaaaggtttatttgcttttaaccaaacctgaacccttagagtaactgttaatataataatgagtttcttaaagtaattctatggggaaccaataaaattgtgccagagcacacagacatgtggttgtctgacttagaaagtaactctgaacagaaaaataaatatataatgtattttttatgaaatcctcttttgataaatattttacaatcatgaatttgatattttcttgagaagtattgattatagccattttgtttgcattttaaaggtgtacttacatggtttggccatattatgaaataaatgaaggccaaataagcctacctcaatgtgggggtgggcttcagtttgaggggtaggctggaggaacactgaaaaagagagctaactttttttcttctctttttttttttgagatggactttcactcttgttgcccaggccggagtgcaatggtgtgatcttggctcactgcaccctctgcctcctgggttcaagtgattctcctgcctcagcctcctgagtagctgggattacaggcacatgccaccatgcccagctaattttgtatttttagtagagacagggtttctccatgttggtcaggctgacttcaggtgatccgcctgcctcggcctcccaaagtgctgggatcacatgtgtggccattgctccctgccagttttttcttaagaagtagttttgtgtctactccagtgcatagagtaaaagccttagcattttccacaatggagtgtgaatctattaattttagacataatgtcatacctgtttgcaaaagggagctaattcttcaacttagccaaaaagccatgtaagtaagtaatcattaggagttttaactcaatataattttttgacttataatccaagataagcctagctaatataatgagcttgtttttaagtagaggtattaaagatatggcaattaattgttgaggtgtatatatgttaaatgatctgtttcttttgaattatacttctgtgatattcccttttctttttttttttattgtggtcaacccccttttctttcataatagctagctaaatgggaggaagtgtattaaattgactactactccatacccagagtctttacccactcttaatatcaaactagattctaactttaggtataatctacttaacctctttgaatagtaaatgatacctactatataagatttccatgaaattaaataccacctgtgatggttaatattaagtgtcagtatgactggctagagggatgccaagatggctggtgaagcattgtttttgggtatgtcagtgagggcatttccagaggaaattggtgtgtcatacaggaccaatagaaacaagcagatgaaagcgaggggtttctgtctgtttctctttctgtttcctcgtctctccccactcccatttctctctccccattccataaggaaacacctttctcctcctttccttggacatcagactccaggttctttggctcttgaattatgtgacttgaattagcagcctcctggggtctctcgggtgttcagcctcagactgggagatgcactgttgtctttcctgattctaaagctttcagactaggactgatccatgccactggcttctctggttctccaccttgcagatggcctctcatgaaatttccctgactctgtgagttcatttccctaataaaccctctctcttatttcttattggttctctctctctggagaatttggactattacaccatcataaactctctcaatgcagtgcttaatccaataaatacttctatagtaaaaatatattttttatttttatttttaatctgcatgtaattgtctccttatctttttattctctatgagagcatcagttttccagtttatccaatatcataaaatgacaaaacaaaaaagtaaaaatataatcaaacctttcctcactcaactagaaatttctgtttattttttccagagaaatatagaaatatctgaatcttaaagaaccttataaaaccattaggtattagcagatgcaggtgtatattgcactttcacatattaaattattgtcaagtcttctccataaagtcaaaagctaaatggaagtaaacgaaaagagaacttcacacgaagtaatggtgggacacaatggtccatggtggtacacatggactaaatccatatcaaaaatctgagttaccctccacttaaaataattccatatgtttcaaacacaattaaggaaactggaatacatttgagattcaattttgaataactaatgtgtgttaaatttgagcagtataaaagctgccctttgcaaaaacatcctggatccagatatatatttgaaaaaaagaacttaattggctataataatagcagtgatggtcacctattctttaggacagttttttaaaaaactgtttgaggctgaaatatatttgccttctgtgggcaaaacctgatgaccatattaatttaggccccaattttttttttttctgaggaatgtaacaattgactaaactgaaatgaaatactcttatttgaatgcttcccacaatgtctttgtactcagaacaaatatttagaaataggtagtaaataaatgtgtatcaaaagaataaagtctattaacattaaaataagataaaaagaaaattttaaacaaattttgtatcaaaaccacattctttatgtatgttttgtgggggaaaccatatatctgttttcaaagttggctcccaaatttttgtagcttctcaaatacacatcaagttataatgcttagtaggtgtaataatatttgtcaatgacctcagcaggtaaatttttatcattacttggcctccatatttgattaaattcaatcaacatttatttagctcctaccatttgcaaagatctgcctaatgtgatttgaggagaaaactgaagtaagacatgtctctagtctttaggaagcttccatatgcacggtaactagatatccagatttcatttggaaaccagtagactcttgagcatatgtaatgattcctagagcggtgaggtgagaagaggagagcatgtaagataagtatacatgtaaatctaacatattgagccaactgttatgaaaattacaaaattccccatggtgattaaaataagagaaaataagatcaatatgaaaatcattaatggacagcaaagttccattcatacatatatagagaaaagaaataattctcaaggcaattaaaattagaactttccaatttatctgatgcacatgtgacattcacctggtcatttagtgtaattagaaattcacattagtcatattaaattcatggtaaaatacaaagagttcagaatcccaaaccatagtgagatttaaaattatgtttatgtttgagagaataaattgagattagcatacataatttaagttttatgaaatcattctcttagatttaatagatggtgcttttatataaggaaatgaacatggctcatctcgctgtattctttttgcaattccataaaaatattctgacaagtaattttagaatctggaagtcttgtttttggggttagactattgttttctaattaatataattttaaagtttaaatttatttttcagattttacatgtgaaacattaggaaagattaatacattgctaatgacatgaaggtagtatggaaaagtaggcagaatagcaacccaaagtctaaagctatgactccaccattaataaacacttagaatttagtaatgtcacattgtgtttcttagttttaatattcatgtgaaaattacgataataacacatatctcacccagaagaaaaaaaaattgtgaagaaacttagaagttctaaaaatataaggtataatgtaaacatgaataacaataacatttatagcttgatgttttttcaggccttgtaattttcaaaatatgtgtatatagttagctgattagaagaaaatatggttgactcattactgtggaaatagcctgatacagtgaaaaggccatgttttcagttagaagacttagatttgagccctagtccaatcactttttagttttctggtttctgtcacatcattcatccttactgaataccttcagtttccttaggtgtgatctatctgaggctcatagatctgtcccatccacttgaaaatgttgatgtgatgatgatgatgagttcagatgaagcatgttaaagtacttcataagttcctaaacaaatataactttatttttcttatcttgattttctaaacaaattcatttgtgtagtatgttagctctaggcagaaggtgcaggaataagtacagttcagagaagctgtagtggggtagtcaatggcttccaagcctgagtcagaactgtcaatcttaggttcacagctgggtgtgctccagagaaactggaccataggaactgcctgtcatgaagttttataactattccaactattcggtgcaaggtgattgctgccagcacttctctatatgctatgggaaaattacacaccaaagatctgtcatatacaattgctttattccagatactcacaatccagacagagagataataaacacaaaagtactctaataagaataaagagtttaaaaccatttaccaagtttcacaaagaagaaactgttaattgacaaatgacaagttaagaaaataattgcccctctcacaaatactagagatctgagcatatctgtctgcagatgggaagaatcaagtaaggcaaaaaagattcaaaatgcacgaatgaatgcaggtaaggagagggaggataatagagcaaggggttttcagtaggcaaagtggaattagatcaaagcacaagtaaagcagacatggaaaggaggaggggcagaactctgagaacaagggcattaatgagggaatgtttatagaaatgtatattttgaaatggagagaggaagatgagaaaactgatgtctgatgttgattttatgaatcatctgatgaacataatccctaaatttatgaaactacatctgatgaacatcatccctaaattcatgaaactactagttttctaaactaagggttgtgatctgtgagtgggtcatgactcattatggagtcattgaatcattttagtgggttgcaactagtaatgttcaaaaataaaataggctgaaacagacaatattacatcccactgcattttgtaagagcaaatttgttttgtgaaattttgttgcagttaaatttatatgtatgtgtatcctgggtcatgaaataaaaaggatattttctgtggggtgcagttaaaaaatcccaaaaaccactcaactagagaatctctataaactgaacagaaatattgccaaggggcaaataaagcttgtacgtatcatgctggtttagatttgtgttgagtagttaatacaatgtctgccttattccagtggttctcagaaggccagaagcacacattaaggaactagtgatgttgatcaaaggttagaaattagacccagtggagttagggctgttagggaaatgaagatgccctgggtgttgttgaggctaggtcaaggtggcagacctgactttccagactattgcaggaggatcctcaattattaaagcttcagttgttggaaaatatcttttccattgagcttcaagtctaccttcttgtaatatctactcttaatatctatgattttgtcttctggtgccacacaccataaatctaatcacttctctacaacaaggagttttatgtttttaaaaatagctattgtcatttgggttcacttgggtctaaatgtaatgctagttcagggagccctagaggcctggaatcttataagagtgagtacaaaaatttagttgaaactgtaggcatgataagggactggtttgtgcaggacagagtctgtcaaatctgaggatgcccaaactgaatgggacaggtgtgtgggtcagcagagggcacacacatatgcagaactgccaatcaggaaatgagatggcaaccacaacatcatttctgaactcttctccctctctttgaattggcaatatgccttgagagagggcctgataccccagagttcaagtcgctcttaaatcttcattcctgctttttcttcagctttttctcatgggttttcagcccttcatatgtcctcagaacagcacagcccttcaacttttctaaatccagctatttagaataccttaaatgtatatcactggccagtttactgtgcttctgaacatgtaaggaacttatcaattgaatataaaattaagctacttaaaaatatttggataaatcagctgtttttgaatgactgattctgtgtttggtcacatcgatagacccatttatctatgagggttcccatatgtagattagtttatttatatctacagatacattgagtggggaatagaagtttcgcctataattttactcacttttaacaatgtggactttctgtctatattatgtcatttttctttatatatatatataaaatttaatagattgacatttttattacattagttttgaaactttcattgaaaaatctagtgtttcattgaaataactgtattatatatggtctcttataattcaactgagtgtttaatattgggcaaatacattcttatgtcattaatggtatctaacttctcaattaaaataaattctctattcttgtgagttatgtattgcacattaaattaggataaaataataattaattaattgtaaatattttgaataaaatgtcttgatttctagttactactagtatttttaaaagagaagcatgatttatttttcagacaataacttacaaataatcatattcaaattgtcattttataagtaggaaactgagttctacagatatttaataattttcaaagtcattttgctagtcagtagtaacagaacctagcctgtatttctagcttgaataagtactttagcttcctcaaactcttgtgggttaggtctgatactgcaatagaaaggctatgtctatcagattcccttttggttatgtgagctttgcgtgggtttgttcatgtaaatcccatgctgaggtgaaagtttttttttctctctttctcttttttttctgtaaaatgagcgttttgtactgctaacataattcttatatattctaagtgaaaaatcattacatagttgtcaatgtatctcacctctccctaaataacctctactatttatgatttagaaatgaattccctccttacttgacctcttgcttgatttataatcgacatagttcctatattttctgcttatattcttcattttatatttagtgcatctcaattgatttttcttctttaccttgcatttttttccacttttatcttcatcttccttggctctctacactgagtataaatactagaccatagtttcaacccatgggagcagagcataatttcttgctgagtacttaaaattttcctatttcattctattttataattgctttacccactggttttcagaagataggccttcattattccaaagtatgcttggtttattgtttaaaagacacaataggctcaccccactttagtccatttctagccatgctttattctttgtttaacttttaattgctattccaaactctacagtgtctgtagcagatgctggcactgccgtgtctgtattactcaagcctttcaagtgtcctctaactttctcccaactgtcagtacctacatctctgtctctgtgtctgaggcattcgtttttgtttttactgttgttttacttcctaaaaccactgaaggccattctgctcttacgtagaagagatatgaggctggacttaatacaactttactcccccaaatccctaacaaataaccctactgaatataaacattccattccctttataaacaggagaattctgaagcataggttttatcccaagttccagtacttttccatgagatgaagcttcaattattcactccaggtagctgatttcataacaacctttgttggtgcttttttccttctctgaaccactacctctactccctgccagtgtttcctggccccctgaaatacactatttaccctcaaatctttgtttcagagtctgtctcactaatttccttgaagctatagctctctgatttatgaagtagtgacaacacttgagttttggcagaattaaataaatgtgcagaacctgattcataataggtactctaatactattgtacctagttaaaataaatgctgtctttaacctctgagtactttctcccaaatataattttgctccctctatatctcaatagaatgagctattttttactgcatggacagagccatgccagtggtcaccaatgtgataaatctgagggttgcatatgaagagttcacacatttttcttttatgcctgcaactccattgctagtcacacattttcacgcagtgagaatagtctttttttttttttctgcagtcctattttaatcactacaaacactacagggtaatgttcaatgaatggttattggaagagtctacctttttcttttttttttttttctcttaaaggaacaatatgctatgatctttcacactttccaccaacttctcttctccaggcttttcctacttatcctgtaaaacttaatttacaggtcttctacaaagcttgacctcatcctccaaagcttttagttacttttactctaagttgccatagcttttaatatttatttcaatcaaagtgcataatctcctgaactgttaacttatttatctcattagcaagatccttaattgatgaggctgggttatttattattgcaactcaacacctagaacaatgtttatgcatactgacactcaactgttagatgaatggattaaatttataaatactgttggaaagaagtaagctattgttaggccttaaagtggctttaattgaatctaaattttaattgaataaattggtacatctcaattgattttgcttttttaccttgcttttttcccctatatattaaaattacttttaattgcaaaaattgtaattacttttgtaccaacctaataaatagttatggaatatgtattattccactgcctcaaatagacacagctgactatttctcatttaccacccctacttttatgttatcatgtaattaaccatattctcctgtttctaatgtgtggacaacatttaacttgctaatggttgatctgtgaatattttttactttagacacaaagaagcctttaggtcatattatacattgaaaaaaaaagataacttaaaataatacagtattaggatttgactcaatttctgcttaagtaaaagcaaagaaactagatatcaaaatgcatactttttccaaagcatatgtaatataaaattacatttatttcattttgttatatttgtcataatttatcacctaatttataatgtattgatcttctaaatgttggaatacaaagcatattagtttaataaaaggttgaataatgtgttttacttaccaattaaatcactatatagtatagcagtgctgtaggaggaaaactagtcttccaaaaatcaaaattttcatatatgttggaagagttggctatcacaatgttacataggagtagattcttgttttctttttaatggatgctgacaagaatgcctgagaatcctatctgctggcattggaagattttacaaaatacaatctgatagtattttccctacttaacattaatcttcttatataatcacttggtcttctataaaattatttgttaattaaaagaagtcctatcattactcttgatactgcaaaaaaatggcctttatgagtaaacataaatatgtaactaaaacataaatgaaatcaggcagttacaaataagaaaattagtcatttggggcaagctgaagagttaagaaaacacgaggatataatttactggcacttcagataaaatagaaagaaataatggggcttctctctaggtatacatattataaaattatagtattttggcatatttgtagtgttgctatttttatcagaccagaatgcaccattctcagctgtatttgagttgagaagaaccaaatagtttttaatattgagtgttcaaaatattgcatgggatatacttatactcaaaaataatcattattcatctgaaattcatatgtgactgggcctcctttatctggtaaccctacctagtaggaaagaatgttgtgtacatttttaaaatactgattaacctagtaatatgattatttaaggaaacataaacaaaggactatttctgaaatattttccagcgaagtttggaaagcagtcttatctattgtgttaagataaagaagggggaaagtcatattttgttttgttttgtttttttttattaacttcaatttcttatcacttttgaacatacaatatgtatttacttaggagtcaaaagttcatgtggtaaataaacactataaatgtaaaccaaggatcaatgcttcaaaagcaaatttattcagtataaaatgtcagagcagcttttatatttccaaatacataagatgtaaattggaaagtgtttgcattttaactagctttaacacatccattatataataacatgagaggaaaaaggattacagcttctattttactacccctttaaaattccttcattttcatttttgtataatgtggtttagaggagaaaaatcagaactgacaatattatttaatgaaacttttaattatgtagataatgtaaatctaacaccaagtctgcacatttataatgctgttttcaacattgtaaaattgtggtattcaacagttgggaaatctggagtaatgtttgtttatctctcagaatttgctatacagcttatgacaaagaattcaatgtgaaccacttctgaattatgatgattatatatagatgaaatgtttcaaaacttactacatgtgaagcactttgcctcatgctttgcaaacattgtatactttaatattacgagttttaaaatattagtatatttgaaaaatcacataaacacttccttttcagatatgttttgctagataaccctctaaagataacactgaataaagtaaaaatccattgctgaaattgcacaaaaataaaaggtatgcaaaatcgaaaataataaaaaagctgtaactctgagtgaaaagtgaggattgaagatggctatcacttaaagaattttgtattatcctagaaaacttcatcttttaaaaaacagcttcatagcacctggagacaaaagataaatactggggaatgcccaagctatagagtctaagaagataaaccccggacataaggtttacatcctcagcttcaaaggagatggtgcaaaactaaggtgtgacaaagtatggatcaaaacattacaaagaaccttgtccatcatccatagtgctaagggaatgtgaaaaaacaatcaatctgagaattaagttctcagcagagttttagtataattcacaatctttatgatgtgaacaatctcaaatttacttattttaaaattgtgtcaggcaacttacactggcaagaggcaaatgtttcctagaggaatgacaaattaaactatgacatcacataatactcaagttaaagttctaagaaaaataaaaatctcatggacaaaattcacaaagtgcaacaggaataaggtgtgattaataagagattaatacaaacatcaaaatcgtacccacaaagatgttaacatactgaaaatattacaaccaaaattacaaacataactatgactaggagattttaataaatgagaagcttgaaaatacaagcaagtaaataaaaactcagaaatatttagaaaacaaaaaataaacttctaggattgaaaaatataaattaaaatgagaaagaaacatcaatgaataataagctgtggcctaaaaaatagacttgaagaaatttcacagaatttctcacagagactttggttggaaaaatatgaaaaaggaataatagacatactgctcttaactagctaagggaaaataataaaatgtaaaaattatagccgtttaaatagcagaagagtttcaagtggccagtatttgaacacaatgaaattaaatcagaaaccaataagttttaagtaggaaattttacatacttggaaattgtaagaattacacctaaaatttcatgaatcaaagaaaatatcaaaaataatgatggaaattaagatattttatttttccaagatggtggattagaggcttttagcatgcttcagctgctttgaaataggaacagtgcataaatattaactctgtgaggtttgattcaagaaagacaatgggaatccaccagaataatgaaggacaccctaaatcctgggaaggagaacatgagcaaaaagcccctgtgacagcatccagctgttaaaagtgagtgaaaccctagcacacgagaaaggcagacagcctccttctgtgactcaactttccactgaggatctaagtaacccagggagagggagagccctttgtttcactcaagccatggagctaacttggggagaggcttggaggtgctgtgaggaataaacactgggaaaagctgcagacattttcccagacctgagaccgagagcaggatgtcattataacctgggtgcacacaaagtcagccattttgtggtgactccgcaatgtggccacttgggcattttagtcttggggcagagatagaagtacctgctgtggaccagggtacagacctccacaactagaacaatagaaagtgtctcagcagcaggtgctggaattgtgctccccactgtgggacaagaggagatatatgacagctgcagtttctcctgaacaataagacttgcagccaggagcagtttgtcaacctggaactgtcatttttcagtgccccagctgctaccctgagatcatggtgcagcaggcctctttcttttccatcacaaggcagaagtctaggcatttggaacacctgcttgcctggaccagcagcttaagcctcctcacacttcatggacatagactgtggtgcagcagggccctctcagatttccaggcatttgaagcagctactcatctggattagcagcctgacctgccccacatttcctgtgcagagatcctggtgtaaggagctcctctgtgttttatacccagtgagatctccaggcatttgagcacctgctcacttggttcagcagcctgagccatttcattcttcctggcaatagatcatgatgcagtagggtcctctctgctgcccacccaggcagatctccagacattctgagcaaccactcacctggataagcagcctgaactgtcccaccctttatgggcatagattgtggtgcaataggaccctctctactccatacttaggcatatctccagatattaaaagcatatacttgagcagattggcaacctgagctgccccacccttcctgtgcagagatctgtatgcatgggtgccatctctgcttcatgtccaggcaaatctccaggaattcagaccacctgcttgcctggttcagcagcctgagttgccccaccattcctgtgaggagatcttggtgcagggggctcctctccactacatgcctgcacagatctccagacatctggagcacccactctcctggattaggagtttaggcttccctcctacctgtgcagagaactcagggctgaggagatttcctagttccacacacctaggcacacctctgggcacttggtggctgcccagtggattctcctttgacactgatgtctgtgcctgacatcaggagaacagaaactggacctgcctggtctagccttgtttatcagggcccccacccctccagggatgagtagggtgttcaggccattgtgcactccacaaatcaggccattgcctgaggcaacagagggcttctgccattaaacaaggatcaggtgtataccgagctgtgttggtcgcagctagctcttaactataagcaccatctactggctggtaggtccaaccacagagcccaatattcaactgctgacagaagcgcataaggctatagaagtaaaaccaaaacaacctacccaacattgtctacaatcacataaccagggatgggtaaagggaaagggaaataaaaaaataataataatattacagagaaataaagaaaaagaaaaaaaatctacccacaggaatataattacaaaaattagaagtcctagtctccagatgacaaggaaccagtgcaaaaattaaggcaccatgaaatatctgaatgtagcaacaccaaaggatcacaatagctcttcagccacatccctaaccaaaatgaaaactcagaaatgacacaaggaattcaaagcatggattacaaggaagctcaacaagatccaagacaaggttgaaaagcaacacaaaggaatttctaatgcaattcaggaaaggaaagaagagataagcatattaaagaaaaattaatcagatcttctggaattgaaaaactcacttaaaggaatttcaaaatacaatggaaagctttatcaatagactgaaccaagccaaagtaagaatttcagagcttgcagactggtcttttggagtaagccagttaaaccaaaataaagaaaaaaaaagttttaaaaacaatgaacaaagtcttcaagaaatatgggatgatgtaaagcaaccaaatctatgaattcctggcattcctgaaagagatagagaaaagatgaacaacctagaaaacatacataagggaatacttcaagagaatttttcctaatcttgctacacagtagacagcaagatacaagaaatccagagaacatctgtgagatactatacaaaacgaacaacaccaaggcatgtagtcaccagtctgttcacggtgaatgctaaagaaaaaatcttaaaagtagttagagaaaaaggtcaaattatgtacaaagggaacactatcaggctaacagtgagagttctcagcagaagccttacaaaccaggagagtttggaggcctattttcagcattctttgaaaaaaaaagaaaaaagaaagaaagaaggaattaatgaaattccagccaagaatttcatatcctcccaaactaagcttcttaagcaaaggagaaataaaatctttttcagaaaagcaagaagtaaggcaatttataatcactagattattcttacaagtaatacataagggagttctaaatagagaaacaaaagtacaatacctgctaccacaaaaatacacttaagtacctagcccacagcccctataaagcaaacacacaattgaaactacaaagcaaccaactaaaaactcacgacaggatcaacctcacgtatcaatattaatcttgaatgtaggctaaatgccccccttgaaagtcatagagtggtaagctgaatttaaaaaaagcacacagaagatccatgtatctgctctcttcaagacaaccacctcacagtagcagcacctatactgtcaaagtaaaggattggaaaaagaagcatcataagaacagaacacacaaaaaaaggcagggtagctattcttatatgaaacaaatcagattttaaaccaataacagtaaaaaaaaaaaaaaaaggacaaagaagggcattacataataaagtgtttgacacaacaagaagacttaactatcctaaatatatactcacctaacattggaacacccagattcataaaacaagtacttctagacctatggaaagatgtagatagccacacaataacagtgggggacttgaacactccgctgacagcattaggcaaggaactaacaaattctcagtttaaatttaacaattggccagttggacctaatatatatgtacagaacactctacacatcaaccacagaatatacattattctcacctgcacatagatcatacaccaaggttgaccacatgttcagccatatagcagttttaacaaattgttcaaaaaatcaaaatcataccaaacatactcttgaaccaaaggggaataaaaacagaaatcaataacaggaagatctctcaaaactacaaaattacatggaaattaaacaccttgctactcaatgacttttgggtaaataacaaaactaaggcagaaattaaaaaaaattatttgaaataaatgaaaacacagatacaatatactaaaaatctctgggatgcagcaaaagcagtattaagagggaaatttacagtgctaaatgcctaccacaaaaaagttagaaatacctcaaattaacaatcaaacatcgcacctacaggaaataaaaaacaagaacaaactaactcctaaggtagctgaagaaaaaaaataactaaaatcacaccagaagtgaatgaaattgagaccccaaaatctacccaaataatttatgaaaccaaaagttgggtctctgaagaataagtaggattgatagactgctaactagactaacataggtaggccagctgtggtggttcacaccagtaatcccagcactttgggaggccgaggctggtgaatcacaagttgaggagttcaagaccagccaggccaagatggtgaaaccctatctctactgaaaatacaaaaaaattagccaggtgtgttggcgggtgcctgtaatcccagctactcaggaggctgagggagagaactgcttgaacccaggaggcagaggttgcattgagctgagatcacgccactgcactccagcctgggtgacagagcaagattttgtttcattaaaaaaaaatataggtaaaaagagagaagatccaaataagcacaatcggaaatgacaaacgtgatgttacaattgattccacagataccaaagaccctcagatattgttatgaacactcccatacacacaaattaggaaatctagagaaaatgaataaattcttggaatcacacaatctccctagattgaatcaggaagaaattgaaacccttaacaaaccaatatcatgttctgaaatggaatcagaaataaaaagaaaaaatctaccaactaaaaaaagccctggatcagatggattcacagcagaattctaccagacatacaaataagagctggtactaatcttcctgaaactattccagaaaatcaaggaggagggactcctccctaactcattctacaaaaccagcatcccccgataccaaaacttggcaaagacacagcaagaaaacaaaactacagaccaatatccctgatgaacacagacacaaaaatttctcaacaaaatactagcacagtgaatccagcagcacatcaaaatgttaattcagcatgatcaaataggcttcattcctaagattcactgctggttcaacatatgcaaatcaataaatgtgattcaccacataaacagaatgaaaaacaaaaaatatgatcatctcaatagacgtgagaaaaagcttttgacaaaatctaacatgtcttcatgttaaaaacattcaaggaactaggcatcaaaagattgtacctcaaaataataagagccatctatgacaaacccatagccaacatcatagtgaatgggcaaaaactagaggcattcccccttgagaactggaacaaggcaagaatgcccactctcaccactcttattcaacatagtactggaagtccttcccagaataatcaggcaagataaagaaataaaaggcatccaaagaagtaaagaagaagtcaaaccatctctttttgctgataatatgattctatagctacaaaactctaaagactctacaaaaaggttcttggaacacataaatgacagcagcaaagtttcaggatacaaaatgaatgtacataaattaacagcacttctatacaccaataatattcaaggtgagacccaaatcaaaaacacaatttcatttacaatagccacaaaacaaaaaacaaattaaaaaacaactaggaatacatctaaccaaggaagtgaaagaaacaagacatctacaaaatactgctgaaagaaagcataggtaatacaaacaaatagaaaatcattccatgctcatagactggaagtaccaatatcattaaaaatccatactgcccaaagcaatgtacagattcaatgctatttctatcaagctaccaatgttatttttcacagagctagaaaaaaactattctaaaattcatatggaaccataaaaagccaaaatagctcttcaaaccataccataaggctacagtaaccaaaacggtatggtattggttactgtactttctattacaaaaatagaaagaccaatggaacacaatggagaacccagaaatgaagctgcacacctataaccatctgatctttgacaaggtcaacaaaaacaagcaatggggaaaggactctctagtcaataaatggtggtgggatacgtggccagccatatgtagaggaatgaaactggacccctaccttttaccatacaaaaattaagtcaagatgtattaaagatttaaatgtaagacctcaaactataaaaatcctagaagagaacctaagaaatggcattctggatgccggccttcagaaataatctatgactaagtcctaaaatcaattgcaacaaaaacaacatttgacaaatgggatctatttaactcaagagcttctgcacagcaaaagaacctatcaataagagtacacagacaacatacagaatgagagaaagtattcgcaaactgtgcatccaacaaaggtctaatgtcgagaatctataaaaaacttaaataactgaaaaaacataaacaaataacccccttaaaaagtgtgcaaaagacatgaacagacaattcccaaaagaagatttataagcagccagcaaacatatgaaaaaatatcaaaaccacaatgagataccatctcacatcagtcagaatggctattattaaaagtaaaaagcaaacaaacagaaaacagtagatgcttgagaggctgtggaaaaaagggaatgcatatacagtgttggaacataaattagttcaactacagtggaaagaagtttggacatttccctagaacttaaaacaggactaccatttgatccagcaatcccattagtgggtggatgtcccaaagaaaagaaatcattctaccaaatagacacatgcacccatttgttcatcacagcactattcacaatagagaagacatggaatcaatctagatgttcatcaatggtggattgggtaaagacaatgtagtacatatacaccatagaatactatgcagccatataaaagaatgaaatcttgttctttgcagcaacatgaatgcagctggagaccattatcctaaacgaattagcacagaagcagaaaatcagatgcctcgtgtttgcacttacaattgggagctaaatactagttacacatggacataaagatggcaaccatagacactggaaatactggggaaggagggggacaatttttcaaaaactattggttactatgctcagtaactgggtgacgggaatctatcgatcccaaacctcatgtgtcagatattcccaggtaacaaacctgcatgtgtacccactatatctaagatgaaagttgacattattaaaaagaaaaagttaacataaataaggacagaaaaaaatctataattaaataaatatgaaaatgctgcttttcaaaacttctgggatatagctaaggtaatacttataggtattctagttttaagagcttgctttagaacagaaataatgctaaaagttaaagctaagtatccaacttaaaatttaagtatttttataaacaagagagtaatttaagcataaaaaactaaaatgtaaaaactaataaaaattgaaacagaagatcaatggagtcaaaagaaggcaatttttataaactaaaaacatgccttgttaaattaataaagaggcatcagccaaaagtacattaatatgaaagacaatataggtataagtagagatgctattgatgttatgcagctaataaaagagtattaggaaaaactttattcatgtaaacatatatatgaaatgaatacattctcataaaaattgatttcaccgaaactgattccagaagaaatagtaaaccttaatggttcagtcagaatcaaaataactgaaatttcttttaaaatcctctcattgtgtaaacaccagttccagatggtttcaaggtaagattttcaggtaattctaatattacacaaaattctgcagaccattttaaaaagaaagacgacagaaacagaagattataaaaaataaaaaatgtatattacaggcccacctagtcattaacagatacaaaaatagtaaatacgttatttgcatctcaatccatcaatttaaaaaataaaaatatataggtataatctaagctgaatttctccaaagaatgcaaaccccgtttatactagaaaatggatgaatgtagttcacctcattattcctactttagatggaggggaaaaattaatattcaatatccattcagaatgaaaaccttaggaaactaaaaaagaagggaactcccctagcatagtaaatgatttctactaaaatacaatgaatatgttattaatggcacatgttgaaaccttcttttaaaattgtgaacaagaaacaagtcagtggaaagtttctgttatcacaatttctatttaacattgcattgacggttctagctagtgcggtgagataggattaaaatgtttaataatcagaaaggaagaaacaatgctgtcactatatctacaaaacataaacttactgattattagaattaataatttagtcatgttactagataaatattaatattcagaagaaaaccgcatttttagataacagtaaaaatcacttgcagaatataattgtattaaaagaaaattacaataacatcaaaaatatgaaatgcctaataattaaactaccataagatgagtaaatcctttaggaagaagactacatacaattttatggaaggatattaaagaatacctaaattaaaaaaaaaacccacaacacattcttagaaaatttcagtaatataaatgcatggatagtcccttaacttaaaatactccttcaaataaaaatcccaccaggatttcctgtggaatgtggaaaatttactccatataaaggatgaaaacagccaggacactatttatttttatttttatttttattattttttttttttgagtcagaatctcactctggggcccaggctggagtgtggtggcacaatcttggctcattgcagcctccgcctcccaggttcaagcaattctcctgcctcagcgtccccagtagctgggattacaggcgcccgccaccacacccaactaatttttgtatttttagtagagacggggtttcaccatgttggccaagctggttgggaactcctgaccccaggcaatccacccaccttggcctcccaaagtgctgggattacaggcatgagccaccacgctcagccaggactgttaaagaagaaaaataaagaggggactttttgtttgaagtattgtaatatattaatctgttctcacactgctatgaagaaataactgagactggctactttataaaggagacagatttaattgactcacagttccacattgctgggaggcctcaggaaacttacagtcatggaggaaggaagaggagaagtaggcgccttcttcacaggggtggcagaacagagtgagtgcaagcaggggaaatgccagacgcttacaaaaccctcagatttcataagactcactcgctattatgagaacagcacgggagaaactgcccccgtgatccagtcacctcccctggtcctgcccttgacacatggggattatggggattacaattcgaggtgagattttgttgggcacacacagcaaaaccatattatagtgattaaaacagaacagtggtgaggaagagatagacaagtaaaaaaatgggacaaaatagcagccttgaaactattccattcatggatgcaaattggatttacagcccagtgggcgttgctggttagtgtgggaaaagagagcccatttcattaataatactggaaaacatagtcatctatttgaacaataaaataaaattggactcctacatcatactgtacacaaataaatatcatgtagattaaagacttatctgcaagagtataggaaaatatctttataattgtagtggaggaaataattttttaataaaatcataaaaagcagatagcctaaggaaaacgataatttaaatgatacaaaaaaaccaaaaactttacagagagggaaatataagtaataatctgtaaaaaagtgtttctaatatttacaactgtcagagaactagtattcagaccataaatcagtaaaaaaagattcataaaagtgagtaaaagataaaaataggcattttgcagagggggtaatataaattgctcataatttttttaatgcttaagcttaatactaattagcaaactgcaaattaaaaccaaaacccaattccaaaacataatgacctgattgcaaaaagtattaaaagcacattagtatttgttcaatactagtgtgctgggatgattttaatgataagaaacactttatttttcttaaaataatttagcatgggtctgctttgtgaccaagcaaattcataatcatgtacgtagactatagtaacactttcacatttgtaccaagagacttttacaatattctattcttatcaaaactgtttataatagtaaaaaattggaaaccactcaaataagccattaaaagggtctggctgctgggcacagtggctcaagcctgtaatcccagcactttggaaggctgaggcgaaaggattgcttaagcccaggaattgaagaccagcctgggaaaaatagcaaggtgctaaatatatatatgcaagctgggcatgctggtatgtgcctgtggtcccagctacatgggagactggggtagaaggattgcttcagcccagaagattgaggctgcagtgagctgtgtttgggccgctgtatgccagcctaggcaacagagcaagactgtcaaaaaaaaaaaaaagtggactagttatacattcaaatactgtaaagcacttaaaataaacattctatcactatcacatccaaatagatgaagcttaaaaacataatactcagcaaacaagccaactcaaggatgcataggatattatttcatttgcataaatatccaaaacatatgaaacaacacatctaggcttgctcataggtggaaaaattacatgaaagttaagtgagtgttttccatactcttcagaattataatttcctctggaggaggaggatggtgcagctggctacaacagaggcctttatggcactagcagctggtgacattcactttcataacatctggtggcgattattcaggtgtgtttacaattattctctaaactacatatgtttaatacttttcatttatgatagatataagaattaaaacttttttaaaaaagagaacatgtatatgaaacttaaaatgccattgtgagccaggtgattgagttagacaagttactgctgctcctagtgtgttactaccctgtaaaatggctcattaaagaacaaattttgggattttttttctcatcatctgtgctgagtttaattaaaaacacacttattatactgaactataggatggagtttctcctgtagctggagaagtgtccctcagttttgtagtgactaaatactggagtcaatttctgaaggaaattagagattatccttccacgaattttttaaaatatgctttgaatatagcatattatatgtaaagttctgcatggttgttccttcataaaatactatattttataatgcactagaaagaatactgtgatagaaatcacaaaatttcagttcttgttttgcttttatttcttataagcttaatctctgagtcctaatttaatgcattatctatccaatgcccagatcatgttgtattacataatgtttacatgaaattatgctaatagtaatgtcctttacatataaaaggagtcactactctttgtatttaatcactcttttaaatgaataattggcatatatttataattgtatatatatatttttaacttttattttaggttaagggatacatgtgcaggtttgttatagaagtaaattgcatgttgtagggctttggtttgcagattatttcactactcaggtaatgagcatagtacctaataggtagttgttttattctcaccttcctccaactctccatcaagttggctctggtttctgttattcccttcttgtgttcctatgtactctatgtttagctcccacttatatgtgagaacatgtgacatttggttttctgttcctgtaatcactcttttttttccagtgagaagttttacatgttttcaggtgcattatacagatattgatatctcataaagtcaccccatccaaatttgccaaccttgtataatatgtcatcaaaatatgattggcccttcatattcattggttccacatctgtggattcaacaaactgaagactgaacatatttggaaaaaaatacaataaaaataatgcaacaataaaaataatataaataaaatatagtataacaactatttatataaactttacattttattaggtattataaatatctggagatgatttaaagtatactagaggatgtgtataggctatctgaaaatactacaccaatttaagtaaggaacttgagcatctgcagattttggtaaccatagggatcctggaactaatcctctgaagataccaggagcaactgtgtatatttttcacccccttaattgctcagaatcctgctctgctagtctaatgaataatgaaaatttaactgtgtcagtgtggctatgtgtaataatagcatggcagcttaattttggttacatagttgaattataacaaaataatttaggaaaagccatatagttgaataaatggttattccataagctgcaatgctctgtaattgtagaatcaaaaacaggtgaagatggtagcaatagatatacaatttacccttgaacaaatgggggttagggaaaccaacctctcttccagtcagacatccatgtataacttttaactcctcaaaaacttagccattaaaagtctactgttgaccacaagccttaacaataacataaacagttaacacatattttgtaaatgtattatgtactgtattcttacaataaagtaagctagagagacaatattttattaaaatcataggaaagaaaaaatatattgactattaagtcaaattggatcattataaaggttttcatcttcctcatcttcacattgagtaggctgagaaggaaataggatgaaatagtgaaggaggtggaagaggaggcaggagaggcaaacatactcactgtaattttacaaaaatacatcataatttctgtctgattttttttttgctttttcatttctaaaaaaatgtttctacagttaccaatcctttctccaaaatttgcccatatcatagaagggttcatgtcataagataagtcaaaagtagtcttaaataatcagaacccttctaccagattgtctaacgtcagttttgttttctggcactgcttatttgatgtcttcttcctcatcatctagctgtggttcagaagccttaatttccctcatcatcttttgttaattcctttagtgtggtgtctattggctctactttttctaagatccatatcttgtaaccttgcaccccaactgttttattgttgtggttgatttagttttgtttttggtttttgccacatccacaatctcttttatgatttccttgattggctctgttgtaaatcctgtgatgtcacgcataatacctgggtacagttttctccagcagtaatttattgtttcagacttgatgactttcacagctttttctataacaatgatggcatcttcaatggtataatccttccagactttcatgatgtattctctatcagggttctcttctattgcattgacaagactttccatagaatgccatgtgtaatgagccttaagcgtcctaatgaccccctgatttagcaagtagactaagtcattgccttcaatgttgagctcatgaagttctgggtgctaggggcattgtccaatagcaaaagaatgttagaaaggcagtcctgtattggatcccagcactttgggaggtcgaggcaggcagatcacctgaagtcaggaattcaagaccatggtcaacatggtgaaaccctgtctctaataaaaatacaaaaattagccaggcatggtggcagatgcctgtaatcccagctactcgggagcctgagacaggagaattgcttgaatgcaacccaggaggtggagattgtagtgacctgagatcacaccactgcattccaacctgggcgacaaagcgaaactccgtcaaaaaaataaaaagagagagagagagggagagagggagagagggagagaaagaaagaaaggaaggaaaggaagaaaagcaagaaaggcagccccttactggggcttgtgtcttcatggacaaagcatcagtgaaattaatccagaattctcattgtccaggctttcttgtggtacaacgaagactgccagctggtgcttatttttttcctttcatcgttctggggttagcagctttataggtaagggcagtcctaataataaacccaagtgcatttacagtaaacagtaaagttagcctatcccttcttgtcttaaatactaatgctcacttctcttccttactaataaatgtcctttgtggcacttttttttttgaataaggtacttttttccttgttaaaaacctatttaggtagatatactttcccctcaatgattttcttaatgggatctgggaattttgctgctgcttggtctgcaaaagttgtttcccctgctgtcttgacattttgtaaagcctaaagctatttctataatcatcaaaccatcctttgctttatatccttcactgtccttttgatttaagttttcacataatgacttcattttttctcaaatcacattagaatttataggcatgcttttcttataccaatcctgaagccacataaaagctatgttttcagtaaacggtaaaacaagtatttcacaaaaacagtaagattttgtgtctgttggtataactgcaatgacaacttcatgaatttcttattctgtctttaccatggttcttatgttggattcatttatcttgtaaaagtaggcagctacagctgtatcgtatcaagcaattcaactttttcttgcaatgtcatgagttttctctgcttcttgggaacacttccagcatcactagtggcacttcatatgggttcgatgttgttcttcaaggtttatggcatttgcactaagcacaataaaaatatgagaaaaccatgatagtttaccttttactgctatatgcaatttactgtagacaggaactgctcaattgaaatgagtactgttacaagggcattttaagcagataaaacacttcagctcaaggcaatagcaacaggaggtgactataaaattattacagcaatagagtaagtactatagttaattttatgcagttatgctttactattgcatctgtatcttcatttgcatttctctgaactgtaatagagccatgaataatccatttgtatgtataagttttgataaattttaactttttgtaatagacttgtgatatttttagtggtaaatgataaagcagactagtatatacatgtattttgtgcaacatgacatacctttttcttaatttttgatattttttgacctatattttatatatatttgtcttcaagttttttcaaattgtccaaagtctccccaaatgtttcttatatagttattgaaaaaatactgtgcataagtgacctgtgcagtccaaatctgtgttgttcaagggtcaatagtacacatacagtcatgcatctttttaaagacatgcatatgttctgagaaatgtgttgttaggcagtttcatcattgtgggaacaccaaaaactgcacttaaaaaacctagatggtatagcctactacacacctaatctatatggtatagcctgttatccctaggctaaaaacctgtaccacatgtcattgcactgaatattgcaggcaattgtaacacaatggtaagtatttgtgtatctaaacatatctaaatgttgattatctaaacatagagaaggtatagtaaagtacagtattatgggaccattgttgtacatgcagtgtgcatcaactgaaacattgttatgcagtgcctgactttattttccatgaggtgtgttattatatagcttagtcatttgaatccgcttttcatcagaatccttctcactttctgggtttattataatgcttgtatttgtttttatgttgattaattagaaatatttttggaaagtacaactctagaacttacgtactctaccttaatgaactctaattttaaagagggagctttagaaagtcttttaaggaaatgaaaataccttgtgaacttccaaaacactcatatttccccctttttcaacttcgttgattgacctggaacccttaaaggagaaaaagaatctatcaagtagagctggatcaagtgtaattttggtttgttttattttttaatagttttttctctcagggaagtttcatgtctttcgtcagtcatgggagtttctctactatcatttattcaatttcaattatgcctctggcccatgctcattattttcttgctctggcagtttagcataatggttaagagcatgccctcttgagcctcaggtccaattcctggcttctctatttattagctatatgaccatgggtaagttaattactttctcttcctcaaaggcttgctgcgatgagtaagtaaatgaatatatgtaaagtgctcagacagtgctcagtatattttaagtattatgtaagtgcttgctcttattataatgattacttttatatagaggtgtaaatctttttatctttttttccattcctctttcatactttctgtctgtataacatttggaattgcattatgagctactaggcttggtgctccagaatatttgtgtgcccaatagctgtgtccacctttcttttttagtctatataattagagtttgcttagttttttgttacaatctcaatcattatacttttatatttcaaaaatctctaataatttcttattgtacaattgcttagtcttatataggtataatatcttcctaatctctctccagatatttggacatattttggacattttacgaaacacactttttgctaactctttcaacacctgtaagtgtctctgtcatggttctgatatttgctgctttcttgtgcactttgtagcttagttgtcctgtacgactatctcctcttttcattcagggagatgggtgtgagctgaaatgtggcttggatacttcgttagtgactgtgagaaagtggcatcccttggcagctgtttttctgagtatgggcacttgcaaccaaatgttgtgagccattcgggacacattatgcctccgtcttcctgacctccttcagttaatattcctacctcgggacttttccattgttgtttgccaaggttaacttacctgactactccagctgtgagaccatgctaataattctggtcgttgatccttagcatcttattcactggttccacgccctaccagcacagaccagttaatgttttattttaaagttgtgctttgatatggcttttttccgctgcttgttgtttctcaggattctctagactctgtagcgcatctagagtgactttttgtttttagtggagctatgacttatttttatatatgacaaaataatgtctatgaatttgatgcagaaggagaaaattgcctaatgtattcaagtctgctatgttgaaatagaattcaatagtgaccttcaaaaagatatgttctaaccacacgaacctgtgaatgtgaccttttttttttttaaggtgacttatgcaggtgtcattaagtttagaatctggaaatcaggtcatcctcgattatctgggtggaccctaaagttagtgataaatgtcctcacctgaaacacacagggagaaggaacagaagatcatgtaaagatagaggcaaagatgggagttatgtggtcacaagccaaggaactccattaaccactggagctggaagaggcagggagggattcaactttaagattttagaggaagtgtagccctgctgacattttgattttggacttctggctgccgggctatgaaataataaatttctcttgtttcaattaaccaagtttgtggtaatttttaatggaagtcctaggaaattaataaaggtatcttcttctattaatacacaattttagcagaaaatattgtctctcatttcacagaaaatattaagacagtacataaaaccttccttaatttcctccttgtcacttacaaacatgtttatatccacaaccatacctaccttccacatcccacctactgttcaaagttacatttgtgttagggaacctctgccatttctgcctctgctttaccaacaaacgtctttgtaatctggtagacattttccttttacatgtgaacagagccaagcctctttgaaataaaaaatcctgcaggtttaacaaatcacccttcaacttctgctctggattctgtcttcattttacagccaatcgttgagggagagcagccagcacacaccgtcctgtctgtatcacatatctcaaactaatacagtctttctcttgaggctaatatgccactgaaagctaacagtaccaaggtccttcacattgccaaagcctgtacacatttcctttgcttatatcaattgccctcactttgatatttgactccggccattgcacaccacccttcaatctctgtttaccctcttcttctgtttcttctgattgactgtttcttcccaatctcacacataggtttctttctctccccagtgcctgttaaatatcaggagtataatccaaggttctgcctttgtccctcacttcttgctacattgtgtgatctcaaggtgaccacattcatactcatgattttatctttatttgatatactggagactctcaaatatattctcataatttagaactcactttgggcttcaatattgaacatccaactctcactggcacatctccattaggatgtcccaaggacactttaatctttatttttgacatcttctcatcctgacttcagacttgttactctgtattaccttttttagtcaacagattcttcattcaaacaactgaaacagaatattgttattatctagaagtcctttttgtgttctcttatatcatatctttgtatgtgatttaagcaatcattttattctgctgtatatcatgtaaaattggatctagaatgataaatagtttttatctcaatcaccatgtgccattgatttgtaggggctgccaagagtacaaagttgagaaagatagtgtgatcacctctagagtgagaggaaagacttccacaattgatgatagatgaaatggcaagggtgaagaaaagtgaagcatctagctctgaatgtgttatccatgatcttagattataaagttcacaggttaagtcagtgtgtgtgtgtgtgtgtgtgtgtgtgtgcgcgtgcgcgcgcgcacacatgcacgtgcacaggcacacacttgatttgggatattttagtaaataaacagataagcacaaaaaggatgctttaggcaggaagaacaaagtcagagaggagtcaagtggaacttaggggatactaatagaactccataatttaatttgcatagagggaagtttgtagttgatgagagaaatttagattggactcaaattagttaaagccatttgtgccaagttaaataatctttatctaagataatacagaaggatagtaaaatctcattctttctggcattgtggaactttacaaattccatttaaatttatttttaaacacttcccttacagggtaatctcaaaataaaatgacgcagtttaaaacaataacaattattcaaaaaaatagaaacatgttgtgaaaatacagattatttctctattttaattaagaatggtagtaacagcagtaatatatcttctgcctgcagtgtcacccaccatctgtgtgtttcttgacccctggcaatagtcccaggcatggatagaaatcatccctgcagtgggtgcagccacattaattttcactagggcttcatagtaagtttccatattgcagttcttttagggagagacctctggtcactcgacttcatggcagacagctcagctaattgaagaagtgatagtattctctacaaccatgagtacaattaatgaaagtattctgctattgcctaggcttagattttttttcttcacataatttatcagagaatttgaggtttgcaaatagatttttaagatgtcatttgggactttcactgacctccagaacagggccatttccattcttcttctgagcagcttgcctatttgactttaacaagccaccagaacagctgccctaacacccctgctgttgctatttctgatattactagtctagcaccaaggtttacttattttttctcttttctcatcatcagccagctatgaaaaaagaaccattcttcatgataaaggtcatatttgcatttcaaaattttgagtgactgtactgcctgatattaatatatattataaataatatggactcaaatttccaagtagcagcattgactataaataaatatatctaggtaggaactataggaggctcacctatcaatgattgtttccagttttaaagatatacttttaataaactataatatgatttcctgtaagatacagtttttcatataaaaaccaaagtggcaagtacagttcaagtaattccaaagttcctcttgcatgaatagccttctcacatatgttatcctaacattgatctttcatttaacttcaaagtatgctctatttccctctgtgaaatcggactttgtacttcattggtcattttatccacatatgctttctctttatgtttctttatttggttccaaaaatattggcattgtaataagtagagattttatcaggtatatcataaaaataattatttatccttttcaggaaatcaaaaaagtgaggaaatggctccaaaaacttagtactaatgtttgtgtgtctgtgtttgtgtgtgtgtgtgtctttgggagtgttggcaatggaaagaagttaaactgaaattgcatacactaagttgtaccaatattttgtgaatcaatttagataattctgtgctactaaattgggaacattatttattagaaaaaggacttccctgagaattgaggagttcactgtttggagtgatttgaccaactggttattttatcattctgcagaccttgatttaaaccacattttatgtccttatattccctccttttcatttgttgatattgatcctttgtttcacctttttaacccattccctcaaaatatgaaatgcttctttcttctttccaaggctatatttcccacctgctagtgactggattccctctctcctttgtgaacttgctctatccattgtaatttctctgttttgtatattctacaccttttatagtagctatttgatatcagcctatgttatcaggattctggtggttgcaagtgacaaatcaaatttgtaagtgtggaaatttattggttcacaaatttgaaaagaccaaagcaataattagttttaaacatgactgcatccatgggctcagatgataacatttttttctttcatctcttcactctacttccctctatgtgttgatcaaacttatttccaccaaatatggtctagttatatatgggacctggagtgaccatagatgtcttcagaccttatcctacaagccaggcattgcagaagacaggacttctggttgtccacagtcagttaatggttcttaagttcttgaactactgctgaaatcggtagcaaggaaggagtcattttctaatagaaggatgtttttgctttttcatttgaataagagaagaaatgctgaatagtgaagcaataggtgtcctctaaatatatttgtttcttaacatagaaagtaccttgggtaggatagaaacataaaagaggaagagaatttggagagattaaaaatctgatttgtgacatattgtggggtttctgtatgtctggtgataggtagctgaaaatacagattgcactttaggataatgaaattcactgtcttcaatatattactctctatttaattatatcttttctggaaataatctctctttggtaatctaaaggctgcccacatttcactttgctcttcctacacatgttgctgtgatgaaccttttggaccaaaagtctaatgagtatctttctcctatgtttattaaaaacagcattcttactaaaagtaatgactacttttctttcttcatagtacttgattacattgtctttgacattattcaatgctgtatttccaactccctatcaacagacacacacaaatcacaatatctcacaaatccaatttttaataatcacttccagattcctcctctttctatgtttttatcatattcaacgattttaacaattcttttttaaaacatctagggaagtcagtcaatattggctttcctctttctcatgtgtacattcagcatcccaacaaatcccacctatgttagacttctttagagtctcttctctgctttccaacaacattgcaaacatttcatgacgagatctttcttaaactattccaacagctttttaacagtctgcagtcttcattcttttctattccaggcagcaaggcacaaagctatttgatttatttttctttttttttcaagtagacattttctttttaataaaacagagcgcaaatttaagagtcttgtaatgggattcaacatttttccttcacgcagctcgggtgtgagtacctggctttaaagcaaatccagtatgtgaaaatggggatgtgtacccatcagatctggggcaagagattcacttcacagagtgaatgcttcttttctttaccagaggaattttcatagtattctctggaagggataagctttcctcatacatataaacacttagtaaatttttaatttaagtacactctttagacaagtgctgtataaagagaagactcagatcaggcagatggtgcctattatttttcaagcaattaccttaattcaaatgaaatccaaatgttttgtcaacatctggttggcattcagtgccttgcctagattgttcttttttattttttattttttggtaatagaaaaatttattttttcaaattaacatgttttcttctttgtttattatactttaagttctagggtacatgtgcacaacatgcaggtttgttatatatgtatacatgtgccatgttggtgtactgcacccattaactcgtcatttacattaggtacatctcctaatactatccctcccccttccccctaccccacaacaggctctggtgtgtgatgttccccttcctgtgtccatgtgttctcattgttcaattcccacctatgagtgagaacatgttgtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctgtcattggtggacatttgggttagttccaagtctttgctgttgtgaatagtgccacagtaaacatatatgtgcatgtgtctttatagcagcatgatttataatcctttgggtatatacccagtaatgggatggctgggtcaaatggtatttctagttctaggtccatgaggaatcgccacactgacttccacaatggttgaactagtttacagtcccaccaatagtgtaaaagtgttcctatttctccacatcctctccagcacctgttgtttcctgactttgtaatgatcaccattctaactggtgtgagatggtatctcattgtggttttgatttgcatttctctgatggccggtgatgatgagtaagttttcatgtgtctgttggctgcctaaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttcttccattttgtgggttgcctgttcactctgatggtagtttcttttgctgtgcagaaactctttagattaattagatcccattcatcagttttggcttttgctgccattgcttttggtgttctagacatgaagtccttgcccatgcctatgtcctgaatggtattgcctaggttttcttctagggtttgtatggttttaggtctaaacatttaagtctttaatccatcttgaattaatttttgtataaggtgtaaggaagggatccactttcagcttcctacatatggctagccagtttccccagcaccatttattaaatagggaatcctttcctcatttcttgtttttgtcaggtttgtcaaagagcagatggttgtagatgggtgttattatttttgagggctctgttctgtcccattggtctatatttctgttttggtaccagtatcatgctgttttggttactgtagccttgtagtatagtttgaagtcaggtagtctgatgcctccagctttgcccttttggcttaggattgacttggcaatgagggctcctttttggttccctatgaactttaaagtagtattttccaattctgtgaagacagtcattggtagcttgatggggatggcattgaatctataaattaccttgggcaatatggccattttcatgatattgattcttcctatccatgagcatggactatttttccatttgtttgtgtcctcttttatttcgttgagcaatggtttgtagttcttcttgaagaggtccttcacctccattgtaagttggattcctagatattttagtatgtttgaagaaattgtgaatgggagttcactcatgatttggctctctgtttgtctgttattggtatataagaatgcttgtgaattttgtacattgattttgtatcctgagactttgctgaagttgcttgtcagcttaaggagattttgggctgagacaatggggttttctagatatacaatcatgtcatctgcaaacagggacaatttgacttcctcttttcctaattgaataccctttatttctttctcctgcctgattgtcctggctagaacttccaacactatgttgaacaggtgtggtgagagagagcatccctgtcttgtgccagttttcaaagggaatgcttccagtttttgcttattcagtatgatactggttgtgggtttgtcataaatagctcttattattttgagatacatcccatcagtacctaatttattgagagtttttagcatgaagggctgttgaattttgtcaaaggccttttctgcatctattgagataatcatgtggtttttgtctttggttctgtttatatgctggattacgtttattgatttgcatatgttcaaccagccttgcatcccagggatgaagcccacttgatcatggtggataagctttttgatatgttgctggattcagtttgccagtattttattgaggatttttgcatcgatgttcatcagggatattggtctaaaattcttttttttgttgttgtgtctctgccaggctttggtatgaggatgatgctggcctcataaaatgagttagggaggattccctctgttcctattgattggaatagtttcagaaggaatggtaccagctcctctttgtacctctggtagaattcggctgtgaatccgtctggtcctggactttttttggttgataagctattaattattgcctcaatttcagagcctgttactggtctattcagggattcaacttcttcctggtttagtcttgggaggctgtatgtgtccagaaatttatccatttcttctagattttctagtttatttgcgtagaggtgtttttagtattctctaatggtagtttgtatttctgtgggatcggtggtgatatcccctgtatcatatttgatttatttttctacatgaaaaaatttgtcttttaggaagttaaggattttttaaaaaccttcattgtgtctttttagcttacaacataaggttcaaaattcttagtatgaaatttttaaattattctcattttttctcaatagtcttgcaatttcacattccatatttcaaccacactgagaaatttgccattctcccaacatatcattctccttaatgcttcagtatctgcgctcatattgttctttctactagcagcacccttttttattgaatttgatctcagtcttctaagccataggaccaagaaagcacctagcacatagcaaatggtcaataaatatgtgttgcatgtatgaataaatttgatcatacttaatttatttttgttttacattttctaaattggaatcataatttatgccttgagtacttcacaggcaaattcaagaaggttttgttaaaattgattaattaaaatttatgtcttaattagcctaacgtagtgaacttgttccataaaacacagatagaacaggagccaaaaatactatgggaaaatcattagaaagttgttcttaataaatcaaaacaaaggtaattgaagtgaaatgcagggttctaaacaacagatacattctcaaaatatgactttcagtacatttcacaaaataactaagttttcccgctacccctttatgttcctgtcacttttaaaaatgatcttttgagctttatttgtagcacagcaagtctcagagagttggagaagggaaaaaatgctttaatcttcatctttttccctcttatagatttataggtggaaagttttcttaaaagaaacaatgtatacaccacctaccatcagatcaggaaaacaaaacaagcgtttaattaactgtcttagacagaacattggaaaggccaactccaattctgtctacctattccccagctttgggacaaatgttgcctttatactgccctcttgttttctcacagtgtttgtaatgcacggaaaaaaaaatactattacattgattttcaaatgctatgtagctgcagttttaaaaataaacagttgttttttgtaatcttcaaaaatgctttaactgattaaaagactacttctcacatatagataattataaaaacatgtaatcaatttttataacaaacctaagcactatgtcatcataaaaatgcacaacccttcaaaagtagttttgaggattttttactaaaaccagattctgaaacaaaaaattaacttcaaaagacagactaaagcaatgacctcatgctactcactacaaagaggcaacagtagacaatagggtcatcaaaatgaaaaccatgccaagctaaatgaaaggaagacaataagctttctttctttcaaaaaaatggtttcatcagcatttctaatgacatctcaagggttatagatgaaaggtagaccaaatagctaggtggagttgttggttaaatgttttattttgttacaattaattttcaagttaaaattacttaaagtggtcaagttctaattaaatattaaaattttattcagttatagccaacttataaatatttactgctagaagcttacaaacaacatgctcagtttaatattttccatttgcaaagtatgacacaattgaagaaacaaatgggacccaattcattatttctggagtattattttatatttatgaagcttgttttataactatcaccttgatgtctagcacatattaagagctcaaatacttaatgttttattgatgtgccattgcatggcagatctcctgagtggtagatttaaatttgctcccaaacttcaatttaattctcatttcctaggccatcagcatttccaataaacaaaacaaggctttggcatttctctaaataacgataaaatgagtttacatgtttggaaaagttatttttctgcatcaataatgttacacattaatctcaataagagatttttttctttttctcaagtcagtagccacattctgctttttctgtttcagataacagtctttcaaattcgcgtcttggccacaaagagtagacatactaaaaatccattcttaatgcactcttcccctgtgactgatgactattccacaacctctcatctctaccaaaatcggcagcactatctccctgcttcattcttttttttttctttttattttattttattttctttttctttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgcgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttactccctgcttcattcttaactggtgacatttttcctatttaagtgagaaaatacacataatgatccttagaagacatgttccccaaactcccaacaccatgtaactgacctgcttacttttgtacttatctcttttaactgcagtctaatattatgaaaaagtttgtgtatccatctagagtcttatatcaactcttccacttgcagttcttcccttctcatttacttattcaggtttcccttgtaggacatcactctaccctgactttcctccattgttgctaaccactctttttcagtctcactgtggattccttcacatctcccatcctccaaatattggaagtgttcttgggctcaagccatggtgtcctctcacttctatccttatttatccttagtaatctcttctgttctcagtgagacagagaatagaaaactctcaaatgtgtagctctgaaatgaatttgtctcctgattccagattttatgtaagtcaacagacttgcatctgtatttggacgtctaataggcatctgaaaattatctagaccttactcttgatctttcttctcaaaaacctgtttttcttcaagtctttccattccaaggaagtggaaagttcagccttccagcttctctggccaaaaactccatcttctctttttctttctcattacacatgaaatcaggaaaacatgtttctctactttaaaaatttagcaatttccaatcaccttgttaacacccagaaatactgtaatagctttataaccaatctacctgcttctgcccttgtacatctcacttttaatctattcccaaaagagtagtcaacttattcttatgattgggtcaaaaccctccagctcttttccatatcactcaaagtagaaatcaaaatggataatgatctggtgcttcctgctgctttctttgaatccagtgctggctagacacatcaaccttctagctactctgtcctccaggctcttgcacttgtagttctctttggcttgaacattctggccacagatatctacacagtttattcccctctctatttcagatctctgatccaattccatctttcttaatatagtcttttatacctattaaatttgcaatctctttctttgccatttcacatttctcatttccaaccattttaagtagattttattgtgttatgctagatattttacttatgaactttttattttctccctacaagaaagtgagctataggaggataaagacttttctttatcccacttatgaatatatccccatcgcctagaaatgttacctgcacctactaggcattctaaagtgcaaaacctcttggatttgcaaagacatggaatcaacccaaacgcccatcagtgatagactagataaaaaaatgtggtacataaacaccatggaatactatgcagccataaaaaggaatgagagcgtgttctttgcagggacacgaatggatctggaagccattatccttagcaaactaacacaggaacagaaaaccaaacaccatatattttcatgtataagtgggagatgaaaaatgagaacacatggacacagggagagaaaataacacacactgtggcctgtggcaagggtgtgagggtagggagagcatcaggaaaaataggtaatgcatgctgggcttagtacttaggtgatgggttgataggtgcaacaaaacaccatggcacgtggttacctatggaacaaacctgcacatcctgcacatgtaccctggaacttaaaataaaaattactccatgtgcagttatataggtaaaagaccccttggatatacacacatgtagtatatataagtttagtgttacactggttcagaataaaaagtctcagagactatactttgttttataaggggttcactaaaatataaacaaaaataatttcaaatgtacaatataatatgtgtttatttgggagactacagtggacttctgagataaattatgagataaattgaaaatatattttaaaatgctattttatgcatgtttcaaagggaacatttaactatgtctgtgacaatcaaaataaaatcataaaaaattcagtaaatgtaattgagttttgctttctttgaaagtatatttgttaataatcacaatacctctttaatggatatttgactacattttaaataacattaaaattaatttcctagcattaaaatgtttgtcaactatatcattttaaacttaatcatatatttgtacttagtatgactctagaggtattctgtagtctttttatcactttaatctactaaacaatgtagacagtatactgtatatcaccaagaagtgttcacaagttgttttttccctccttctgaaaaatattatgtctgtgttttagtgtatatgtttgtgtcttttgggctataggtgtacatctggaatttgctagcattagcacacagaaatgtacactcaagtgatttgaagcaactttggtctgttgtcaaatttaatagacattttcagtttattatgtatacaaatatttattatatataaatatatacaaaaatataaaatatataaacacataaatataaaatgttatatatagatacaaaattttacatacacacagaagagaaattcctcaaatgcagagctaatgcaccaataaacaaacatttgtgagtatatttagcttattagtcatatctgatgctaagatctaccatcaaaaacatctaaaggagtttttttcttttttttttcttttttttattattatactttaagttttagggtacatgtgcacaatgtgcaggttagttacatatttatacatgtgacatgctggtgcgctgcacccactaacttgtcatctagcattaggtatatctcccaatgctatccctcccccctcccccctcccccctcccccctacccccaccccacaacagtccccagagtgtgatgttccccttcctgtgtccaggtgttctcattgtttaattcccacctatgagtgagaatatgcggtgtttggttttttgttcttccgatactttactgagaatgatgatttccaatttcatccatgtccctacaaaggacatgaactcatcattttttatggctgcatagtattccatggtgtatatgtgccacattttcttaatcccatctatcatttttggacatttgtgttggttccaagtctttgctactgttaatagtgccgaaataaacatacgtgtgcatgtgtctttatagcagcatgatttataatcctttgggtatatacccagtaatgggatggctgggtcaaatggtatttctagttctaggtccatgaagagtcgccacactgacttccacaatggttgaactagtttacagtcccaccaacagtgtaaaagtgttcttatttctccacatcctctccagcacctgttgtttcctgactttgtaatgattgccattctaactggtgtaagatgatatctcattgtggttttgatttgcatttctctgatggccagtgatggtgagcattttttcatatgtttcttggctgcataaatgtcttcttttcagaagtgtctgttcatatcctttgcccactttttgatggggttgtttgtttttttcttgtaaatttgttggagttcattatagattctggatattaaccctttgtcagatgagtaggttgtgaaaaatttctcccattttgtaggttgcctgttcactctgctggtagtttcttttgctgtgcagaagctctttagtttaattagatcccatttgtcaattttggcttttgttgccattgctttcggtgttttagacatgaagtccttgcccgtgcctatgtcctgaatggtaatgcctaggttttcttctagggtttttatggttttaggtctaacgtttcagtctttaatgcatcttgaattgatttttgtataaggtgtaaggaagggatccagtttcagctttctacatatggctagctagttttcccagcaccatttattaaataaggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcaggctcttttttggttccatatgaactttaaagtagtattttccaattctgtgaagaaagtcattggtagcttgatggggatggcattgaatctgtaaattaccttgggcagtatggccattttcacgatattgattcttcctatccatgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctttctgtttgtctgttattggtgtataagaatgcttgtgatttttgcacattgattttgtatcctgagactttgctgaagttgcttatcagcttaaggagattttgggctgagacagtggggttttctagatatacaatcatgttgtctgcaaacagggacaatttgacttcctcttttcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcttgtggtttttgtcattggttctgtttatatgctggattacgtttattgattttcatatgttgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtgtctctgccaggctttggtatcagggtgatgcgggcctcataggatacccaggaattgaactcagctctgcaccaagcagacctaatagacatctacagaactctccaccccaaatcaacagaatatacatttttttcaacaccacaccacacctattccaaaattgaccacatagttggaagtaaagctgtcctcagcaaatgtaaaagaacagaaattataacaaactatctctcagaccacagtgcaatcaaactagaactcgggattaagaaactcactcaaaaccacttaaccacatggaaactgaacaacctgctcctgaaagactactgggtacataacgaaatgaaggcagaaataaagatgttctttgaaaccaatgagaacaaagacacaacataccagaatctctgggacacattcaaagcagtgtgtagagagaaatttatagcactaaatgtccacaagaggaagcaggaaagatccaaaattgacactctaacatcacaattaaaagaactagaaaagcaagagcaaacacattcaaaagctagcagtaggcaagaaataactaaaatcagagcagaactgaaggaaatagagacacaaaaaacccttcaaaaaattaatgaatccaggagctggttttttgaaaggatcaacaaaattgatagaccgctagcaagactaatgaagaaaaagagaagaatcaaatagacgcaataaaaaatgataaaggggatatcaccaccgatcccacagaaatacaaactaccatcagataattctacaaacacctctatgcaaataaactagaaaatctagaagaaatggataaattcctcgacacatacactctcccaagactaaaccaggaagaagttgaatctctgaatagaccaataacagtagctgaaattgtggcaataatcaatggcttaccaatcaaaaagagtccaggaccagatggattcacagccgaattctaccagaggtataaggaggaactggtaccattccttctgaaactattccaatcaatagaaaaagagggaatcctccctaactcattttataaaggagtttttttcaagatgtttatattttaatgtctgtaacattaagtctaatctttgttctaccatcagtgttttgtagtaaatttcaaaaatatcatgaccatctgcaccattctttcacttcatgattgatgttgaaaatttaacagcataattgtattctgaaaaggtagtcatatcatatatcctgttgttcatggatttatattgtggaatgcattactttaaggtattcttctttaagacctgtatataattatgattgctatagatgataagttggcatggttataaatttattatcaaagttgggtttaaaatattaattaataatcttttattttggctcccaggggagaaaaaaccaatagctctgtattaattattttatgagagagtcttacaaattttgaagaactgcattttcatcagcattttctcaaatgatgtgaaaacatttaaaggttactaactagtgctacattgcagtagaacccataagaaattatatgtctgatattaacatgaatttatttcaaccagaataatttaggatgatttgtaaaaattcataaaattaggagttttttagataatacaattaaaaatgtaaaataataaaaacaactatcgtttctgctctatatgatgtttataagcctagattactacacaactctctgcttgaagcatatggcaaagtcaagtataatatgaatatggataacaacaaaaagtgccatggcaagaatcaaaatgaaataaatatctctgtagactttataaacaaggtctttctgtgttgcccagactgaagtgtagtggttggatcattgtctatagactataaacaggtaagaaacccaaagtaagatatagtattaatgggctctggatctaaaagcaagcaaaagtacttccagaattgtaaagtaaaggataataaatataatccactcagacagagtccaaaagtctcagcttaacatgtggccctggggtaggctttcccacagtagaaagaagagagcctaaaacaatgtaaccttttgggaggccgaggcgggcggatcacgaggtcaggagatcgaaaccatcccggctaaaacggtgaaaccccgtctctactaaaaatacaaaaaattagccgggcgtggtggcgggcgcctgtagtcccagctacttgggaggctgaggcaggagaatggtgtgaacctgggaggcggagcttgcagtgagccgagatcccgccactgcactccagcctgggcgacagagcgagactccgtctaaaaaaaaaaaaaaaaaaaatgtaacttaaacagtggcaaagcacaaatctggttactgcttttaaccagatcccagcctatggaagctaccaaattcatgactatgaaatgacacatgtgcctatggtattgcaaatatcatcaacacagagaggctaattactacctaagacatgatttggatggaggccccaaggacaggtaatttaaaaacttattttaaaaaagttgacaaaaataacaaaacaacaacagcaaaaaaagactttccactcaacgtgaacctcaaaataaaatgccaaaacaagtaagaaatcaaataataaatgtgatgggctgaataataccccctctcctcttaaacaggaggtcctaatctctgcaatctgtatatgctatcttatttggaaaaatggtctttgctgctgtgatcaaaatgtgtgtcttgagggggtacgattaacctggattcaagggggttgtaaataaagtaaaatatgtccttataataagaggcagagggatatttgatgatacacagaagagcctcttttctggtgcgatcatggaggcagacactggagtgatgcagtcacaagccagggaatgccagcagccaccagaacctctaagaggcaagacccagagtttcccctagaccctctgaaggaagcgtggccctgccaatatcttgatttgagcccagtgaaactaattttataatcctggctgccagaactttgaaagaataaatttctgttgttttaagctaccaagtttgtagtgatatgttatatcagccataggaaattaatacaataagagatacagctaagaaaaccaatcagaacatgaaattaaataaaattaattgtctccataatgaattcatactctgaaaagacaaaaatttgaaatatgttcaggatactttaaacattcgataaattaacaacagaaggtcctgaaagtaatcccaatgttgtcataaaaattattttataaaaaaagaaaattaaaatattcaagaagaatctctaaaactgacactactgaaggaaatattaataaattaaaatgtggtattgagaagcattaaaaaaagagatgaaagttttgtaaaaaacagttaagcatcaggtggttccaatgatcacataatacttggtatcacacgtatgcttgcagtaaaaaaactataaatgtgtatgtgtattagagcccattaacactatatcttgctttgtgtttctgatgtatttatagtgtgtggactacaaatgagccactgcactccagcctgggtgacacagcaagaacctgtctatataatctgcagggctatttatttcatttgatccctgctgtgtcactttttgttgttactatttatattcacattgtactcggctttgccatgtgtttaaatcagagtgttgtgtcatgatttcagcttataatatatcatctagaccagaaattataattgtttttattattttatatttttaattttattaactaaaaattccctaatattatgaatttatacaaattatcctatatatacatacatatacagttgaccctaggtagcatagattagcattgcatggggccacttatacatagatttttttcagtaaatttattgaaacatttttggagacttttgatggtttaaaaaacttcaagtctcagacatactatgtaacttagaaatatcaaaaaggttaagaaaaagttagatatgtcataaatgcataaaatacaaggagatacttgtctattttatcatttactgccataaaatatacacaaatctgttataaaatgtaaaaatttatcaaaatgtacacacacagaccatacatagccccattcacagttgaggtaaatgtaaacaaacacaaagatgcattattaaatcataactgaataaaagtgaccgtagtacatactatattgctgtaataattttatagcaacttcctgttgctattgcagtgagcacaaatattgtaagtatccacttaaaaatgccttgtgatgctgatcatcttcatgtgggaagttcatctctccaattgcctattgcagtaaaaaacgatatctctcagttctcacatatttttattgtgttcagtgctgtaccttgagtaaccatgggacccatatgaagtagcactagtgatgccaaaagtgctctgcaaaggaaaaatcatgatattataggaaaaatttgaattgcttgacatgtaccatagattgaggtctgcagcgtggttgcccactatttgatgataaatgaacacagcataaggaccgctgtaaaaaaagaaagaaagaaaaggaaactcacaaagccatcattgcagctacctcatcagctggagaaaccttgcagtttttgtgaactaccatttttatctcctctggaaagtgcaacttttatgtgggggcaggattgctataagaaaggcacatctgtagactctaacaggatttggaaaaaaaataaagttattatatgatgacttcaagcaaaagtaaggtgaaagatctaaagctagctaatttaatgctaacaaaggatggtgtgataattttagaaacatttttgattaaaaaaaaaatcaagatatcaggacaaatggcttctggcaaccaagtggcagcagatgagttctgaggggccattaagaaaataattggaggcagggcatggcagctcatacctgtaatctcagcactttgagaggcggaggcaggaggattacttgagcccaggagagcaaggttagtctgagtaatgtagtgagaccctgtctccactaaataaaaaaatttaaatttaaatttaaaaaaaatagccaggcatggtggtgcactcctatagtcccaactatttggaaggctgaggcaggaggatagcttgagtcctggaggttgaggctgcagtgagctgtgatcatgtgactgtactcaagcttgggcaacagagcaagaccctgtcacaaaaaaataaaagaagaaaataggctgggcacggtggctcacgcctgtaatcccagcactttgggagcccgaggcgggtggatcatgaggtcaggagatcgagaccatcctgactaacacgatgaaaccccgtctctactaaaaatacaaaaaaattagctgggcatggtggcgggtgcctgtagtcctagctacttgggaggctgaggcaggagaatggcatgaacctgggaggcagagcttgcagtgagccgagatcatgccactgcactccagcctgggcgagagagcgagactctgtctcaaaaaaaaaaaaaaaaaaaaaaaaaagaagaagaagaagaagaagaagaagaagaaaataaaatgattattgaagagaagggatatctgcctgaacagatttttaattcagacaaaagtgccctattttagaaaaaaaaagccacaaaggacaattattagtaagaaagagaaatgagtaccagaatttaagataagaaggaataagtttacttttctgtgcaaatgcagttgggtttgtaatcaggacttcccttatccacaatgcttttaaacctcaagtcttgaaagaaaagatagacaccagctgccagtttttgttttacaagaaaacctggacaaagcctccacctcttttgcctctgtcaccctgagacagcaataccaatccctcttcttcttccttctcctcagcctactcaatatgggcacaatgaggatgaagatttttatgatgatccaattccacttaatgaacactttttctggattggttcaatcagtgttttctccctgaagtcaggaaggtgtttccactaagagactacatttctaaagttcttttgatgttgaaaaatgcccctggcttcccagaatcccatgaattcagcaactaaggtgttgaggtggtctgcttgtcctcaaatacagtgtctcttctgtagcctctaaatcgggactttaggactttatcattaggactttaaggctcattacacacaatcctctatggaaaggacaaagtgcaattctgtctcaaaagaaaagaagaagaagaagaaaagaaaaaagctgtcaacagtatgaaagataaacctgaaagtgagaacaacatgaaagtctgaaagaattatatcattgaagatgccatcattgttatagaaaaagctgtgaaagccaccaagcctgaaacaattaattactactggagaaaactgctgaaatattgtgcatgacttcataggatttacaacagagccagtcaagaaatgacaaaatagactgtgaatatggcaaaatacggagtcggtgaggttttcaagatatcgatcctggggaaattcaatagctaacagataccaatgagaggagttaacagaagacaacttgctgaagatgaatgcttccaagctaatgctggacaatgaggaagaagacatagaagaagcagtgccagaaaaagaatgaccttagacaatctgtctgaagggctctgattattcaagaccacttttgtgacatgggcccttctatcatatgagcattgaaactaaagaaaatggcagaaatattgatactaaataaaaatattttttagagcaattgagaaagcaaaatatagacagaaatacaatgtatttccataaatttacactaggtgttccggtctctcctgcctccccttccaccttctccacttcttttgcctctgtcacattgagatagcaatgccgacccctccttttcctccttctcagcctactcaatatggacacaatgaggatgaagatttttatggtgatccacttccacttaatgaatagtaaatatattttatttttcttataattttcttgataacagtttatttttccagctttaagaatataatacatactatatatgacatacaaaatatgtgttaatgaatgtttatattatttgtaaggcttctggtaaagagtaggctattagtagttatgtttttggggaatcagaagttatactcagcatggggttggtacccctaacccctgcatttttccatggccaactatatatatacatatgtatacatacacgtgcacacacacgtatgtatgtattcagacattagagagctcaaggctattgtctttgtgagaaaggaggtaagtgacatgaatctcaaattttctcagattttctccctgaagtcattttctgaaggttgtggtgccaaaaaataaagctaactctagcagcaacaatcttgcagggtgtcagagactaatagtaaatttctggactattaaataaactaatggttaacggataaactatttgttgggggcacctaaagaaaactctagaagactggataggatagatatttccctcaggccttggctaacttttgagttgctcacaaatgtagtgagattccatagtactagataaaacagtcagactaggaggctgagaaatgagtaaaagttacacaatgctgaggagacactaaaatttggatccagccaaagggagaaacctcagtgaacactgggcatttatgtgcaaactcagaaaaaaaatcttgaaataagatcaaatatctagcagtaagaacaatgctaaaataagctttccctaacaaagcctaaaactaagtctcaacagcatcaaagtatttcagataatttaatagattttcaggaaaaaaaaaaccacataccactttctagcaaaagataaatatccagagcctgtacagtatatcattacaatgttcagcataccatcaaaattactagatatgcaaagaatacaaccaaagatgatctagatattacagttaacagataagggcttcaaaataattatgcttaatgagttgaaaaaagaaaaatatgagtaaaatctatgtatgaaagtgtagtaatttacacagcagaaggtaagaatactgtatttaaatagaaaatgtttattgtgacgcataaagagaaaaaaatggaaagaaccgataagaatatgaaaatgtgggtagaacacagtcagaagatctaacagatatataaggagttccagaaagaaagaagagagagaaagggacagaattaatatctgaagaaatagtagctgagaatttttcaaatctgataaaatatattatctcatggattcaagcaactaagcaaaccatcaaaacaataaatacagcaaaaactacaactaagcacaaaagaacacagctgacaagatctacgaaaaagagaagaccttataagacaggttacttttaacgatgcaataatcaacaataaagcttttggcttactttctagcagtaaacataaaataatggaaacacatctttaaaatgttgaaagaacaaataattgtcaaccataatttgacactcagatgaatccttcaaaaatattgtaaaaataattacatttcaagaaaacaaaaaaataagactgaagggattttcggcagcccacatgtgcataaaaatactaaagggaatgattcaggataaaggttaattatggcatgtagatgcatgaacatgtagaaaaaagcgaagaacatcagaaagggtaaatatattggtaaatataaaagatgattgacttttgaagaaggaacaataaaatatatttttgtatctctaaagtatgataataataggtcaatgagaagaaatagagtttcattatggaaaagcaaaatattattaaaagtttcttgcattgtttttagaagtgataaaaatgctaacatatggtagaccataataagttaagagtgcatactttaatctctagtgtgaatactaaaagaataatgaaacaagacacaaattaaaagaaaatagaggaggtaaaatgtaacgataaaatgatttggttaatctattacaatggtaagaaatgaagaatgaagaaacaaaacaggtagaagaaattttaaatattagcaaagtagtagccataaactcaactgcagttgtcgttacgttaaatataatggaggaggagtgcagcaagatggccaaatagaaggctccgttgatcgtctgccccataggaacaccaaattcaacaactgtctacgcaaaaaaaaaccaacaaacaacaacaacaaaaaaccttcttaagaataaaaatcaggtgagcactcacagtatctggttttaaattaatatccctgaaagaggtactgaagaggatagaaaaggtagtcttaaattgctaatgccacccctttcccacccctagcagcagccatgtggtacagagagaatctgtgtacttgagagagggagagtgcagtcattgagagacattgcattaagctcagtgctgccctgtcatagcaaaaagcaaaacccagctgaactcagctggtgcccattcatggagggagcatttagaccagccctacacgaaggggaatcactcatctcagtggtgggaacttgagttgctgcaagccttgtcaccatgggctaaagtactctgtggcactaaataaacttaaaaagtagtctaggccacaaagactccaactcttaggcaaggcctagtgctgagctgagctcagagccagtggacttgggggacatatgacctactaagataccagacaggtggctaagaaagcatttgcaccatccctttcccaatcccaggcagcacagcttgtggatccaagagagatttcttcctttcacttgaggaagggagagagaagagtaaagaggactttgtcttgcatcttggataccaattcagccaaagtaggattggacaccggtcaggattgtgaggccacccttccagtccctaactgggatgatgacatttctagacataccctaggccagaaggaaatctgctgccttgaaagggaggaaccagtttcaggaggatctatcacttcctaactaaagagcacatgggcacggaataacaggcagcaatacccagttagtatcaaaaacctttgatgagactctgagatgtgctggcttcaggtgagacccagcacattccaagatctgatggctacagtgagagagaacttctgcttgagaaaagcagaaggaaaagcaaagggaacactgtcttgcaccttaggcaccatcccagccacaatggagtatagcaaaagtgggctcttggggtccccgatttcaagctttgactctttgatggcattttctgggccttcctggagccagagagcagcccaattcactgaaaggtgggtcccaggcctggcagtattcaccacaagctgactaaagagccctttggtcttaactgaacatcatcagtagcctggcagtactccccgggggtctgtagtggtggtagccattacacctttggtagtagaggctcctttgactgtagaaaggagaggtaaaagggggaaggactgtgtcttgtggtttgagtgccagctcagccacggtacaacagaacactagataattttctaaagtttctgaccagtccctggctcctggatggcatcacttctgagagccttgaatgaatataggtgatagttgggtagtagttacagtgagccttgggtaagacccagtgctgtgctggcttcaagtaagacctagtagagtcccagtggccacaggggtactacagtcactccaacccagctacaagtgactcaccacagagagactctgtttttttggaagaacataatggaagaaatcaagagtctctaactggtaatccagagaatttttctagattttatccaagactactgtggcagtacctctataggtctgcaagaaccacagtgttactgggcttggagtcccacctaatacagatacagcttagatcacaacacccaagtcctgtcaaatacctgaaaaatcttcccaagaagggcaggtatgaagaagtccagactgtgaagaatacaatgagtacccaacccttcaatgcccagacactgacaaatatccacaagcattgacaccatctagaaaatatcacctcaccaaacaaactaaataagacagaaaccaatcatattgaaacagtgatatgtgacttttcagacagagaatttaaaatagttgtttttagtaaactcatagacattcataacacagagaaggaattcagaattctataaggaaaatttaacaaagagattgaaataattataaagaattaagcagaaattctttagttgaaaaatgcaattaatgtactgaagaatggatcagtcttttaatatcagaattgatcaaacagaagaaagaattagtgaacttgaagacaggttatttaaaaatacacagaggacacaaaagaaaaaagaataaaaaaggatgaagcacacttacaaaatctataaaatagcctcagaggggcaagtctaaaagtgattggacttaaagaggaaagagagagagggattagggtagaaagtttattcaaatgggtaataatagagaacttcctaatcctagagaaagatattaatatcgaagtacaagaaagttatacaataccaaacaggttttacccaaagaagactatctcaaggcatttaacaatcaaactcccaaaggtcaaggataaggaaaggatcctaaaagcagcaagagaaaagaaacaagtaacatacaatggagttctaatatgattggcagaagactttttagggaaaccttacatgacgagaaagacaggcataagatatttaaagtgctgaaagaaaaacaaaatactttcatcctaaaagagtaaaaaattcctagtgaaaaaaattcttcaaaaatgaaagagaaataaggactttcccagacaaacaaaagctgagggatattaccaacaccatacctgtctgtcctacaagaaataataaaggaactttttcaaactgaaataaatggatgttaatgagcaataagaaatcatgtgaaggtataaaactcactggtaacagtaagtacacagagaaacacagactattttaacactgcaactgtggtgtataaactactctcatcttaagtagaaagacaaaaagttgaatgaatcaaaaataatagctacaacaacttttcaagacatagtacaataagatataaatagaaacaaaaaagttacaaagcaggagacaaagttaaggtgtagaatttttattagttttctttttgcttgttcatttgtttgtttatgcagtgttacatttttatcagcttaaaataatattttataatacagtatttgcaagcctcatggtaacttcaaatctacaaacatacaacaaatacacaaaaaatagaaagcaagaaattaaatcataccatgagaaaaaatcaccttcactgaaaatagacaaaaaaagaagtaaagaacgaagaccacaaaacaaccagaaaacaaattaaaaaatggcactagtgaatccttacttaccaataacatcgaatgtaaatgttatttacattctacaaattgttaaaattatcttaatgtaatgaaataattggatgaaaggtcaacataataaaaattaattgtatttttatatattagtaataaacaactggacttttttttgtaacatctgaaatagcatcaaaaaacctaaaaactcaggaacaaatttaaccaaaggtatctaggaccccacacttaaaactataaaacagtggtgagaaaaatttagagacttaaataaatggaaggatatttcatagttataattaaaagcatgagtcctgtgattatatacatctgtagttatttctactctattgtttcatgctttacatttgttacatttttctggaggtcattttttatcttctgaacttttgaatgttttaattttttttaatgatttggaagttatatatcattttttctattcattctacagttacccacagtatttagccaacatgtttaattatacacttttcttttagcttttttgaaatgtataatacgttattaataagtatggtcaaatgttctcaccacaaaaaagatgagtatttgaggtgatggatacgttaattagattgatttgataattccaccatatatacatgtatgaaaatatgacatttactccaaaagttatacaattgttatttgtcccaattaaaaataaaataaaagtaaatttttaaataaataaactgttttctttcaatgtctggaattactagatatttatatcctccatcagtaataatgcagaaatgggccaggcgtggtgtctcacacctgtaatcccagcactttgggaggtgtaggcaggcagatcacgaggtcaggagatcgagaccatcctggctaatatggtgaaaccccatctctactaaaaatacaaaaaaattagccaggcctggtggcaggcacctgtagtcccagctacttgggagggaggctgaggcaggagaatggcgtgaacccaggaggcggagcttgcagtgagccgagattgtgccactgcactccagcctgggcgacagagtgagactccgtctcaaaaaaaaagaaaaaaaaaaagaatgcagaaatggaaacatgagaagctcaattgcattttgcaatctccacctcttattttgagatcacatgcaatatttttccatttgttttaatttacacactattagttaattttaattaaaattgttttccggttttgttaaaagtttgtaccaacattcttttagctgaaattgtcctacccatttctatggcaactctgtcatcatttggtagtctgccttaagtgagtcaaggctcacattctttctcttcttggaggttcttctctctccttagattttgggttaattggttttcctgacactgcaactctttgatgcattcaagaaaagtagttacgattcagtagatcttctagccttttcttatggttggtgagcacagtgaccttatcagatttctgcattttaggtaaaaaccataaactctttaaactttaaactttaaactctgtaatgccaaatgtctttgtaaatagttatattttaccctcacatgtaaatgctaatttagccaagtacaaaatttgagattcaaaatgattttccctcagaatgatactgcttcattgtagcccagtaaccagtttcgataatgagaaatataatgacactaattcttgctctataagagatcagttgggtttgtttgttcagtgtttttttcagagagtttagaatttttctcacctatgttctgaaatctcacttgaaatatgtctaattgcttttatctcttgttactttttttttaaaaaaatgcttctctatacctgctgggtctcctcaatgcttcccttctgttctgatcaattttctcctgttaattctttgataattattttcctgtctctgttatttccttttatcactcttaattcactgatattaaaattttagggccttagtttcatgtcttaattctttatactatttttcatatatattaatgtatatgttaattttttaagttctgggagaattcctagttttactctttagctccattcattctgacattcggttctatctacattttttcctttcacacaattttcattacttattttggtttttccaattaatggggattcactttcatatatctaaggacattaattataatatttatgtgtttacttactctgtttcctcatgttctttgtgtgaggactttcatgatactagttttcctcaactgcttgccaattcttggcagtatataatttttgtatttgagaattcctgctgcctattctttgggtggtagttcaatatacctttcctgcctctgcaattatatgagcaccctgaatgtattaatgtattattatctggggattctgatagtttttattttgacagtgagggtttcttgcttcttctgagagtaattatctgggcccatttttatatttctctggtctcagtgcgtgcaccctatatttgttgtaggagaaaatatcactgctgcccactgctcagtacaagatgctatgtagtacagttgctcaaaatgcaattctgcagtgactcacctttcagattgcctcaaagctttcttgttgactcttactttgcatattccctggtaatttttctcaccatgaagaccatcttttcgtgcaaatgctttatactcctattttatgctgaatggtttttctccaaatctctttttgtttccatcagtttctcttattcctgaaatgatcaaaacaatcaatctgctaatggtactcttttgtgtttgtttttcacagttatcaataatttatattttataaattatactttgttctcattttatttgatttggggcatattgaaaaatacagattatgtacacagtctgcaaatttgaatcgatctcaaggtcctaaaaatatatttgacttatttagattaaaataggcccctttaatgtgaagtcaatctaagtacccatcaactaatgggtagataaagaaaatgtggtatatatacactttggaatactgttgagccattaaaaggaacaaaacaatgtattttgcagcaatgtggatggagctggaggacactattctaagtaaagtaacacatgagtggaaaaccacaaactgttctcacttataagtgggagctaagctttgaatacgcaaaggcatacagagtggtataatggactttagagactcggaaggagtagggtggaagagggaacggataaaaaactacacattagatacaatgtgcactacttgggtgataggtacactaaaatgtcagaattcatcactatataattcatccatgtaaccaaaaccacttgtacctaaaagctattgaaacaaaaataaatacatatgtacatacataaatacataaataaaataggctcttctaaaacactaaacttccttgttaaataaatcagttaatattgcaaaattcgattatacaggaaaaaaatctctatctattgatgattcttaatttatctagatttatagatatgtaattttaaaataaaatgtttgacctctttattttcatataatttttggtgttatgaagctttctgcttggctattagttctaaaaactaggatatatgatggatatccttatttaagttatgtcttgttagagagtctttgggaggacagaactccttctacttttgagagccacattttccctggctctaaagaataagatgactgtcgttttctcataaattgtaggtttttctacaaggctcattactgattcctttcagagctcattttcctacaaaatacataggagatctcagcgtcctaaaccagactaaacttttgaattgttgtgtgtagtagaccccaatacttgacaaattatccactccaattaactattaacgtaagttctttaatgtagagtctcagcatgtagcctgctaaatttttaaaaagagccagccacctttcctctccctaaactgtaaaacagagaacttaataggtaattctgtaacactttctgatagctttctccttaatgagctgctggcctgtgtctcagagtccacttccttaaatgagaagagcatggttttcatgtcaactattttaatattgacttcttttatactcattttgttaagaaatcaactgagtcaaatatgactacttatagtttttattgctttgcactaaccaataattatgtgtacaaaattgagcggtcaagaaatataagcttaacatagcccctcagctgtaaatgctttcatgaatactaaatcatataaaactatcttaattagtataggtagatgtgttctgcctgaccaggtcacaatttcaagtagcatgtactaaaactatgttttaattctccttttttagctcctttttaatggcttcctactaagttcaattaattggacacatgctgtcccggagtagcaaacttaaaaatatgtgtgtttttatgttgatgaaatgttttctctttagggtctaaaagttattaccagaggcaactggtcttgctgtctaaatagataagaattgcttactattaactatgctaaataataaccatcattcttaaaagttattctccaaaaatgaagcattcattttagtcatacatcagttctggagacaaacgtactggagacaaatgtacatagtccacagaagcctatgttgctatatctatgataggtaaatcgtaatatattttttgaaagagttgaggcccaaattaaatatgctgcagaactttgacatttctgagcatttatcactttatttgggggtagggtacctttccttttgatgtagtttcagatttacagaaatagtacaaagaactctcatatatccctagattcaccagttatttatattttctctatattctgtattactctctatgaagatatggatgtaatattttttctaaccatttgagaggatattggagacctttaagcctaaatattcatgtgcacttttgaagagtaaggacattattttacataaacacagagcaattccaaagttgggaaatttagatagcactatttttaatccccatattcaaattccataaactgtatcaataatattctttagagatattgtttcctgggtctaggatctaatctaggatcaggcattacatttacttaatttttttttttttttagttcctctaatctagaacactgttaacctatgcccatatgtctgcagtttctttttcttcaggtaaaatttccattcagtgaactacacatatttagagagttgacaaaggcctctatttcatataaatatatatatatatatcatatatatagtatatatatatatttcatatatatatagtgtgtatatatatctatatagtgtgtgtgtgtgtgtatatatatatatatatatatatatatatatatatatatatactttaagttctaggttacatgtgcagaacgtgcaggtttattacataggtatacacgtgccatggtggtttgctgcacccatcaacccatcatctacattaggtatttctcctaatgctctccctcccctagcccccaccccacaacaggccctggtgtgtgatgttccctctatttctataatcagcactactattaatatacaggacatctctgttctcctcaaaagtgggattacgtagtatatgctattttatgtttggcttttttagttcagcataatgactatgtgataatacatctgtgtctttgcatgtatctgttgttcataccttgtattacaaagcaataattaattatctatatatggcaaaaataacttattcctgtgttgacagctgtttagactgttacgaaaaagcttctttgtaactttttgtacaaattttattatatttggtgcatatgtattttcatatatatatttttagtaaatagaaacagaatcactatatcataaggtaaatatatgttcaattttactaaaacctggcaaaacctttttcaaagtggttgatccatattacatccctaccagctatgtgtgaaagttgccagttctaaagaacaggcaaaatggatcgatgtgaaaaaaaaaattagaaaatggattgtctcagggttgcgataatttcagagtgactaataaagtgaattttggacttaacttggagacctttatggcccatttttctcagataccacacctacttcttattaagaattccagtcagacttctcaactttcataatagatattccatccttcttttcacctctttgttttccaaagcttaagaactaccatatatatagattgctagcattttaaactcatgtgcaagattttatgagcaaactgtctgcttttcagtttttaatcacaaacttaactaagagaattgatattcaaggaagatggtctatttgaccaactattcatgtattactctaggaattctatgttatgtcctattatcaggtcacacagcccaaatgtcagttatctgtaacatgttattttgcatataaaaaatctatgttgctagattgcaattcaaaataaaagttcttattttttatttgcttgtttgacagttgaaattctattgatgtttataatgaaaatacttgcttttttctcctctctaggattctgattactatttcagttttattcatatatgccaactaaaggcatttctgaagtgaaatatcacagttttaaaccttcaaatacaagttaaaagaaaaatatccacaacaacaacaacaaaactcagctggcttattcagagtgcttttcagcaatttactcactttgggaatatctagttttctttgtggattaaacacgtctgacgtgactcactgctctaaaattcccagttttgaagtaatattttgttttatttgtcctaagagactgagggttaactgctttctcccatttagctcttaaaatgtatcagtttatttacagtatttaacatacatatattaggaccttcttattctataaaaatagaactacttgtttaattaaaccactaattgccttagccaaaggaaaacatcttactgaaataaatgatttgtcttggtaatagaagtgtcaaaagtgcaaatagatccctaattgctagataatttcccaacaattaattctgctgcttaagtattccccagctagctccatgttgcctctcattttagatcagcacatcaccatctcctgcttgattatttctttgcctccagtcttgcccactttatctacgctactacctttcatctttataaagtacagttacggccatgtcactctgctgtatgagacattccattgtcttccttctcataccactgtatagttcaaaataaagcctaacctctttatgttggcttaaaagcccttcataattcaagttatttctgtctcatctcttaccttcccctattttgcacccctactccatttataaccattttctagccttataaatgtccttctcttccatgtgaatctttgtgtatgccctcttttttttttaacctggaacactctacagcagcttttatacttcatgcacttaatgactactcttcctgtgatgtactactgagtagaggaaaaagttagagctatttttaattagtggtgaaggtaagcctctgacagcatgatattggattctgaagatgagaaaacagccttctaaggagaaatatgagtggtctagaaagggcagaagtcctgaactggggaagattatggcatatttgagtcatagaaaaaagtcagcatagctggagagcattggaatggagagagaggcagagtagagagaatgacagaagatgaaactggagaggtatatactgagtgcctaaatcatgtgtgatatcacagaccattccaaagaccttggattttagtctaagatcatttctaagccactaataagctttaatcaggcaaaaggcttaatctgaaaaaagttttgaagagattgctctgtttgtattgtaaacagtggatagaagtggaggagggtgaaattggcagctgagagatctgctagatctctctagcagtaggtggcatccaggaagaaaataatgatggcttgggtaggtgtaagcattgcacagggataaaagctactaatatataacttaggggatgagctaaacagaacttgctgaggaatagggagttgataaaaatcctcttatatttatgtagagaatttcagagattggaatttttcaagcgtgtttttttttttttttttttttttggtggtggttctctttttttccgcaacagtaacaatgcatcaacaaaaaattctgatagataccttaaacttaccacacacttattttgacagcttttcgtcttattttttagagtttagctgatctccttgataaacaagtttattcatggatggctgaaacatgcttattatttatatcaactaaataaagtggcctgcagtcgttgatcttgacaggacaatgcaatagctttcttgctgatgtgactcattattttctcttccaaactcaccctgtgaaccctatgcaccaccatcacaatttcctcaagaaccatttcaattaattttcttttctgcttaatatagtttttatagcccactatactcaggactaggtttatctttcaggcttcatttctcttttcttttcctcatgaatgcaatgtttcagctaaaaatagctagttagtattccttgaatcctccagaattttatcattattttgtctttactcttgcagtctttcacaggacatattaatatcgtatctctaaaacaaaattctactacccttagagcttggaatgagagtaatgcatagtagttaagaaaattagctttgcagttaaagaatcataggtgagaattctgcctctgtcacttaatagatgcgtgaccccagcaagttcttagcctaaggaccagtttccctttctctgagatggggaagatgagagtatctactttatgatgttgcactaaaaattaaataagatcttacctgcaacacattttataacattgtttgacataaattaagcaccgaacaaatgataggtatcaatatctttattaaggttcactttaaatgctatgactttatatgaaaaacccatggcatcagcttgaactatcaacttgaatgtgatgttatatattcccattgctgttatatatattatgagacatatatacataagcacaaacaatgtcttacatgttcattatcataaccaattgtctacatctgttgcatcattctttccacattctgctgtgcaataagattgtgtgtataccaaatatatgataattttttttgtcccatatccaattcttagataaagatttataccctcctttcacattgcttgtacctgtattagagttaagcctcagctctctgaactctacatgagagttaagcctcagctctctccaaccctgtcacagctatcggggacatggatggacccttggtgttagttgtttcaggtacattcttttcctccattacttagaaatcagagcctgagaatatgtcatcttgggcaatgttaacctagagcttggaatggccatgttcagatctaatgcattataaaatagaggaagttatgctagagagagagagagaaagagacagaagaatgatatagttgatcacagagaaggagagatgggagaccatgcagtcctttattgacagataaaataatttcaattcatagcttccttgttcctggtgtcagtccattttgcaatctagctacacttcctgccaggtcttttggtgaaatagcctatagtcttccatgaaattatcttcagttttagtagattttgttactaacacataaaccatctttgtaagaggccacatgcctatctccattcccttcaagcactgtagctgcatgaatatcttttccatcttcatctaggtcagtgcctaacacagagcagcagtaacaacctgatggcaataaattggttttaccattgctcacagtctagaatttaacacaatactattcaggcacaaaatcaagctgatttaaaagtaaatttaaattaattttctttgaaaacgttggtagtgttttataaaaatccttgagattttctctgagatcctgggctgggaattactatattaaaccaaagtgtagtaagtatcaaaactggctttacatatgagtgtgtctcatacatttggaaaaagccaagatgtttctggattgagatcttcttctagtaaataatagcttctttgaagctgtgttgtattccagacatttcacttattaaccaaggagaaggcagatatttgtatattgctggcatgaagacattctaaatttcacattctaaatctcaaatggatatttcaaagctttcatagttgtattttttgaaacttcaatttatgtagactagaaaatataactattttgaaatataatttaaaattattggtcctgtgaagatggcaatgtcgtgattccaagggagagtaatgatgtgttaaaaggtacacaaaaagttaatcagagaaaatagattgcagaggttaccagctagggctcaggagtcaagcagcttggacctcaaataaattctgtaaaattaattgctacttgtataattctgagcaagttatccaacatctcttagcctcagttttcttatcttaaacatcaggatgtagatgcaaatagtactcacagagtttgggaaaaattaaatcaagctatttaagcaaaagttttggcattatatctgacatgtgaaaatcttacaattcatgtgggctattggtggtatttcattgtagtaatcattatggacagattttcatctgattttacttttttcctggcttcaataagaattagatgaaaaagactataaaactgcatctgtgacaaaaattatatttataaattaattatgcataaacattgaaagggcaaactccaatattttaacagggatctttgttaataaagataagaaacattttcaattatttctgctggtacacatatattttccaaggctctactaaccaagacagacttaatttgccctcagcttaagtgaactttagacaggtttattccggactataggaccttgacttgacctccctttttagagcactttttaatgaaaacttttaattataaattatttatctgcctctttgaaatgtaaacattctataatccacaaatgtctttcccaaagtcctgggagtcatccctttgaaatataatcatggaaggacataggatcattgtctcccagtctctgtgggaccataggaacctaactttaataagcaacaattgacaagcacagatgacctaatctcactgatggacttctcccaaaacatcctccagtatttttccattagttcactcctgcctttaaaaattacctgccttagttcaatggggttgagttcaatttctctcccctatttcaatagtctctctcctttattgtaatagtcttgaatgaagccttccttgcttgtttaacttatctggtgcagttttgtcttttacattacaaggattatatctatggtaaaatagaagtgcagaggatgtgtgggtatgtgtgtgtatgtgtgtgtgtgtatgtgtgtgtctatctgtgtagacataagaaaatttttgttagctaaaaaagctaaagaggaactgaagttcaatgttgttaaagtgtttgtcttcaaacttatctcttaatagattacaatgattgtattttaggagaacctgctaaattcaaacagtcagctatgtcatggcagtatagtgtcagtcccagagacttagcagctaatagatttctttctaaagcacagacctcccatctaagtccaagtccccactggctactgatttatagagtagcatttggcaaaagacggtcttaatcttacctgggtctcattttcctgcttataaaagagaaaaaagaggttctgagaagaagtacaaaattcaaaattgaaaaaagaataaaatattttcacctagaaagattttctctcctttggtatgcaagacggacttgcattagagacagaatagcatggctggttagagccactctctaaagtgggctggctgcctggttatgcctttaagtgtctgtgcctccactgtgtaatgagaatgattctaacagcatttatgtcatagttttcttgtggagattaaagggattaatactaatagagaacttgcacttttaatgtgccttgtacatagtactttgaagtcatcctagctttatatgtttgctcttatatcattattattattaaatattttgatacacgttaaggagaaacagtggccaccagtcaatttgattttgaacatgaaagcagagtctgttatgattttcttttggcaaaattgtaggattttattataaccatgacaagatgagggtcacatgcacttctgagatcaagaaattactacatcatatagtttgaaagaaaaaatgtgttaacaaagtagaaaagaggctggtgtaattttgagtaggtagtgtctctgtcatagtgtccatttccaaggtaattaggtgttcttcctcaacatagtttgttgttgttgttgttgtttgtagcatgtcttttattaaatgactgcattataatttgaataacaaatttcctatagttgaaatattctggatagtttccaattttttatcattataataaatgtgataaacataaatgttatacatccacaagggaaataaaaacatataatgataaaatatcaatcttcagcagattattttgtaaattcttttttttccctatacttctggtattaatttttgaaagaggatattttttgatacacatatttatttgaagatccaatgacatttattcatccatagatttacatctatgtacattgaataaagatgtgtactttttatggtagccatttttattctgatactttgtaaagatactaaaggttagattgctttgtttaggaaaattaaaatgtatggctttctgaaattatcatttttaatagatgtaataattgtcccaattttgaattagtgtagttaatacagtttaggaattttgttttaaaatagactaaacaaaataagggatatataaagagcaccattaagtatcaccaaacagctgacttacccaaacagatttcatctccaagcacaatttgtatccaatcagcaaacaattcagagatcaaagaagatgatttttacctgaattacaaattacagttaattgcataatcatattaacgaaatatcttatcccattatcgttgtgtattcataatagttttctgagatttgaatgtgaaagcaggtcaaatacttcataaggaaggaaacagaaagaggcccatgatattttcacaaagtcaaggattccatgcatgaccgtgcctgtgtctcactctgctcttattaaaactcaacacctgcaatcattatttttgctttgacacataatattgaattttcaattttagttgcttaaaacattgtcatctcaactgatcgtgtcttttattttattttttctagaagtattgaaagctgtgaaattatgtgagtctggccttgagaagtaaaattttgggggccactgatactttagcactgagtttgatgaattctgctctatactcaaatatttccgaaggcaacaaaaacagcaaaagttatgtagttgactttctttgttaacttaagctaattttaggactgggtgtagggaagatacataaaaatgaatgaagaaaatacagtttatagaaatggttataacttgtatatcattccccaaaagaagcaatcacaggcaacttcagtagcggtttagaacacagatttaggaattatacagacattttgcccccaaacttagttccatcactattacaaggaacagccattgttcagatgtgtaatgataggtgagagatgcatttttagatgtggaactgcagaatgaggatgatgatacatatagaaatgtaattgctattgccaaattaccctctaaaaggactgcatgcatctgtttacactcccaagagtaaatgaatgtgcttgtttcttcatacactcaatgatactaggttgtataaaaacattatgacttagtttaatgagagaaaaacatgaagcctctaatgtttccattaaatttctttataagtaacattattttatttttaaaagtcagaataaatctaaggaaactttcttagtgcctctgcatttcaaactaaaagttttacataataaatatttgaagatataaagcacacaatgaaccatgcatagaatattagaaaaagtatagacataatccaaaatgtccttttaaaataatattttaaagtggttaattgcattcatgaaattattaagtcagttaaacactatccaagttttatataaacattctaaatttgcataaatgcacacatgtttatattctccttgaatttcatactttactggaaaatctgagaatggccaatattggaacaatgcagctcttcccacgtatttatgaaatatattgccacttaaattataaatttgattctagtggcaattcattcatttagagtatcttttcaagagattttgcattaactaaaagaaacagtatataaaatcttatttttgagcagtaagagctatatatgtaaagttttattcaaataattttaattttaaaaacaatacatttccagtcacgttatttgcctttacatgaggcactaattattgagaaaataactaatataaacttatagaaacatttgtttttatagttcagaaaatgagaaatttaaaaagaaattccactctgaaaatacaacccagtttatttaggaacacagataactcaagagttgatttaaaggaaaagatgcttgcacagccttgcctaataaccttttttcctcaagtatatactcagctaaaaccttagattcccaggttcttgcaattagtagggaggcatatgacaatagtttcccaaatgtgcttaataaatagagttgtacttttgaaaaacaaacacagaataaaagtatttttaaaagacttctgatcagtttcacttgcaagaaaaaaagtgagtcttctgagtatttttcaaatacaatgctccttactcttggaatatttgaacgctcttgacagaactatattttccttatttgtttgttctgcagtaccttcatgcaaaaataggtaaggcattagaaaagacgatgaatctctcaactgcctcatgctgttttctgtgagcaatactagtgaaatgcatgaaataagagatggttcattattttgagttctgaaaattagttgtgcatttaatagttctgtgagatcctattcagtgagaatattcagggcttgttttgataacaaagtcaaatttgattcagttagactcctgaaggaagttgggaatataaaggctaagtcaacatcctaataggaattcccagttattccctatatgcactggtatttttgcattctagagactcaaatatattactaacagttaaataatactgatatttttctgcaaatataattacctctttcttttaccaccatctgctcttctagttttccattcacatggatatcactcagggaaattctcccataaggtatacaaatgtggaactaaccacctccctcatcctgaactaacaagaacagggtgtttctctacccattgttggcaaacatcttggaaaggctcagatagtaaatattttcagttttgcagctcatacagttcctgtggcaaggattcaactctgccaatacagtctgaaagtagccttatgtaaaaaagtagaagtggctgtttttatatttatttacaaaaggaggctgaaggccagatttggcccatgggtcttagtttgctgactcctacctgtaacacaacatgcctaagaagaaactaatcctaaaacttcttttgagagaattagtaattttatttatttatttaacttttattttagaatcagggggtacatgtgcaggtttgctacataagtatattgcctgatactgaggtttaggtttctaatgatcccatcatccaagtagtgaacatagtacctgataggtagttatttaacccttgcccccttcccttccttccccactttgaaatcccagtgtctattgttcccatctctgtgtccatgtgtacccaatgtttagctcctgcttataagtgaaaacagaacatgtggtatttggctttctgtttctgcgttaattcacttaggatgagggcctccagctgcatccatgttgctgcaaagggcgtgatttcattcatttttatggctgtgtagtgagaattagtaatttttaactaaggatgtagagtaaaatgatctagaaacttatctgtattttatttggcagttcagtgacttaaactatgtggagaggagttttagattttaaagaagcaatatgcagaggccaggcatggtggctcatgcctgtaatcccagcactttgggaagccaaagcaggcagatcacaatgtcaggagttggagactagcctggccaatatggtaaaaccccatctctactaaaaatacaaaaattagtcgggtgtggtggcacacacctgtagtcccagctacttgggaggctgaggcagaagaatcgcttgaaccatgcaggcggaggttacaatgagccgagattgtgccactgcactccagcctgggctacagagtgagaccctgtctcaaaaaaaaaaaaaaaaaaaaaaaaaaaaaaaaaaaaaagaagcagtatgcttggttgaacactaacaactgtaacccttccttctggcatcatttaataattttagtagggcagacaatgctggtcacttaatcaatgtccattccactctctctcctcacggacaaaacacatatttattttgagggatggccatatagctggctaaaaacctggatgtctcacatttcttacttaaatatcaatagcaagtgaagttcttctaacaagtcgtgtgagagtggaagtctactcaggttgacttccaaagctgttgtttttaaggcaaaaaaaaaaaaaaagagtcagcttttgctctgagcccttcttcctgccttcatggaatgcagttctgatgcttgacatttctcaggcatattgtgaccttgaggataaagccacatgtttaagttggaggaaactgaaaactgggagaagactgagctgtggactcccttgaggaggtgtaagtatcatggtgtgattgaatatagattcttggttaggagtaaaagaaaccttatttgattaagccactgaagccaagattctgatatgtatagctcaactcaatactatctttagatttaaaatagtgtctctattttatataagatgaacatgatctaaaattcaattttacaccagagtctaatttcattaatttcatgtttctcttcctgcttctattttaatagttattttttcaaagagagttctatttcagaagatttaggtaggaaattaaggaaattgcaaaaaccctttcactgtgctaaggtgctcttactttgcaggtatgttcaaactaaatacttctgtctgcaatattctcagcagcaggcatcgctgaccctaaactagagtataaaagagtgggaggatgaaacagaaattgaaaaagctcttaaaaatcaataaaatgttaggttgtacaagatattgaaatacaagacattgctcttaagaaaacagctagatagctaggtcagagtgcagtaggtcaagtcctttttatgaactgagcagggaggttgtgaccatgaaggagctgcacagcagggaaagattgctgcagagcaggtaacagcctgccaaataaagacggcttcatgtcaggaaccacacaatcttctgggagagcagaggtttgctaaaggattctcttaagatttttttttttttaatttttggggcctagtgcaaatgcatttctttcccacaagaagcatgactaattctcctgatctttacaaataaataaataaagattcccttaagaccttggtcttgtccacacgtgacttgaagcaatagaggtagaaatgaacctcacacacaaaaaaatccttactgattctcttaactctacattataatgcttggaagtatttctgacagtcagagatttgagaaatttatttgagtactttgttttaaaataacgaatacttttcaaatattaactgtaaggaatttaaaaggtagattatatactagactatagagaatatacgtaacattcaaacactctccacttcgtctcaaagaaatggtgataattttgaaatgctgctgcatgagaaagtgtctgaatttttctgttctggaatctttcctttttttttctcacattgaatttattctccatggtatagactgtgatggaatgccaaattatttcttctgaagccttattagtaaatattagtctaatcaaatatttagtcaagacataatcttccattactgaatttttatttgttcattacagaagtgctggatatttccaaacctgaacacactctctgtagatacttcatgggaattaatattattgcactatcacatgtatgttcttatcatgctatgaacatggcaattaaaagccctgtgactactactactaactcagttggaaaagcaattatccacttactcatcaccaaggcacttcttaggaatgcatttcagaacaataatcaatagagatatttatgttgatatagtattggttatattcatgtctgatataatatgggttacaatgacactacaaagtttaactttggatatgccatgggtagaaattaaataaaccttgtaattaaaaccagataaaagttcatgctttgtaccacagctgacttggatcttggccacaatagctaaaagatgaaaggatctcggtaatgcctcagaggtagtgggaaactagagctacccatttgccatttaagaatttctcagatgatcctgagccttgaaaaggaatggtgtggcttgcctggggcacataccttcaacaccttaccatatgccactccctcagccagggaggtgactctagtccactctgagttataaagaattttttctttcacgcaccacattttcagcttctcctaaaatctagaaatatcctcaaactaacattaaaccaacagcggtgtctgtaggcctggctgtatcgctccagaacattgggctcagccagttaaactctgacaagcaatctttatgtcctgattgtccaagcacaaatggctgaccatcagcaattaaacatagcatccagcaattcacattctagcacatgtcgaacgaatcctccaggaattatcataaccaatttaactcaacacttccaaggaagaggattaagatgtgcacaccagagtaatttcttctcactcattcttttagcttgcttgtggcacaattggtccttagagcaagagtcacatcagagaaagtatgcttggatgcatttattccagcaatgtcaggaaactcatcctggttagtagcccaaactgtagcttctaacatgggagatcttttaaaaatactttagcccatttcactatgtgtttgtattgcaaccagaacacataaaaaataatggcatgcagctgggtgctgtgatgcatgcctgtagtcccagctactaggaaggctgaagaaggaagattgcctgaggccagcctgggtaacatagcaacaccttatcaagaaaagaaaaaaaaaaaaagataatgacatgcaaagaggcagaaaataaagaaagtcccattttaatcatgagaattcatctgggaaatagtagactttttaatagaatttaattattttattttgattgtagtgttattcaaattacaacttatcctgttctagattattgttagtgatctgtaaatgtcttccaaatcatttgataaaaacactttctaacagtgagctactgcttgatttcagaacaggctggacttttgaatccacaaaatgacactgttataaatgtccaggattctgcataaactctgcttatttttccttactcttaggaagattagatagtctgttttcaagtcacagtcctttttctggtctctcatttggtgtggatcaagtcacttaaccttctatgtgtttgtttcttcatctttaaaattaggttaataattttgaccttttgccttggcgttttactctgaactaaagaaaaacattaacacatggaaattatcctgggatctgtagatgaaatgtgcagagatggaaggagttattctatttaaaagaaaaaattagacatacttcagtgaattcacttcacatgtgtgttctgcttcagtgaagttgaaagaaagtggttactggaatagacagatgtttacatgcatgtttggactggtaagcaatgatattgaaaatattactattcctaacacatagagacttactggcctgatcaatttgattcttcacttatttattcacagctgaattctgcttgcagtacacatgcaaagcattcttgctggcaggtaggggaataaagattttttagtttgtgtttttaaaatgaactcaagaagaaaattaaattccagatacttcataaatatatttttacaaatatgtttctataaattttagtttacctcttgctgagagaaaatcaaatgcattgtgaaaagtggagaggatatgtgaagaccaccttccctttcttttccttgacctctgcaactgtcctttattgcattgtttttgatctgggtagaggttatggaaggtaactactctccagaactatgaagcctatctgctttgtcgtttctctttaagtccctttaaaaaaatctaaagacatgaattagatgcttggacatgtcttttactttacatacctctatttccctatttccctctaggaaatataagaaatccagtttttcccccttctgtgattaatataaattttgtgtagtattaatacccaacagcacaattcaaaaaaaatttatcaaagaaaaccctgataacaaatcacattttaattcaaattttataattttactctaaagtgacatgaaatcttggatttatggaaattatagatgtttggattaaacacataaattatttaagacaagaaagaccatttcttacataaaattgaccatagacaactgacaaccttaaattcttaggctcaaatctaaagtgtggcaaggtagaagtatgcccaacatacttcctttttttcgacttctcctttgcaaaaaaactacacctaccagtcatactgtccagatgaaagccactcagtctgctttcaataagaacatgaattaaatactctcaatggaatcccactgctggttgagtcaagcattctttgcacatcctgcttcacaaagttccacaaaatctgaccattccttatattttaacatgattataattcatacatactgagcatttgctacatatcaggtgctatgcaaacgatttacttttccaaacttaaataataatcccaagaattccacaaggtagacactgatagtttgctaagttacaaatgtgtaactaaatctagagaaaactgagtaactttgcaagaggctcaaggttagtaagtgacagaaacaaaatataaactcggatctgcctgatttgggatggttttcttaatacttacactgtcttgtctcctgtccaaataactctggaaattgttttattctccctgttgttagttgctactctctgtcttcctcacttccacttccagaaaacttcaagctcttaactgctctaacctgttcaccaagttcctactggtgaacaggtgtgtattagtccatcttgcattgctataaagaaatacctgaggctggataatttataaagaaaagaggtttaattggcttacagttctgcagactgcacaggaagtatgatgctggcatctgcttggcttctggggcagcctcaggaaacttacaatcattgtggaagacgaatggggagcaggcatgtcacatggtgagagcgagagcaaggcggggcggaggtgctacacacttttatacaatcatgtctcatgagaactcactcactatgatgaggacagcaccaagttgatggttctaagccattcatgaggaactgcccccatgatgcagtcacttcacacgaggccgcagctccaccactggggattataattcaacataagatttgggttgacatagatccaaaccatatcaaggtaagcaagtgattattgttctagtagtttttgaaaaagtttataaatgattatctataaattatacctctgcatttgattacagatgctaagtagtttaggaatctgaagttagtaagcttttctttttaaaatattgatacatccaagaagagaagataataattaaatatagcattgttttagttttgtgcttattatatattgttgatttttatattatatacattgattttattgattttagcagaaaatttagctctgatggagttttgtcatcttgatggtgaaaacagtctcatcatccttttaaatgagtcactgctaaaaaagtatctgaatagacacatggctctaaatacacacacacacaaacacacacacacacacaagctgatcatgtcaagttatttaaagtcagaagacttaccaattgatcctgcgctggcagaattttatcagtttggggaactaactggggcctgatcatcactggtaaaaatatgtgctatataatgataatttctttgtcttgtgaaaacactaaaattcctaggagaactggctaactcatatttattgtctgcattgtaggaattatgtagaaccagaaaataagaaatacctctgtacaattgtgtgtgtgtgtctgtgtatgcatgtgggtatcaccaaaaaatattaaaatattttccaaacaaaactaagcatgtgacttaatattaattctgttggtcttcatgcccattaagatgttcttaatcagtggatctctgtgttacaaaggtggttctggataggggttagcaagattaatatgttgaagggaaatataaaaatgaagctgtgttcttcctaacattatgaggaagcatacttgaaccctaataaaattctaaaagaattttcctcttttcagtttccctaaatgtactgctatctctgaccctcatcatcctggcatttaagtcacaatgctgacaaaatctaatcaggaaatggcaacctataaattttgtggaccaatgtaaaagggctccctttatcataatatgataatatcataatatcaaatatacccggggtccccaacccttgggccacaggcaagtacacacttttttggggagattgcaaaaataaagggaaaagccacaaacgcagaaaaaggaagggaaattaagatatgtaagctgagtcttccacttaggttatggaaaatcacaacaaaagatcacctctcatcacagcaagaacatgctagatgttctacaaaacctaaattttgtaaagaccatcagaaagctgaggttgtaatgtaaactaatgaaatgaaaggctaatgatggactagttgagaagaaatccttccacaggcaagtctgcactcatccacacaacccactcttttatgtggtctttacttaaaagagagctcatgaagattctgagcagcacggaggcatgaaaaagaccctttgtactgcaaacaggagaagtctgcctaagtttgagtgtgaaacaggaaaaacaaggaaaaccctcccacattctggattctgcatgagtttaaaggcaaagatcttttgtcacttaaagaggggccagcaaacactccctttactttcagcctagcagcaagtacagagaaatgttatctacaatggagggaggtcaggactattgagaaagcccaaccccagggcataggtatacagagactaagactaaggctgaaacaagagagccaaaagaagtcttcttatgatttagattctgcctgagagtgaggtaggaggtcattagccacagtgggagggacaagaattctatttgtattccagaacttgtacagagaagaagacaaaggttttctcctgcctatactcttgattataggttgaaccatgaggcagaagtcatctgttactaagtgaaggggtggaaaacatgcacatggtgtaaagtctgcaatgactaggaagaagtgtatgcttctgggaaaagagcagaaaaattgagagtgatttcctctggggtgtaggtgcagggtgagcctgcacccaatatgactaaatgcgaagcaaagaactggactaagtgagggctactgccaatgagcagttaactagagcttttctatgagagagaatatcaagtaaggaggaatattctaagacaaagcacctggctaagaagctggaaaagacagatggagtgataaagaaacggatgcattttgcaaagagcagctggctagagtagaggaaaggaactcagagttctgcaaggtcaccactcaacataattagaaagctgctgaagaggtggcaggaaagttcaagtgcataagtctcatccagtctttactgatccatatgccacaattctccagtattatcaccagaacaacccaaaactctcagctgctctgctctggccaaccagtatagacagagcatgcttgtgaagggaagataaaatgaacttttagagcatgcaaaatttcttcaacattaattcaagggatgcaacatattttttttcctagtaagaaaataacctatttgaagagaagagcatcaaaaagtattatgtagcagattcaacagaattatattacatcttaatcagcaacagtttaaaaagccaaggcctagatcagggatcagtcatcaaagaacactcttcaatattaataaacctcatttatggtgattaaaagagaaggacagctctctccacatttttgtatttttaacttaacttctactgattataaattatttctcttgtaattcagctccatcattcggtgaacctacattctagcaaatttggagtttgggtggcaggggctaataggaatggaaagaggaggaggcaaacaatcttggggcaacagtgctatgtggaattgtctagactgtggcatgttgattttctctcttttgcttttttcctttgattacttaagagctatctcattttaacttctaatagtgatcatgcaaacaaaaagacaaaaaggagaaaagatgtacctttttactggaatagtatttatgattaaaagtcaaacaaggcatttttgtcaatataaaggcaattttagccaggcacaatggcttacacctataatcccagcactttgagaggtcaaggtgggcagatcacctgaggtcaggagtttgagaccagactggccaacatggcgaaaccctgtgtctactgaaaatacaaaaattaaccgcgtgtggtggcgagcacctgtaatcccagctacctgggagactgaggcaggagaattgcttgaactcggaggcagaggttgcagtgacctgagatggtgccactgcattccagcctgggtgacagagcaagactccattgctgagaccagctcattcggagagactctaacccagcggcgctagaggaattaaagacacacgcacagaaatatagaggtgtgaagtgggaaatcaggggtctcacagccttcagagctgacagccccgaacagagatttacccacatatttattaacagcaaaccagtcattagcattgtttctatagatattaaattaactataagtattccttaagggaaacgaagggatgggccgacttaattgaagcaggaacacgcccttaagacacagatcgctcatgctaattgtctgtggcttaagaatgcctttaagtggttttccgccctgggcaggccaggtgttccttgccctcgttcctgtaaacccacaaccttccagcttgggcattagggccattatggacaggctatagtgctgcagagattttatttatggccagtcttggggccagtttatggccagatttgggggggcttgctcccaacactccatctcaaaaataaataattaattaattaattttaaaaaattaagggaattttggcttacacaacttctcctttaccataaatactgttatattcacgccattcactatcaataataaatgttttgtgatgaatattggcattgtaaaaccaaaaactcaaaaaccctcatccaaaaactttatgggcaactgaaaacccctcccatacatggaactgcacagagtaccaagaggcagctgtctgccgctggtagacaagagcactgagaaagatatagctctactcctgtgtccaagtcacaggtgcacagagcctgtttacgcgtgaaaacatacacattgaaacaaaacttcacacaaacacatactctaggacttttagcaagtactacacagtagcaatgtacttctgagatagaagaatactgatagaaagtacttctgtgatgcacgcacacagggccagctgaagtattagtgtagagaactaatgataaggtagtgtctatatgcaaatcaggtacttgaaggctgtggacactgatcttaaataaagcaacaaagaccaaatgcagctcaactagagattgagttagcccaacactcgtacttgagggctcacagaaaaagaagcatgtctgtttctgggtataaatattatatgcattaatctgtactgttcatctacaaacaatgttcagtatttaatttaaaaattatttggcacatataagtcaagaacatattgctcatcatcaagaggtataatagtcaatacaactagattcagaaatggggtggggggctaggggagggatagcattaggggaaatacctaatgtaggtgatgggttgatgggtgcagcaaaccaccatggcatgtgtatatctatgtaacaaaactacacattctgcacatgtaccccagaacttaaaatataaataaatgaataaataaaaacaaatagcctacatgttagaattatcagaaactttaacaaataataatatattaaaggatttagtggaaaaagtaatgatatacaacaaaaatgaaaaatttttaaagtactataaaaaagaataaataaaaatgctagaaactaaaaacatggtatcaaagataaagaatttttctgatagtcttatctgctgactagatataggagaggaaataatcaatgaacttgaatccatgcttataacctaactaaataaaaacacacacaaaaaaacagtgccaaataactgtaatggagcacttgtgatatttagcacagtataaaatcatttagcatatacactattggagtgcaagaaggataagagagcatgaggtagaaaaaaatggaaaagatactatttgaggatttaccaaaattaataaaagatacaaaactacagattccagaagctcagagtatccctaaaaggacagatataatgaaaaacatgccaaggtacaccatagtcaaacttataaaaaataaagagaaaatctttaatccaaccaaggggataaaaaagaaactttacatacaagaaagcaataataagaagatagcagacattttagaaaaagcatgcaactaaatgatgtttttaaagtgcttcaattaaaaaagaaactagaaatacatatccaaaaaatatgtttcctaaaaagtaggtaagatgaagaactcatacaaaaatgtataaataaaacaagacagagtaaatatgttaggaaatacaaaagttcctttaaaagtattcttaacatatgatttttgaatgcatcaagtaaaataataagaaatagtttaccatgtatactgaaatgaagtatatgacaccaaaacatgacatattgaagagtattagttgaaaatatacattaatattattttaaatggatcatattatagaattttaacataaactgtaataaatttatgatgcggccaggcacgttggctcacgcctgtaatcccagcactttgggaggctgaggcgggcggatcacgaggtcaggagatcgagactgtcctggctaacaagatgaaaccccgtctctactaaaaatacaaaaattagccaggcgtggtggcaggtgcctgtagtcccagctactcaggaggctgagacaggagaatggcatgaacccgagaggtggagctttcagtgagctgagattgcaccactgtactccagcttgggcaacagagcgagaccccatctcaaaaaataataataataataattttatgttacatattttaatgtctagtgcaactatgaaagtgacataggtagacgtaactaaataatcaatagaaaagataaaacagaattctacaaatgttagatctactaaaaagcatatagaaaaaagagaaaagagagaaaagagcagattcaccaagtatacagatggtattttaagtatacagatggtatacagaaatacaaacattgaaataattacattaaaggtaaataaatacctaaattaaaaggaaaaaaatcctgaatgaataaaaacacaagatccaaataaatggcttttaaaataaatacattttaaagacacaatctgttttaaattaaatgaataaaaaatgatataccataccaacactaagtaatagaaaagagatatgacagtactaatatcagacaaagtagacttcaaaggaaagagtattttgagatgaaaagtgggatatttcatagttataaaaagttaactaaataacaagatatagcaattctaaattcctgaatatgtatgcatctgatgcgaaagttctcaaaaacacgtagtaaagattgatggaaacaaagggaactatggaccaatcacaaaatgtaagtgcagaattttatatcttttcactagtaattgataaaacaagtaggcacaaatttccgtaaggtaatacatgatttaagcaaaactgttaaccgcttgacataatgatatttatagaacttgaaatacagcaaacagaataaatattttctgctttcaagtgcacatggtatatttgccaagatagaccataggctgagtcagtataaacgtttctacaactatcttaaaaacatttatgaaactgtccaagacctgacatcatgcagaatatgttctctgaccaaaattgtattaaaatagaaattagtaacaataagatatccagaaaatgtgtgaatatttagatgttattgaaagcatactactaaataatatctggttcctttaaaatattaataaaattaataatcactagaaagactggtgaataatatagaatacacagattgccaatatcaggtttaaatgaggtaacattgcattagatgcttcaaatatcaaaagaataaaaagaaaatttttggaacaatgttttgacaattaaaaagctaatttaaataaaatgtgaaacaatcttgaaagaaacacattaccaaaactcactcagaaaagaataaaaaatctattttgtcttatatatcttgcataaactgaattcatgatttaacaagttccgacaacaaccagaaaaaatactccaggaaaacatggcttcagtggtgactctagtattttaggaatatgtaatattaattgtatgcacagtcttttagaaaatagaggataaaacattctctaactcattttatgaggccattattaccatggtatttgttatagaccataagtttatgttccctcaaaccccaatataatagtattatgaagtaagtagactctttgggaggtgattggacatgagggcgtagccttcgtgagtgggattagtgcccttacaaataagacaagagagcttgcctcttctctctggcctaggccatgtgaggatataacaaaaagatgtccatctgcaaaccaggaagaatttcataactagacactggatctgtctgcaggcaacttgatcttgaacttcccagctttcagaactgttagaaataaatgtttgttagctaagccacccagtctgtggtattctattatagcaaactgaattgactaaaaccacactagaatgacacaagaactttgaaagataatacagaccaatatcacacatgaacatagatgcaaagttcataatgaatgttagcaaatcaaattcatcaatatttcaaaatgttaatataaaaaccaagcaatatttatcctatgaatgtgaagtttaacacaataaaatgcatagaagttattcactacataaagggaaattaataatgtgatccttttaatagatgcaaaaatgtatttaataatataacacacttgtatcataattatgttgcttagttttctttactatatggccatctacctttatcattaaaggataagaatgcaaggtattgttctaatcttacctatgttacctctttgtttattacctagactgtaaggtaataaagcagattcactctttaccacccgctttgcacaataccctatttgttttcccattattgtgtgtaaatgtgtaaagtagcatttttttctgaaatatgtatgccatgtgctgtctgttctcaataagagctgattcattacacaccctcaaagaacattttccttccaaatggattatgttctctttaaatggaggaaggttactgacaatcattgtatgtgccatggctgaagtaaatgagttcttgtcagaacaaggggagaaaaatagaaatttgggctaagccaaaacatgaggctggcaaaatttggcctctggattcttagaagtcctccccatctgtccagtgattgatagtcctcttttcatcatacaaagacacttttggaagggtcttttataagagatacaatcactttggtgtaacgttttccgtaagtattggatttgcaattagtattttgttgatgtttaatagcaagacgttgaaatattctataataattgtccattttttcctccatgcagtgggtatccattttcactttgtgtattttaatgctccatcatcattatgaagaaacctttcttattcctggtaaaatatctttgctctgagatctaatctgtcttacagtgatatggcccccctagctttcttttgacaagtgttgacataatatgtgttcttacattcttttcttttgactcattttgtcctcatttttaaaaaagcttgtttgtgtagtcaacagagttgacctcacgcttttatccaaatgaatactctctgtcttttaattttggtgtttagaccatttacatttaatatattattattatgtttaaattttatttattatcttgttatttattttataattgtccagtctaccttaccttcttacttttttttttttttttttgcattttcttgcactgagtacatttaatgattttcttttatctcctttgttgtcctcctggctaaaacactttatcattttaatggctgctgtagagttcatagtatatttttctttaacttacagaccagtttcaactgctattacatcctgataatatttgattggatacaaaatattaatttttctcatttctgttggctatttttttttgtattgcaatacatatcccagtgtttggtactatgattcagctagttatgtggagtcagttttatacttttatttcctgcttttatgatttttttaaagcaactccaaagtagtgctgaatctatgactaattatcctctactgatgcatgacttttctgaattatctattcaatatcctgtcatttttttccagttttgttagtgaaaacagccactattcctggctttatatgaatgctagacactgtttttcttaaactgtttcagatgatttttttttcctaaactggaacagtttcctcacagagatgcattgttcagtacactgaaaacttgcagcagatctctgggtttttttttctctacttaaacttgagcactcagcactgactaaaccaaatttgtggctagatgtctttaaacaaaatctcttcttccagttttctgtgttccttaaaaacattttaactttgcaaacttcctaaacacaattaatcttttaactattcctgtatatttccaaagcacattgtgtacacccttattaagaaactcaacactatcttacagaagtgtaagcacttgtctgtcttccttgaagggaaaaaaaaattgatttgttgatttgtacatttttacacttcatagtaagaataataaggattaacatagtagcaattaacaatatttgttgttagataaacaatacagaattctcaatcatttctgtaactcaaaaataaaagtatagtcctggaatctagaaggctaataaaagaaacagaggtaccccaaattttcaaacaggattccaaaaatgagtcaagtgtcaattgttgtgagtaaatgaatcaatttccttctctttattatacaagttttgtgtgctggtaatacctaatattaaataagtataatatggggtatttatattcagtactaacagagtattaaaaaaaccctctcctttttttccaaaatagcaattttctctctctgacacagttgtactatagtttatgtttgttcttaaatcatttaggacaatttccaaaaggtctttgcttgtaagacaaggcttcactctaagaaataggctttcaagtacatagggtccgaggaagtgagtagcagggtacgtagcaataaggattttataagcctttcttcctgtcttctgaccaaggctatccacgctttaatgctcagatcatctgttgtttataatttccagagaactattgatcttttttttctgataacatatagagcataattatatttcttgaaattttctatttttagaaggatttgaattatttgtcaaaaattgaattcaggttgagtccactgttctccctgtagctgtttctaattccgtgaggttcttgttctttgtgctgagaatattctctctttgaaagaccgatctgccttcttcttcaaatccttagcttagatgtagttatctcaccactgtctaccatgagcatgtttcatttaaagaatgaagctaatgaaaggttttggcccttgctctgcaagtgagtaacagtcggctccagtattattacgtcacatgataactatgtagttttctccatacctgggaaacatctcttatacttgatatgggaagtgaaaataatttcaacagatacagattttagactgtttaaaatcactttgtatgagttaagaggataatctttaaatacacttccaattcaggattaagccccaaacttcaagaggttcatttgattttggctgtttctcagttcattcaatatcattagctgtgcttagtggcagattcttaagaagaggtcttacttgcatgtaagtcaattgttttagagaaaatattaattaaaataagtggtgagtgaatttaaatcaagcagggccatgcctctattctgagtttaaatccctgactcatttttttctgtcttcctggatacaatatagaaatatgtatttgataaatatctccatccagaaaaatgaattcaaaatcacatttagagctttgaaccaaatctttcacagtaacagatgctctttcctgaaacaagcttattccacccagtgtatttaatagcatcacttttacaagtgaggggcaggtgggtggaagaacatgcatctcataacctgcctcccttcatactcattcatatattgcatgtttttcccatttgtgtttttataagcacacagattattatacttgcatagccagggtgataccagcgaggcctggggcccagctttgcagtgactgtgacaagcttggaaaaataacctggttgacaacacatttatctgctaaatgtgtcttggagcagagaatagcaacaatggagaagatacttttactctttctgcccagaaagtcacctctgcacttaggataaagaataataaggagccttgtggatggaaaagaatatattatttatttatagtacctttttggtttttcttctttttcaagagactgaaagaattaaagcaacgggaatttgctcgaaatgtagcttctaagtcatggaaagatgagaaaaaacaagaaaaagcacttaaacgacttcatcagctggctgagttaaggcagcaatctgaatggtaagaattaaaggtgtctgggatgcttcaaaactctcgtcaacctatggggaaattttaaaggcaaatctactgtaacaatgtaaacaaataataactaactaatagatatgtctgaagggcaaatatagttaaacatacataaattaataacttttggcctttgatatttttctttcctaatattgttaatttaatgtactctataatgaaatgatcccagaatgattcaaatacattagcatttattctatccagttgactaaatggattaatatcacttcttaatatattttttaaattttgtaataataattttaaaaaccataattaacaatatatcttagggggtggggaataagtcttctgaacatttccgtgtacacacctgtgtctagtacaaataacacgatcattgtctggctgacaaacaagatgtaattaatgcagttaaatttaccacacagtgccatttaaattgataattataatataacaagttttatactaatacattcttgtagctgaaaaatagcagttttaccaaagcttggaaccactggatgtttcaaagttgttacctggaatgcaattaaatttgtggattgtgatttgtgttcatatgaatcataatgtaaaacactaatgtagctaattaatgtgtttgacagcaacctagtgaattgtgaaacttatgcctctgtgccagaatttaaacacctattgcttaaatggaaagtaatatataataaacaggagtgagtggctcaattagttaccacaaaatattagacttaaaaggtaattttaaggaaacatttatttttgtaggaccaattatgagtaaaaatgcaattaatattcagcttgcatgtatttatttataacttttagaataatctaattaatttatgaaaatacataaaagataatcatattaacaagaaatgagaaatttcatatgaagacaaaataaaggtacaacatgtagccagaagtaaggttaatacaaaaatgcatgctctggggtcttatacaactctagaagcaacgcatacatttggtactgagctttctacagccaacacaatgagggacttacaatatgttgtgcaaacatactgttaatgagaactcagtccttgccaaaatagggcttagaaggaaaagttctattgttgttagggtagcatgcaggaaaaaatctagggaaagtgttaattcctgtgattaataaggagatgcagtaagtcagatcataacaaatggtacaagttctaacatagatatacgtctttagacaggtcccttaagggcacaacagtaaatctaaatagtcttaacaaatataattttggttgtttgttattatgaaagttgtcacacttctacatttctgcttacccattctatattttcctctggagtaaataacaaagaatcagaggtgccttgctgatggcagtggtcatggtgatggtgatgatgataatgatgctgatgatgataatgatgctgatgatgataatgatggtgatgatgatggtttatttagaagttccaagtttgctagagctacccattaagtttctttcaaataaaaaggtccactctattaagtttcagctgtccctctggaagccttattcactaaacaaacacaaacctaaccactccttttggtgatttgataaaataggcaaactctctaggtcacaatgtgcccgtattgttatggaaaagacaagtgttcagctttctagatatagagcctgaaactaggaaaataatttttttttatcgtctactgcccatcacctgcctcttagccaattgctctctctgcttaaacagactcatggttgaaggaaagtcacttaacagaattattaaatactttattttagtaggtgaattgacaagtgaaagttaaaaataaaataaaaagaaaaaatcactggcattacccttctcctggacaatcttttctttgtcctttttcctcataatgagggcttctgaataggatgatccaggtaacacaattcttctgtgaccctttgggagaagagaggtgaatttactggtagtgcataaaatgatggcaaaaaaatggtaacagatcttataaagggtcatcaaatttgaccgtctcttaactagttccagccaacctgtttcctcagcaatagcagttattatatggggctgagggtttagtccctctctgtatgtgaacttcttatgtatgtaagttttagtacatcttaatatggaaatttttccaaaatttaaaaattttagggccactgattctgagactatgaattttttaagtggtgtcatttcttaatgttccacgttatctagctcttatatgaagtttttcatataagagctggaaaatggaacacgaaagaatgacaccattttaaaaaatcatgttgttttgatatgtttttctttctgtttggtaaggatgctttttgaacaggagagaatcaaaatgtgcatttgttaagctgcagagtattagaatttttggagaacaatttgaatggaaaatccatcaataagaattaaaaaccaaactctacagacactttattaaccattattttaatataagtaagaatatattttcaaaactaaagaaagttccaaagaagtgagggaaatattaaatgtggagaaaactataaaaattgaagtttcattgagaatgcaactgtggtttcaaggggcgggctggtgggagaaatgtgaaggtattgttcaaagtttataaactttccgatgtaagatgaataagttttgaggatctaatgtagagcatgattatcttagctaataataccgtattgtttacttgaaatttgccaagagagtgaatctagtgcccttatctcacacaaaatggtaactacgtgtatgatagatgcacaaattaatttgtttgcatacatcaaatgatcacattgtataccttgaatatatacaatttttttccagttatatctcaataaacctagaaaaagttaaagctttaataatgttataatacccaaacttgtattaaaatagtagaatttaaaaccccacaaagataaaaacaggattttccaaaataataagaataactttgatttaagaaaaagcaaattaaaatttataaagcaacaagataaaaagtttaaagaataaaagtaagaagtgtcaaagattaacaataaggacaaaatgttaaaacttgtgaaaaatctgtaattataaatgcagtttaaattggaaaatgagaactagaattaaggacaagaagctagagaacattgtattagaaaaacaataagagcaaagaaattttaaaatatttaaaagaatgtaaaaagaagaagcttgcatattagagagctacatggtaaaataaaacagcagtacagaaaagaacatttagattaacataaagcaagaaaatgaataaaacagtgtcaggataatcagcaaaattattattaagaaaagtatatatataatatatttaacatgatataataaatactaaaataactgcataataatggaattgggaaaggaagaacaatagtatccatacactagacttgtggaataatttcaactgtgtttcatacaggtgataatgtcagatcgattgaagcttctggagaagattaacttaatccagaagtatagttcctacttaatccaaattgtggctacaaatatggaaaataatctctttggtaccaaggcaaagttgaatgctgcagctgtttctggatcacttccttctatctgcaggctggaggcactttcaaaggccaataatgttgtaataaagtctctacgctccttatttacttttatgcttgaaagaaacattcagtaactcatatactatcttagaatgctcctcactattcattttattaaatatgcctaatgaacatcaaaaatttactcaataaaaggagattaatgtgatgaataagaactttccgttatgaaagagttactgtaaggaagataatacagcttttaaaaacgtctaaatttagttttttacaagatttaaaggaactctgtaattctaaaattacagccattcatgaagaggagacgttctaaaatcattaaaagctaaatggtggctaaaattagtgtttgcaagttaaaatccatatggtcataatttgtaaacagattgaatattgtaaaaaaaactgagtcagtaaaatagaaataaaatcaaagaaattctccctgaactatagaaaaagactgaagacagaataaagtactgagataaatatcaatacctaaaggatatattcaggagagccaatgattttaaaacataaattccaaaggaagcaataatcagataaatcaagggaaaaaaatgtatctgaactgaagaaagttaaattgaaagtgcccaagaacaaaaattcacccaaattaatcaaccttaactatgttctattaaaatgttatacatacatatatgtatatattaatatacatgtatatatactctttatgtaacaaatctaatgaattatatatatttatatttttacactttataagaagggaaaagcatacaagcacacaagcagattcatctcaaagataaataaagggaagctaattcaatatgtctataatatgattcatctagagacaatgaagcaaagtacatgaaatttggtggacaaaaggaatgtgatgactctagagttcgatgctgatttgccaaagaatggtaaaagaaaccaacaagaatttgttagacaaggactcagaaagcactactctacattagaacttgagcaacatatggaagagataccagttggcttagtattttatattcaagcaacaaatgactagaggaaagtaaaataaaaatcaaaattagaaataagcaaacaaacacatccaagtatatggaacaagaaaaagaatgccagttcaaagcaaacaataagaaaaatgatgtgatttgtattgtcttctttccagtgaagccttcttttatagtagagggtatatagatagactgttaaagggcatataattttaatctaaagaattttatctcttatatatgttgatattttcaatcttctgtatgaattgctaatgaagctcagtagaacaaataaccttttgagacctttaaaagataaaacatataatgcagaaatggtagaaaaaatattttggtgagtaagaagcagaagaaaagatttcaaaatcattgaaggtatttagatagattgtacatatgtcttattttattatgcatttattataattagtcaaattactgacaagtcataaagaaagaacttaccactgtgtttcaaaagtaagtgaatatgagggaattttaaacccaaggagctaaacattataaaatgttagaaatagcacataaaagcaaatttaaaaaaatttttatatttttaaagtggcttttaattctatttaatttcttatttaatgtgaatgcactgattggaaaactattagtgaaatcatgttaaatctgtattccaaagattgatagattctataggacatatattgtgatgtaaatgctttagaagcagtagcataagataattcacttgctattgctttttggtaattgcaaaatactacatgtaaacaattcattttagaaatagccactatacaatttatgctaagctatataaggacaacaaaaggttatgttttagaagatgtagctcataaaatgtaaaataactcatcttagaaacactatgaaatgttcatatgtagatatgattccaaagctaatctcttaatcatttaaatatttattgtatttacagtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaataagtgttaaagcccctcctgtggataatttttttaattgtcactacctataaaatcatacatttaaagaagtctgtcaattataagatttaaaatattgctgccaattcaaaatgtgacaaatatataaatatgatctgaattgctaatactaaaacaagagcattttaataattttttagcttgccaaaataataggcaaatttgaataattttatgaaagcgtagagggaagagggaaagagttaaagatttgttttggatgggttctcgcataatgttataaaatagcaacagaaaacattcaagcagagcattaaaattaaaaagaaaaatcaaatgaaatatggcaccctgcgttctaagtatttgttgtgtgaatgaatgagtgttgatttggcttatttgttagataataaaaggtcagtgaaatgaagcaattatttaaagtaatttatgtcgttaactattgactaagttttcaattaatgtagtctgttactgtattttcataggaaataagaacaagacattttctgattaatttaggttgaaaattacattttaatgaaaaacaatctttatagattatacttttgagtttctgtgaaaaataaattatcttcatttcacacaaatctatgtcaagataattttgtaattgtaagaatcagcaaaatctaaaactaagaatgtttaacttttgtataaaaacatatacaaactatcattagtatttgataatgcaaactcaaaaataaaacgtgctcagaataaccttttaaatatattggtcaatctgtcaaatataacaggaactaaaatattgtttattattcttctactcaaaaattttactacgttcagccaatacatgtataaggatagaggtaaaggtttgaaaatgtcagtgtttttacatgtttattgaggatatcttattaaatatctggtgtgttttattcaattgtactagatatttatgaaacaatgaataatgatgaataaattcaccatccatgtaatgttgcaaataatttcaaacattcattcaaaatggtttttggccgccaaaatttgcatttcatacatctatattggtgcataatcctacagttaggtttattattttatgttcttaagcatgagtttcagagaaaatcaaacttaacagaaatggaggtaatcatttatctaatgctgtctatacgaagatgcaaactcctctaccactagaagattagaggatgtcttcttcagccttggctgcaaaaggaagatagctatatttaaggcttgttgtgattcaggtacagttaccctatccacttgtttgcattatcttctttaattttcacaactgtattttgaaatcagtattatcattcctcattacagataaggaaaatgaaatagaaaggttaaatactaaatacttggtaaacagtaggaaaggacatcgttgattcaggagagactggtgagagagaaagagaaagaaagggtggagggaagaaaaagaataaaaggagataaagtaaatttgaaattttaacagaaagaaaaactgcagttcccaagatatcactagaaacttgtgagatgagagttctgactggtacataacactgacagaatctaaatttaaaatgaatggagaaatgaagaaaaaccatcaaatagcaaggagctatacttgcatggaattccataaaaatgattataaaagatcactgatgaacattgagtaaatccaaaaagaagcaagacaaacgaaatatttcttataaaatggatgacaaatggtctagcagattttttaagtcctgtggataattatttcctaaagcaaattacaaagctgatgcagagccaagatagagtaatcatggaaactcactagatgtcctattataaaaaacactgaccacttgattgatttttataattgccttggtgacaatttaaactctcagaaggttagacccgagcacctctactgagcacttaattttgactaacaaagacagattgatatgaacggatgacatggaagtgactattccatcttgtattaacagtgatgaggtgttcactggacaaactaatttggactatgtggaaagcaaacatctccctttaaataaaagataatttgtactccagggtgagaaattggaaaagttgtggcatcacgtgaggaaagatgcaattatgcaacttacttccccccaaatcagtaactgtaggctgaaacactgttttattttccattttaccttgagataaacacactttgggaaaaaaaaaattttaatatatattgaaccctaaaatagttcgattttaaaaaaattgtcactgtgatggattgtatttttagcagtgtttccttccatttacataattatttgacaggtgacttttagcattaaatttattttatgactattgcctgatatttacaggttaattttctttatgggattactgtttcacaagtggctcatggaggcagtttttaaaaaatctgtcttaagctctaaatgcttaagaaaggctgtgaaatctttccacacaagtacacacacatgcatgcacaaacacacatttatctatctatatgtctttcttacagattatgaaccagtctagcatcagatagcatcattggattcgaggtaaatgaaataaatgctttgtatgaagcactgaaaatttgggaatgttcatcttcttaataattgcctgccaaattcagcaagaaaaaaaatacaatgggcctataaaaatgcaaaggtaaacttaaggttcatctttaagacgttataaatgaaatattggaagtgattagaatatagagaatgatttaaaaagtctccaattcccagagtttttgcttaggtagacattttataaaataatcccttgaaatttgtttcacttcccgaaaatggattttacagtgactccttttctttagtttctgccaggacttaatggaatctctctgttatctctaaatggaaatacacttaaagaaactaattctgtaaaacgtttctgttaaatgaaacacttaaccagtacaattactcaagattatattgctgaatctgactatctccttagtgcatgaagttattacttacacagctcaaaatgctggcagcaacagagctttctgaattttaccaccatacttttaagttgatcctaaaacattatacatttcaaatcatttgatacaataattggagatatggagatggctctacccattaggataccgattggtattcaagtgtcctagatgtatatgaatgaaacgtccagatcccctccccaggatgtgtggatgtttaactctttagtggtgaaatagtactgctgatcatctcaaatcagtagcacatttcttaatcattcctaaaaagttctccacgttttcagtttctgagttttcagaaacatagttaacattctgaaaaaaacatgtaaatgtcatatccagttttgtaaaaacacaatttaaaagatctaaatcttacatatcaatgtatgcagataagatactcaggggcaaaatggacctaatgctcatctctggctcagcaaagctcatgaaaaggtttagttttgattctttaaattagatgaaattctgaaggaaaatgtgctctcattggcaaatagaaacattattaaaaagcatgtgagtggctagttccacacaatagtcaggaaaacagatagttgccttttgtgtttcagactgaaaccacttcaataagatgagcatttcctactaaaatactagttctcgtgccaataagcctgggtctagaggattttcaaaggttatcatttcattccagcaaaaatattatccacttcttctattaggtagacattgaaagtgattgttgtatctttggattaagctatattaaaatggaagcagcagctgaatgggttaggtttagaataagccaatattagaaagagaagccaaagggtcattttcattctatggagctatatataggggggagagctcccaatccacttttaaaattattttctcaaagtcacttcctctttttgcaaccccccatttttcttaaatagcaagagtaagaatatcttgtgagaagcattaaaataaaatcaggcaaattggaaaacttaaaatatgtatgagtgcacatgtgagtgtgaatctgtgtgtgtttttaataaatatactctttagtctttaattgtacatcttgatctttgttgaaaatagtgttttttaaaacatattcacatattgaaacaacaacttcaagaagaggtttcttatccccaagcaaaattgttagttccttccatatgtgagataaaatagttgacaatgtaaattagtcgtatagctgtttaaagcaaattcccatcttactcaattctatttaaagtactaaatttgtaattaaacttggtgatcctctggcaatatgacacataaaccaataattttatgttgcattttctgtataaattgtctttttaaactatactgtggctaagtaaattgcactattgtacatgcaaagcagcttttttaggttattcaataaattacttggactgtagttcaatgcaataatatttttttcgataaaaagcttaatgatataggagtgttagtcatgtatttctaacaaaaagcataccaaaatataagaacaaactcaaatgcaaaatggtgtggaaatattctgtgttttacactgctgaattaaagtgcatttatcattttatttattactgtatgtatttatattatatatttaaaggctgggatttcttagactatttcttaaaattttagtgttattaaaataagctgtttcctcaagctgaaaataaatataactttaaaaattctatggatgtattctttgttgaaacctatcatatatatacatatactgtaaaatctgtttctttttatttgcttttaaaaatgtgaactaatgctttgcaatgttctaacaaagcttcataaatagtctcaggaatgtattctctagctggtaatatcatataatatggtagcattctacacatttattataactttcatatgaactctagagatactttaattaaaagaaaccccagtaagttgttagtctcaataggactcaactcactaggaaatctctttaatcaagcatgaccaatgttgtgggaaaatgacatttcatacaactcccattcatctttactttcttaatctttgcactccagagtacctggatgctactctgatatttgtgcaaaatatcagaaccaggtgttgttagaaataaccactagatactcccttgttcttgaattacatctatccttatccttccctttacccttcaataagctttaaccaaatcctaaatctccttactttagtgttttaattgaatgagctgtcactacctgtgcatttcaatggagcagaactttgcaatgcactctcaactagtggtagagtttgagttttcagtagataaatgtttcagaggccagtcacctgctgccctacacttccagcctagattccctacttttatgctagatcatttattagaattctgctatgtaataaaaaagtatcttttcacacaatacatacacatccacacacaactacatgcacacatgtgcatacctacattgttggtggagtcatgacagaaactgtcctttcttaataaaattgtcaccatttattgagtacctaatatgagccaaatactgtttatgtcctccccactagctatattcctggattccccctgaggagaaaaataagtttctcctgaaaatgaaagtagattttatatatatatatatatatatatatatatatatttttttttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtaagccaccgcgcccggccgaaagtagattatattaataattacactaagacaaaggagcaaatggtaatctatggtctctatactcagagcctgctcttcataatgtgtgagccttctgcctttgttcactctgtgtcattttttggctcatcataaaaatttttgcaccaatagaaaatgactgtcgcatactctttttttaaatttttttaagagacaggacctcactctgtcacctaggctggaatgcagtggcaccatcatagctcactgcagcctcaaattcctgggctcaagcaatattcctgcctcatcctccagagtagctgggactacaggcacatgccaccacactctggctaattttttaaatttttttgttgagacaggggtctcactaggttgctcaggctggctgcaaacccctgcctaaattatcctctgagctcttcatcccaaagtgctggaattacaggtgtgagccactgtgcccaacccaacacatactcctgaggttgttttcttttactacatttactggtagacttgagtcatttcccaaatatcactttattaatactttgaattctagagaggaaacatagcagaactttctgaaggtgcttagcaataaataaataaatgaaaccactcagcagactggcacactcaagagaatactatactttataaagaatcatcagtcaaacaccttacaagttaaatgttttctttatattttgtttatcagaaagagatttcaaagacacaggatttcaattatttgtctgggatacagcatgacatcttcagaagaggaagcaaactctgatacctattcatggaattgcttcattcattatcaggatattttaacagatgcttttgtcttttgttatattttattcatagtttgtgggcaaaaatatttcttccatatttccaagacttaaagaaaatatattctaaaaataggcaattaggaaataactgggatgtaactctctgttctttaaacccctaactccccaaatagttgcttgggaaattgtattattctgtttcatactgctataaagaactacctgagactgagtcatttacaaagaaaagatgtttacagatatacacagttccaaggctatacaggaagcatggcttgggaagcctcaggaaacttaaaatcatggtggaagggtgaaggggaagcaagcatgtctgccacatggtggaaggagagagagcaaaactaatatacattacgtagctactgcatgcaaggcacaaatatagcagtaaataaactatctaaaatttctgctcttaccgagcttccattttagtggaggggtaagaaaaagaacaaaataaataagcaaaagatgtgatcaaaattagtaagtgctgaagaagccaatggccatctacacataatggaagagcctatatttgttccaaaatctgttttattatgaaatctatgcttattcttctacatgaaatggtataagatagtgatgattatctgggcaatgatgcatgtttgtttggttgctccactaaagaagaatgatgagtttaaagaaattcatctattttgaatggcctgtagagaatagttataaaatttaccctaatgttcgccatgttaagcctattttgactttgagcctggaattccgtaattgcactgcttcaaaatgtgttgctattgaataatttaaaatgcaatatatggttataggagagacgatggcatatttacgaagatatgaatgcaacattgtagtcatcagtaattaatgcatgttcaaaaagaaaaaaatgatttcagagaatgacaagtgcagtagtcatctgagttctctgttttaggaaggcagttaggtgtgaggaaaacctctagcttttggcaaaatctacagggaaattccatttcatcaaaaggataggctcctcagggtttgctgccattgtctaactagttgctgtatttattaaagtgtgactgtttcatgtctctttgatgtgaagccattttcctaaatcccacaatcaataattatttactgggctttttgttttctgttatcctagttatttcttttttttcccccactgacttaaacaatagcacaattccttttttctccgtctaggagcagaatgaaaactgtaaaatcatcccatatgaaaatctaaactatatgagaaatgttacttcttgatttctaattgattatctttgcaaatgataaataaattaattatcaataagtgaggctgtctaataaatgaagctttttggattgttgttacacagaaaaatgtatctttggggatgatatcaagtgtttctccttggaaagccagactctgaattgcagcactgcctggccttggtttcttatttcaaattgagctgtcccattcttgatggcagcatggggttggttgtcaccacttatatatatagatgtttcagtgcttcaggctgatttctggcatgtccttgaaggattacactggccctcttgggcatgcctgttctccttctgctccttagatattctgccctcatcaatttttctcacatgccaatcctgttggaattgagttttcacaataattgtgaaaaatataaagaaacaaatgcatcctgaaccctgactagtgtgaattttattctgcctactgaggttgcatgggtggtagttgcactagaatttagtaactagctgtgacaaggagtcaaattcttataaattgagtgtttgtaaccacacagttactttgtcaacttgagatctgatgtatgatagtgttctattaagagaaaatgagttcatgtgccaatttgagaggcgtgtcattaatgaagatttcagagagataagagcttaaatattttcatagaggagtgagcttatccaaaacttttcaatgttattcatgtttcctcagtcaagatgtacagacatatcaggaaaaacatagcaatcatagttgactagcaggttaaagagaaatggtcacaatctatttgtctcatctactttcccccacaaaaatgataaacatttaattggctatgccaggattgtcaagatctagaacagtggtgtacttgtcattttgcatcctccttttttttttaacttactattataacattttccttcttgctacattgtttcttaattagcattttgaattaggaagaaaagtgcatggagtgtatatactataatttacataaccattccccatgttattgttatttagactttcccccagctttttgcaaatataaagaatgcttcaatgaacatttttgtagatgtggtattttttcttcttatcattactgatatatgattggttcttggaaaaggagatcaaaacacacatattaatgttttgtatatattaccaaattgctttccaatgagttttatcaaggtcataaatataaatatatcaaaaaccatatcaaaaacagtaatgtgctataattcattcaactcttccttctcctatcattatcattataatcatcatcctattattattattctagctatactataattataccataattatataatgattgaagatttaaaaagactttggtatgttcttttgtcctttgtaagttaaaaaatagttatagtttctactttttgaattatctgtcaatatctttcggaatctatgtaaaataagaatgtgtgtgggagtttatagctcttgttctttaatggactacaaataagccttaatcattatgcttcacaattttactcctaaacttgcatacctacactttataccccatcgaaatgtctaattgcctgtctaggaatcaaatatcttcctgtaggatcttgtctcttgtcattgtattacacatatttcctttagaaagaaaaaattatactaacaataaatgctaactagttctttcaaagatatcaataatggtaaaaatgctgttcccatatagtagaaagtcatagaatcttataattaggagagaatttagagatcatctggggccaagaacagcaactacaatcttgtagacaccctgtttgacttactgaatgaatgactgaatctaatattgtgctttcatttttataaacaatgaattttctaaagtgtgtcccaggaatacaaatgaatttgccagtgtaagctggtattgaataaagaaatttaactcttaactataatactgtgccatccagatttagattgatggcaaaagttaagagcgttagtgataacttagatgatggaccttagaactgaactactcagtttcaaaccccctttcattttctagatgtgtgacctgaggcaaatcagttaacctctcacagcctcagtttctttatttaaagatgtatataatgatagtacaatctgtataataaggaatttgactggaattgtagcctctaaacccttggaataagaaatttggctggcctatgtcctgggtttctagaaggtagtctctaaattctaggacttccctgagtgatatgtgtgtctttgatatttgtggttagccttgatagtttatccttatgaggtgacccatggtctgctcctagacagtttaaagtaatgagattactcaggatggaagccggccgtgccaaaaagacaacatgtggttagcgagttgtggctttgagccagatgatatcagcccaacctccagagaggggagaggagaaatggaggttgagtgacatgggcaagaatttaatcaattgtgcctatgtaattaagccctgacataacctatgcatacaatgttctggtgtgcttccttggttgttaacactctgtgtcatgactccaggaagagaacaatggaagctttgcatttcgaatcctcttagaggttgttctatgcaactcttcttttagctggttccgatttgtatcctttttgctgtactaacattgtcatcaaatgtatagtactttagtgagttctgtgagttgtttgtcgtgaattgagcctgaaggggtagtaggaatccccagatttgttgccagttggtcagaaataaagatggcctttggacccttgaactttcagctggtgtctgaagtaaaggtagtcttgtgaaggattgtgtctttaacctgtgaagcttatcacaacctctgggtaattggtgtaaaaaattgcaacatctcatagagttatgagaattaaataatgcttagaatagtaaccatatgtaataaacactgtgtaagtgttagatattgtaattatcattaaaagttcaggttttctcatgactgataaatataatgtccatataataagcattggtcattttttacttagtactttttatttaaccattaaaacagttctataaaatgtttccatatggccattttcccagttgtctgttttaaggaaacatctagtgagtggtagttctgacattaaaaaaagaataaaaggtctgtgttcttcattacaatgtaatatatagcctttcccacttattccaaccaaaggctaaaatctcattttctagaaacaactattacatttataatcacttaaaaattttttggctgatcttttgctgacaaaagaatggaaagtttacttccagatttctgtacaatctaagctaactgactcactgtactgaatgttcagctatctgtcatagccaatagattccagaaattataatagtgcaaactcaataagtgactattttaaaaataaaatttattaaaatgtatttgtaatagaagcactgaatgaataaataaatccacaagtctcttgaagccagcaggctgataggtgttcttcgtcttcaaattctggctcccaatgctttcttgagtgtcatctttaattcaactgaacagaggtggggaaggaagtggggagcaagaggacatgcaggagaggaatgggaaaaaatataaaacatttaatatggtttaagcctagaagtaatttcagctcacattccattgactagatctcagtcaggtggacccatctaagcgcaagggaggctgggaaatacagcatgtctgtggaagaagaggagaaaatgcaatactaatagtttaatatttcattcttaatttttcatatgctttgctgccctatcaagtccttgcaggaagtagtccataacaattcaatgctgattattttattaaaatcctttccttcagtgaaataccctacttgcctatcacgactaaaagtctctctttttcacaggtgaaattgtagttctgattctggcaaatttaaatatttgtttcttcttctgagtgaatgaaaaccaaaatgtttaagattgtgcttgctctttttcttattgtttctggcttcttatcccaagccttaacacttgcttttctttctccttctcttgacccatatcatgtgattaaaaaaggggggtggggaaatgatgtttgctggtcctgagaaaatggaaatgtgtaatttcagaatcccagggttttctaagggaatgttgtgctaagagcatgatccaggctctattttatagcaggtcagttattcatcctctgaccctcacccctctttcttctgacacttcttgtcctttggtttcaaaatattaccttagaaaactataaaataataaatacctagcactgtcctgttgcacagcagtttcttaaacattgcactcattactgaattttccataccgcacctgccagttcaatgagagatagtctatttcattgtataattcctcatcttgcagatttgcttcaaaagtctacaaaatagacaagcacaggctttataaaagtccttacctttaggtgcttggtgatgttcaattgacctatgaaattacatatttataattgatcaactgcttatggttatcatgctttcttttactttacattcccaacaacttagcatatataatcagctgaattccctttcaacagaagctttatcattcttgaaataagaaaagaaaaaaaatcaccaaaatgatcacttagaatgtcacaactacactttgtacactttgcagtatgtgacctatcctgggaaaaggcatattcttggcagaatgttgccctgaatcatcatttcagaactgttatgcctgggaaccaatactctaagtgtggaatacaactgaagaccaggagaggatggagaagcattaagaattaggtttcacctctgatttctaggaaagtggtgcattcttataatgaaatgtagatattcccacagtttgatcaataaaacaaaaattggtaggagtatgaaatatatcaaaaatcaaggcaaaaatgtataaatcatccaagacattcattattatttaaagcttttggatacttggaaaactatttgacctttgttaacttccattaaaaaattaaggcaatgaactttcatactaaaatttttccccaaagaaagtgtgcacattttaagtgtctgaatacattttagctaatgccaaaatgtttctatcatttcttttgcatatattttacttttttatttagaattctgtaaacacacacacacacacacacacacacacacacagtgttgtttttatttcatttttttgtttttgtttttcatacaggcttgttttcaaccaggcataaaggtaatagaaaaatagagattcttttttaaaaaaatagtttgaactaaacaaagttttagattagttaagagacttctggctttttagtccagtatttttacaaacatgcagttttgctttctcttcattctggttcatttgggtattatttttaaaagaatgactttggacaaaataaaaacctgcttaaggtcacataagttagcataacatgctaatagcttatattcacgttaaaagatacatattcaggtcaagtccttactgattttaagactgagtgacctatgccaagtggacatttgctgtcagaaaagtgtcccttcagtatctctagggagcaacgagactacaggtgctataagaacctataaataataatgaatgtcttggatgatttacacacaatgtgactaaaataaaataagaggtgatagttgaaaaattctaatttgttttgacctccaaattttttatcttagaaagtatgcctcctaacaggcagtgctatcgagtaaagaacaaaacctttggactgatactatctgatttcagattccagctccatcctttaccagctatggatacttgggaaactacttgacctttgttaacttccatttcctcatctaaatgagagtaataaacgtaggttctaccttaggaggttatagttagcattttgtaaaagtgtttggtacatatggaggtgtagtcgtattggctaatggtttgattaagcagcataccaatttaaaagcatattttaaagtatatctttcatttgaaagcaatatactatgacaagataataaaaatgggaaggaaaaacccacagtttggatttttctaaaaggaaaaagccatgcccctcactgccaccttagatagattcactcactcatttttttcctgtctttgggcttagtctatggactttagtgtaagataagaacagaactcctgctttcctgaactgtcccaagtaaccaggccctaaacacacctgcttcttcatactgcacactgctatgaatatataaaatagcatcctgatatgtcctggagattcagcctttattattttgcagaaaatctctaattgggcaacttactatccaaagtattaatatccacaaggatcatacaatcttattaaaaattattttattgatttctatctttccacctgtgcttgtcacctgagaagcagatgccagattggtaattacatgtataaaggatttcttggagaaaacatctgtgaggaaaaatcaccaggagggagttagaagggatcaggagaattatcagacaaagatgtaggtataattcccgtaaaagaaagaaaaaagcaaggaaagttgagtaggagaagttgtgcaactctaagactgtttccacaaagctaatggggagcacttgagccaaagccattcattattggaatcttatatttccttaaataaggcctcgcctagactccctgttgtatttaatcattggctatgagcacctggtgggaggcatggcctctaatcaaacatatccctggatttcctagtatatcagctgggcccatctttcaattatgctcccttcaatgggagacagagaatacttaatgaccaccaaacgacctgatgcttgagtctcttctacactatctcctctctgcaatgctagagttccatcaccccctctgctgaggtaccagtttagcatttaccctttgttccctctctctgccttttaatctatctcaaataatacccagatcatcccttatgctgttgaatgtatcacaataaattccaaagacaacagcaatgtttaaattattttttgtttagaattaactattaatcaagagatatagaacataaataataattcccagagcaagcacagtctccagttgttattaatctttgccaagactgataaatgattgactaattacatgaaatattatagactcaggaaagcagagcagaatgttaaaacagggcttaagcaacggtctgcattaatattgtgttttgttcacttatgctgcttgtgatctgattgtaaaaacaaatcagcatttagatattccaaagtttctccgaacctataaaaaatactgtttagttgtattttttattcattagcgtttataatgtaaacaattatttaaaatgataatcaatgatgataataaaatcattttcaaaacagatttacagcaaagggcattagacattataaatcagtgacaataatcaatttaccatgcttccaaatgtacataggctaaacttttctcatgaacatttcaaaacattcaaatttggtataattttgtaacaagttataataatttatgaaaatgacaattggtagtcagccactttctagggaaacaaaaagagaaactcagagctaagcttagagtgctttgcagttagttttattaattccatttgcctaaataaggtaaagatttgccttttttttttctagagtgatttaatcagttcaagctgctataacaaaatactatacattgggtggcttaaacaacataaatttatttcttacagtgctagaggccgagaagtccaagatcaaagttcccaaaaagtaggttttattctgagatctcttctcttggcttgtaggcaggcactggtatctcactgctcaaatgacctctttgtacacacccacagaaagacagagagagaacaaactctctggtgtctctcctttacagacgctacatgagggccccaccctcatgacatcatttaactctaatcatctcccaaaggcccctctccaaatactgtcacatgtgtgattagggcttcaacatgtgaatgtgggggtgggggcacacaaacattcagtctataccatagaggaactgccatagcctcggatctcaatctgtaacacagcacaaattcacaacatgatcaaatgacaatatttcccaggtcaatgggaggtacactcttttccctctgcagttgctctttgcaaattctcccatggttccccagggttctttacaaagatcagcgtttcattcctcctttgtactgaaaactgtctgctaagagattgggatttcaaggatattctttaaagccagttgatgcaatagtgacctcctgtctgttggtcttgattacttccagggccaccatgaccaaattggaatcctgggttactgattaaaccattatagcaagaagcaatgccccatatttagtacagcatcactgcagtcccagtgccatcttgctgtcaccacggtgctgatgtgaagctctgctgattctcccaggattctgtgagtaactctagtgtcaaactcagtcagtaacatcctacagcaaaaattacctgaaccccagctatcacagctttcatccacacatgtgcaggtgtacacatgcatgtgcatgcgtgcacacaagcacacgcacacacacacacacacacacacagctgttttctcaacaagatgcctaggatgacatcaccaggtacttgcaaggcagagcccaaactacttctgccctaatacatggctggtatagagtgttaagcacaagtccagacttttcctcccttatagtgaagcttacctctgaggttttattttgcttctgtatgtcttaggctcctcctgtttaatcctatagatttcagtacacttaaaatttcagagagaggctgggcacagtgggattaactcactgggcacagtgagactgtaatcccagcactttgggaggacgagggaacggatcacctgaggtcaggagttcaagaccagcctggccaacatggcgaaaccccatctctactaaaaatacaaaaattagcctggtgtggtggcttgcgctgtaatcccagctactcgggaggctgaggaaggagatttgcttgcacccaggaggtgaagtttgcagtgagccaagatttgtgccactgcattccagcctgggtgacagagcgagactttgtttcaaaaaaaaaaaaaaattcagaatcttttgacaaagtttgtctgattccaccttcagccagaagtttctattatattcttcataacgaaatgaatacattacttatatcaacttgatgtaagacatatcaacatagacagatagatgatagatatagattagatagatagatagatagatagatagatagatagatagatgatagatagatatagctagatgatagatgtgggttcttaatttgaaaatttaatatgataaaaaacactgcattatatgaaccaaaaagtaataatgacacagccttattgtagtccttgatgccctagagaagtagctttgataccctggacctctttgcctctaactcccacattattgctacattacaaagttgaaatacaaataaatagaaatcatgacacttctattttgatatgtgttttccaccaatttgctttgaattcttcattcgcaggggaaaattctaaactcactgagtcttagaatcaataggtctgactttttgagaaagctttctaagttaaagatacccacaggcaagtatctgagctccaaaggaatgtactcttctggctcaaatattgccttgcaatgcttctgcctagtatctaagggaatagttcccctactcaataccaggcactgaaattccttcatggcccaaagcccaaaaagaagctgagaggtatggggtcaaaagcaagtggagatctggagatgaggctgatgaagcaatgctctgcaggagacccatgcgtctttgtctttgccctatggagcatggtcgtcaggaagaaggttctaggtgaaaaactgtccttcagtacttgtcacttaaaattaaatgtggcaagtcccaccaggcttttgttaaaaaacctaatgatgcatttccattttcagttttatttcttcctcctgaaccattggcatttctttaacatcaatcaggtggaggttgctgtgaactttccctgtttgaactcagtcaattctgaatttgttttctaggtagtctaattttatcattaaaaacactttagctctgaaattaaagctaagttatatcaggtttcttgggaatctgaaatgtatgccatattggcctccttaagttttatttcttaatatgaaaataaaatctcacattttaaactttaagaagagagagtacacaggctttgggaattcaacagcatctagtcacagcagcaatacttgtagcagcaaatttgtagatacaatggcatgaaagttcaactgcttattactctcattaatctttactcttacttttgctgtctttatgcctctgactgtctcgttgtcctcactggagtaatgccaagctagtatccagtttcaaagttcacatgttggcctcatttcctaaactgtaggcccttccaggatagaggccacatcctcttgtctatagctctgtagcacctagcataattcctgggacattgtaggtgatccaaaagtatttaatttttagaaatcaattttaaaagacttgccaaacctccatttaaactgcttcctggaggcaacaatgcagaattcctggtccaggtgtcagcatttacctgtgactaatctgataacggtgtgctgaccatgccttggccttctgcctgggttgggtacagtgggagtagggggacccatgaaatcttagactcctcatgacatgctgcaactgagtatttgaggggtgtaggcatagatgtccccgttttgatctcccaatggagaagtatatagcttgttatattgtcattagggatctgatgtggtctgcccacattagggtgaaggtatagctcatgtaaatggtgagaattcagtgtcattttgagtaattttaagtaattatgttacttgaacacttaacatttctgaaccttagcttcttatctgcaaaatgagtaaaataatatcttcttttctctggatttttatgtatctgatgtaaaataatacagaaacgctttgcagatcataaaatcctattcaaacataagatatcagtatcactatcttatctatagtaagcctgtgagtggtaaggcttctgaaattttctatcagagacttcagcaaaacaggtaactaggtataaattatgcaagaatttggataattttgtagtaaatttggaaataaatgcaaactccaccagttgcagaataagagcacatgttagcatttgggttacatgttgaagtgcaagtgaagtaagtactcccagaaaatgaggcaatgatagagaccaatatctgaactacctgactccagttaaaataccaataacttttttcaaagaaaaacttctaccttcaaaaccacaactgcttaccacaggatgatatgacttagaagaccataaaataagagctgatgttttgtctttatatgcaatgaaaaatgacagaattgcaatgggggcagccctaggaatcacacccctcagaaatattcaggagccccaaataatcacggatgccactaaaaacaggaaatgtcctcatataaaagatgcaacagcccctgtggcatcctcagactcactgatgcccagacgaatccttccctcatccagagtcaggcttgcagcaactgcaatcaagccttctcacaactatcccccacttccctctacttcttgcctttaacaagtgttcaacctgtccccctaccatatgaattgttttccatgaggatttcttatacttagatctctatacataaagatcaagaaattataatttgtaacaaagcatactctgcattctcaagcttagttaacagaaaacagtattgaaatatacatgccatatgaagtacttcatttgtgttgacaaagggtaatatcataaactatttaatcataaagagacttcgcttttcaggtcaagtgctgtgtagttttttttttttttttttgatatttctctacttaaaatgacagtggaattacactaactcatcaagactagaaacctagaaataaagcaaaaagctccataactttgttggaagttatctttctgcacactaaacaaattacccaaatgtttcattctttgattacaaaatcatttttcctaagtaaattttctctgagtgttaagatgtacctccaacaggagtatcaataaagtgcctaagaatctagggttctagggtttttatgtgtgattagatttctcttcttctatggccttcctgagctaaaatatagttcaggagacctgtccttgtttctgacccaaaattttcttgcattgtgaaagaatagctcagcttttctgttagccaacaatctgcagctctttcaagactgcaactctccctaggatttttttcacaggatctgaatgcaggtatacattcactctggctcttcctttttcgttattcagacattctcaaactatatattttattttattttttttgccaaaggaatgaatgaacaggtaatatagagaattataatgagacatgagatcacattcttaaatatctttgtcatctaaaataaagacagcagtctaccgcttgttttgctcaccattgtatctctggaaaatattatagactttggcacatagggagccctcattatttatcaaatgaatgaatgaatgaatggtataagaaaatggcacgtgcttaggaaaagaaaacactccacctcttgtgatcatttactgcccttatcagggaaccatgagtcacactttgggtgaactctcctcaattaagacccccaagcacatctgggaaaaattaaaatctaacattaccttattttatttattccaaaatgaagtgacagaaataggttacatatacggaaatacacaagaagcaacacattatatacagcatgtgaatataaagaatcttgatataccacctttccttaaatgcaatccttaccattcataggctctggaaaatcatagcaatgagaagattttttacttcgagcatactcactgattagctctgctgcatcccctacttccagaatgcaggcttgacatgccttcacctgcgtgctctacttagtggactccctcaagtgagccatgggcacaatcttaacattggaagaaccatggaagtgtccacatttctattacttcttcagtgctacactattttcttttggagggggagggactttcattcaagctcactaatatgaggatcctgacacataattcagtccaaacacttgctagaggcactgtatgtttttttctgattgatgtcaggttccactgaattgtaaaaacagagagagcttcccagtgcagggacaggcatcattgtcgataatggaagatgctcatgagtaaactcctgagagaaaaaacacacaacacatttagagaaaggcgagaaacatctttcagttggaggttggggtattctgtgaaagaagaattgatgtgtgaacagataggtttgggtgagaccaatctgcttttcttttttttttccttgatgtagtgaagtcatcccatatcagtgtctttgctgtttcttctttttggaatgatatttatctacattattgcatgactgattttttattttacaattacagatacaactcaaatgttctctcctcagagatccttccttgactatctatttaaattacctcctatgtcattatgaaacattagcctattctatagtcttcatagaactaatggtatttttttctttttttaaattatactttaagttttagggtacatgtgcacaacgtgcaggtttgttgcatatgtatacatgtgccatgttggtatgctgcacccattaacttgtcatttaacattaggtgtatctcctaatgctatccctcccccctcccccctccccccaccccacaacaggccccagtgtgtgatgtttcccttcctgtgtccaagtgttctcattgttcaattcccacctatgagtgagaacatgtggcatttggttttttatccttgtgacagtttgctgagaatgatggtttccagcttcatccatgtccctacaaaggacatgaactcatcattttttatggctgcatagtatgccatggtgtatatgtgccacatttccttaatccagtctatcattcttggacatttgggttggttccaagtctttgctattgtgaatagtgctgcaataaagatacatgtgcacgtatctttatagcagcatgatttataatcctttgggtatatacccagtaatgagatggctgggtcaaatggtattcccagttctagatccctgaggaatcaccacactgacttccacaatagttgaactagtttacagtcccatcaatgtgtaaaagtgttcctatttctccacatcctctccagcacctgttgttgcctgactttttaatgattgccattctaactggtgtgagatggtatcttactgtggttttgatttgcatttctctgatggccagtgatgatgagcattttttcatgtgtcttttggctgcataaatgtcttcttttgagaagtgtctgttcatatcctttgcccacttgttgaaggggttgtttgtttttttcttgtaaatttgtgggagttcattatagattctggatattagccttttgtcaggtgagtagattgcaaaaattttctcccattttgtaggctgcctgttcactctgatggtagtttcttttgctgtgcagaagctctttagtttaattagatcacatttgtcaattttggcttttgttgccattgcttttggtgttttagacatgaagtccttgcccatgcctatgtcctgaatggtattgccaaggttttcttctagggtttgtatggttttaggtctaacatttaagtctttaatccatcttgaattaatttttatataaggtgtaaggaagggatccagtttcagctttctacatatggctagccagttttcccagcaccatttattaaatagggaatcctttccccatttcttgtttttgtcaggtttgtcaaagatctgatagttgtagatgtgtggtattatttctgagggctctgttctgttccattgttctatatctctgttttggtaccagtaccatgctgttttggttaccgtagccttgtagtatagtttgaagtcaggtagcatgatgcctccatctttgttgttctggcttaggattgacttggcaatgtgggctctcttttctttccatatgaactttaaagtattttttccaattctgtgaagaaagtcattggtagcttgatggggatggcattgaatctataaattaccttgggcactatggccattttcacaatatcatactgaatgtgcaaaaactggaagtattccctttgaaaactggcacaagacagggatgccctctctcaccactcctattcaacatagtgttggaagttctggccagggcaatcaggcaggagaaggaaataaagggtatgcaattaggaaaagaggacatcaaattgtccctgtttgcagatgacatgattgtgtatctggaaaaccccatcatctcagcccaaaatctccttaagctgataaggaatttcagcaaagtttcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggaccgggacaactacaaaccacggctcaacgaaataaaagaggatacaaacaaatagaagaacattccatgctcatgtgtaggaagaatcaatattggtatttttttcttaattgttgccatctctctacgccataacgtatacactctttccattcacctccttttttttcactgctagatcagcagcacctagaatagctcttggccaagagtaactgtgtggccaccttactgatacaagtaaagggcttgtaataccaaggcatttctggtggacaaaacggatctactggaattttttcagctatgggagaacagaggtccagaattgggcctcagagaaattatgtttgtggcaacatgcagtctggaactgaaaagagagatcctgggtcagaaagactaaaaataagatgttttaaatgtatgtgtggctgtgtgggtgtttgtgtatatatatatatatatatatatatatatatatatatatatatatatatatatacacacacatacatgtaatttctatatggttttgctgatattgctttaatttttatttatttgtacaatatattagctgtttaaactataaacatgttttaagctaaagtaaatctatcctttaagacctgttaaacttgatagattatacatatttccgaactcagctattagtattgttcgttgttgctttttggtggcttaaggttatcagcacatctctgtataaatgaagacaactactaaccaaagcacctaagcattttaacccagacaatataaaaagcctcataattcagaatttactgtaattattgcagttaataaatagtaaaggctatttaaagacttcctgtcttgagatggtatgcccttgtattccaaaaacttaataagggataataataatgattaggataatgataatcacattaagatcatgaaagtatgtttaaaaagcttaaaacgagattcctgcagagatgataaaaagggttctctaagactaagttgagaattgaatttccacatagtccaattaatttcacacagaggaaaggcaaaaaaataacgattacatggatccatgccatactctcaatcctgtgtagcaaccacaacaaatcaacaatataattattcagtacctaatgtgttagatgctgatggtcacatacaatttgcaaatacatgccactggacaagtagaaaaccagatatatcagtgccaactgcaacctctggcaaatgtcagaaaaaaaagtcactctgagcaagatcatctttttttttaattcaagagttgggtgctgtttttatctcttatgacttctctatattacttgcagtaaaacttaaggaaaaattgtaataatgtgtccccacatcttatttttatcagatggccctcatctgacctccccttcaattctgcagagtatatttaaaaggcagatctgatggtaactctccactactaataaacagttagtagctctcaagaatcaactgaagaagaccaaccttctaaaccttgcttttaacattctctattgctagtgccttgcttaattctcgcttaataatgtatcagtactaactgtttatagtagagacaattgcttgcctctactcatgctgcccaaaatgcccaccttgcttattctaccttcttacttcctctgtttgctaaatcttactttatcttcaagataaagttacacatcatctccttaaggataccttccccatatcttgagccttagttaactgtctttagttgataattccatgcactctgtggatgcttctattccatttacaattgacttcattcatatccagttacatcactttacctaatttcagaatcacatctgtcgtcactttattccaaaagtgtatccattctcaccacttctttcaaatggctgaatgacaacaaaaattgatgctaaatgtaaatcaccatttaaatgttgctatgttgcttgactaggtgcaatatatagttgaaacttctgtaatttttattaaaataataaattataaaatataaagctgcagaaaactccatgttgtaaatataaacagatcaacataaatttttacaaattgaagatacccatgtaattatcacatagatcaagatattgaggtataaaatattttcggcaccacagaaacctaatcctggacctccctctcataatcattaattcctgctgaaattttgcatgatgtttaactttatataaatgaaataacacaactctgttgtatttggattaattccctcaagtttgggtttatgagatttgcccgtggcccccgtgtagaaatagtttattattttacagagctgtttagtattcccttatatgaatataatacagtttgcatattctttggttgatggttatttggtttctttacagtttgtggctagtgagaagaatcaatctctgcacatttttgtacttgtcttttggtacaaatatgtatgcatttctgctgggtatatgcctaggagtataaagtcaggtcacatgatatgcatatgttaatctttattagatactgccaaacagtttttcagaccggttatgtcaatttacagttttctttttttgtttgtttcttttttttttttgagacggagtttcactcttgttgcccaggctggagtgcaatggtgcgatcttggctcaccgcagcctctacctcccaggttcaagcaattctcctgcctcagcctcctgggtagctgggattacaggcatgcaccaccatgtctggctaattttgtatttttagtagagacagggtttctccgtgttaaggctggtctcgaactcctgacctcaggtgatctgcctgcctcggcctcccaaagtgctgggattacaggcatgagccaccgtgcctggcctgtcaatttacagttttcacaggtagtgtatgagagttccgcttgatctacatcttcaccaccagttgctgttttcagtcactgattgattgatttatgcattttattgtagtttaaatttgcaattccctgatgacaaattacgttttgtacttttttaaaactgttaatgttcacttacgtgtccttgttttaaagtccctaacaggtcttttgtccacttttaatcatgtgactaggtttttcttatagactccaggaattatatattctgcatatgaatcctttatgaaataagtgaattgcaattattttctcttactcagtggttcccattttcattcccttaatgctgtcttttaatgaatacttttgttttaatgtaaaccaacttatcaatcttttcctttgtggttagtgggggatgtgtggtgtgtttgtgtatgtgtgtgtgtttgtgtgtgtgtgtgtgtgtgtgtttcttctgaatacttctaagattttctctgttttctgctttagcggttttcctaaagtgtgcctagatcttttactttgaatttattctgcttgggtttcataagacttcttgaatatgtgcctcaatgccttttacttatttttgaaaatgattggtcagtactacataaaatcttgcttctgctgattctgctcttctcttttggaatatatatatatatatatatatatatatatatatatatatatgaatttctattcttatctgtattttccatacttttattctttaagctacagcccgaatgttttctgctggcccgtcttctagttcattaattctaactctcttgtcttgccatggtaaatacttacattaagttgttgatatcttactatccattgttggatttttctgttccagaattggaattggaattttaaaatagattctatctctgtggtaaaattattcatatatcatatattttcttgaatatcttatcatattaactttaaaacccaagacagattatcaccaaaaactgggttatttatatgtttgttactattgtctgcttttctttcagatatatttcttagactcagtaatttttttcaatttcttaaaactattaaaaagtatagatactttgcatgatttatctttccagagtaatttttagtaaagtaaaatttatttttatcctgtcttctctttggatgcctgagttagggacaaacatttttaacatccaaccatactgaattgtcttgaatgtgagttggcatttgtgtaagcctggatattctcttgttccctcactaagaatcccaactgaaaactggaatgtatatgggatcctcttccttgtcagggcctcaacaaaatttatacatcttcaacaccatgacctaatttaaagaaacaaaaaggattataagagaatactgtaagtcaacaaatttgataacttagataaaatggttaaattcctaggaggacacaaactactaaaactgatacaagaacaaatacaaaatctgaaaagacctataactagtaattagagtaaattagtaatttattttaaaatttatttttttaaattgacaaataacattgttttttaattatttacaacatttttgaaggtatatataaattgtggagtggttaaacctagctaattaacaagtacattacctcacatagtaatcatttttatgataatagcacacaacattctttttagatttttcaagaatacaatgcactatcatgaattatagtattcttgctgtacaatagttctcttgggatttaaaaacttcgcacgcacacacacacatatcaaaattcaggctttactataatctacaaatacttaaaaaagtaatacctacacttcacaaactcttccaaaaaacaagagcgaaggaaaactttctctttattctagaaggctagtgttagcctgattatcaagtcaggcaaaggtaccactagaaaggaaaactatagaccaatatgacttatgaacatagatgcaaaaattttcaataaaatatagcaacttgactccagaaacatacaaaaagagattatacaccatgaccaagtgagatatagcccaggaatgtaagactggtttaacatctgaaaatcagtgaaaatgatgtaccatgttaataaaataaaggacaaaaaatcacattatcatcatagtagaaataggagaagcattcacaaaatctaatatactttcatgataatactcaacaacttaagaatagaaggaaacttcctgaagctgataaagggcacatgaaaaaaaacccacagataacatcatacttaatggggaaaaattgaatatattcttctaaaatcgagaagaaaataaggatgtccatactgactgcttctattcaacactacactgtgattctagccagagatattaagcaagaaaataaataaaaaccatacacattggaaaagaagaagtaaaactatgtcttcatttgttttgtgtttctacaacatctgagactgagaaatttataaagaaaagaaatgtatctggctcacaattttggaggctggaaagtccagaggcatggaaccagcatctgcttgtcatctggtgagggccatattgctgtgtcattccaatgacagaagatggaagagctactgaatgcatgagacagaaagagaaagagggccaaagtcatcctttttcttatgaactcacttttatgataactaaccccctccctgataacagtaatgacattaattcattcataagggctgcccttatgatctaatccccttcttaaaggactcacctcttaatatcacaatggcaatgaaatttcaacattaatcttggaggggacattcaaaccacagcactatttttattgacagatggcatcatttggtataaagaaacttctaagaaatcacacagacacgcagacacacacacacacacactactacccctaataaaggaggatagtaagattatatgatacaagatgaacaaaatcaattgtatttctacatgctagcagtgaaaaatctgagaataaaattaaagaaacacctcatttataataatattaaaataaaaacttagaaataaaataaacataagaagtgaaagaattgtatgccaaaattatacattatttaaagaaacttaataagatcaaaaaaggaaaaacatcccatgcttatagataagaaaggtaagtttttgttttttttttttttgagacgaagttttgctcttgttgcccaggctggagtgcaatggcatgatctcagcagctcactgcaaccttcacctcccaggttcatgcaattgttctgcctcagcctcccgagtagctgggattataggtgcccacgaccgcgcacagctaatttttgtatttttagtagaaacaaggtttcaccaagttgattaagctgttctcgaactcctgacctcaggtgatccacccccctcagccgcccaaagttcttggattacaggcatgagccactgcgcccggccaagaaatcttaatagaagatggtaatactcctcaaattgatctgcagattcaatgcaatgcctatcaaaatctcaacttgcttttttgcaaaaattgacaagattattttaaattttaacactatgagcttgccaaaatctttattctgtttttcaatatctttctgcttttagcatgttagtcaccttctgcaaagtttcagaatgtcttaaatgtcctgatgggggatatacaagaataatgttcaatttgttgttcatctctactcaccaatatattcaccctcaaacttctagcaaactgggaattccaaactccatttttttatctcaccagtttcaagagattttcacatgctctactggcttttttcccccttagccttgtccctctgactcatgacccattccaaaatcaacaaattccctgaagggtaaggtaacacacagaatgctagcttacctctctgcagatttttctctccattactttaactcatgagatctcgtgtctcaggagctctccaatgccttgtttttggttttgtatgcctttcctagtttcctcagcaaaagtgatggttcaggactaatttctctgttctgaagtgaaatagagttctcaattttctttcttaaaaatgtatttcttttcagttataattctcctacttatcatcactggctatatttcagtttcctttcctagtccctcttattaacctgtacaattttactgtttcaagaatcttccctgaattttttttcttttttatgtgcatttctaagcagctttacccagtctcatggcttgaaatcctgtttatgagcaaatgtctcccaaattcttatttcccatcctgatcaccctctcaaagcctagacaactatatcaaccttctacttgttatgttcactgagagagtttacttggcatcttagtcttattaagatggaaatgagaaatctcaaattcataaatctcaaagctgttacttctaccattttactcatctcagtaaaaggcaccaaaatccactcaattgtgttagccaaaattccaggttttcttgagtgacttttctcaccttctacattgatggcatcaggttcagtaagctctcccattaaaatgtgacccagtctattcaatgtatccatctccactattactacctagtccaatccactcatatgttgcctgcattattagggtcaccagtctcattgcttctgttcttgcataaacccgtcaccaccattatcattttctcatggcaagcagagtgattttttttatatattaggtggttatatcactcttgtatttgaaaccctccaaatgcttgaaaacaggtaaaatcataaccctagttaatacacttttaaaaggttctgcctatgacttcctttttttcagtttttaccagccttgtatttgtccttccctccagccaaactcaccttcttttttttttttgaaagataattcagtagttactgcccggtacttttaaacaatttgttctttttgataaactcaacactcctccttcattaacaaacacgtgaaatataaacagtgtatacttcctttactagtatgtatgtttgtgtttttacatttattcctaaagccagcattatttttttaatagtcaaacattggaatatttccatcaattcaggaataagaaaaaaatatctattttctttacgatatttaacattgttatagaagtactggccaaataaatttcaacgtagaattaaataaaaggcacaaatattggaaaataagatttaaacagttttatttgccagaaatatgattttatacacattgaatccaagagcatcaaatagccatcagaactaaatgagaattagttatttaattggttaaagattaacatgtttaaatccacaggtttcctttctgaaaattataataatttagaaaatattatgaatagttatgacatttgcattgctaaacatatacctcaggataaagtgaacaaaaatttcaatacccatatcaggaaaaatttaaaactctactgaagtgtaccaaaggcatcttgaggaaattgagaggcatgcttttcttaggcagaaagagcaatatgattacgtcaattatttataaagcagtcacggctgggcgcggtggctcatgcctgtaatcccagcactttgggaggccgaggcgggtggatgatctgaggttgagaccagcctggccaacatggcgaaaccccgtctctactgaaaatccaaaaatttagccgggcttggcggcaggcgcctgtaatccctgctacttgggaagctgaggcaggagaatcgcttgaacctgagaggcggaggctgtagtgagctgagatctgccactgcactccagcctgggcgacaaaagccaaactccagatcaaaaaaatcaatcaatcaatcaataaaattaaaaaaataaagcagtcacacacacacacacaaatgtaaaatgtactttgaaagaaatctggtaatgaatgtgggaatgaagaggatattgtagccctgtttttaaaatatatgaaatgaaacttcacaatattaatgtttggtactagaaaacaagtcaggtttatggtataacccaaaattataagactgtctagcacataagtgtgatagagtttcatagcagtggaaaaagtagacactgtttaacaaacttttgttaggaactactttgctgcttaatataaggacgtattcctaatacccttcttgtaggtattttaaacaaaacatatgagtgaacctaacattaaaatagagttttcgtatcataatttaatagccagaaggcaaaaagtaaaaaaacaacaaaaaagactgatgatagatactattataaatattgctagtaggattgtaaataaccttctgtaaagaaaatgtaacactctctgtcataacttaaatgtgcatatactttgacccagaagttccgcttcagggaatttttctcattcatatcctaatgtgaatgaaaaggttgtgaacaaggttttacactgaaataacataactgaacataagtaatgaaattatttattataaagttgtataatgagattaaatattacactgtcatcaaaaataatgaaatagaactctgggtacagaaaaacagagagtattttttaataagtgaaacaaggcaagttgtcggagtatatgatagagatgctatatatattaatatgaatacagattacgaatatgcctatgagtgattgtttatgaatattcatgaaatatacactccatattgatagcaaatgccatcttggcagcatttcattcatttagttattctctaacactctatggatttaaagcttcatatcttcatttttatacttcatttttatatgatgtatgattttatgtcaacccaaactcatgctttaaaataattgccttgattgtatgtacatatttattcttccaattaactttataattagcttgtgaagtatcacagaaattatgttgggagagccgggagcagtggctcatgtctgtaatctcagtactttcagaggctgaggctggcggatcacctgaggtccggagttcaagactaggttggccagcatggtgaaaccctgtctctactaaaaataaaaaaaattagccaggcgtattggcatgggcctgtgatcccagctacttgggaagctgaggcgggagaatcgcttgaacctgggaggcggaggttgcagtgagccgagatcgagccactgcactgcactccagcctgggtgacagagggagactctgtctcaaaaaaaaaaaaagaaaagaaaagaaaagaaattatgttgggaatttgaaaggtattattttggagatatagcgtgacttaaaggaaattgatatctgtatagagctgaatctttcatcctcacaatagcgtagctgtagagttcaaagtttttctgtgtttttataaatctttgtagattgtcttcagaataatcttgcaccactttttgtcatgatattcctaaacacattagtttcttttgttattatgacatgtaataattttctactgcaagttttaattggttactgctcttctatataaacataatggaattttattgttgatcatgtatgtagtaatcttgttgaattttattactttatttcttgaatttgcttattttctttacttagagttgaagaaataaatcatacattttattttgttcaatttttgtctcttttggtcttagggctttggttaaaaaaaataccctgtaaaatcaattggttagtcatctatctaattttttgctctaacattcatataggacaatagttacctttatcttgaaaatgtttataaagatatttcaacttttgatcatttgtatgtgtgtgtgtgaatgttgagtagtatataactttgaatgatattttaaatgtttttgatgatttttagtattaagtccctagaagtttgtccactttatctaggttttcaatttaaacggtacaattatactggtattgcactcctataatttttgttctttaatctaccaatgtttaattacttttttctttttaatcactcctggtgtctttttatttctctctttgattaaattacaaattttctaagttgttattcttttcaaataaccacttataattttctccataattttctgctcttttgaaaaattatttctaactttgtttcccttgattcaggaaacatttcttaatttgagcttttagttctctaatttatttttttaactctatataatctgctcttcatctagttgttttgttttcaattcaacaattaaattcttaatttattatatctctaatttgttttattttattgtcctcagtttttgtttcatagcatcttgtttttacttaacagtgctgattcctttcattgcttcatataatcaatttaaagtgcttttctgttttactagtaactaccttttttctatgtaagatctccttattgttgtggttctgtcatattggtctttctcagatgctctttctctcaatttctacgaacccgatctggcctgtctttgggaagctgcatctgtttcttctgtggctatagtggagtgacctgcagtggttggactattcagtgttcccccgtgggactgtgcagccttttgaaatagccttgtctatggcaagcacttggcttacccatgcaatatcacttgtcaggcatgccttacagcttcagtccactgtgaattcctcttcctcttcaggagcttgcctgtatatcacttagcttaatgtttatctgggctttttcaggttacatgcaggtgagggagatttcagcatgagttcactatctggtaagatgaatttaccatatcacttttgtaataaaaatattttaagcttaaaatatctacacagtgcctggaatatattaatttccttgtaaatgtctgttgaactgaaataaatattatagtttcaaataattaaatttgataagcatagaatttgatgcttgatccaatttatctttttcaaaatcaaacaatcctttactactgtcaatttccagacaatacacactcttataataatataatgccatttagtttactgaatgacagagtatgccagagtacagcttcctagccataaaatctggatctatcacatgctcttttcatagaaattctaatatttttctattatcagtttcacaattcatctattttttacacgaaaaaacatataacattttagtgtgtcttttttcattgactatcctcaaatcataatcatatattgcaaattaaaaattggcctttacttgacagaggggagaaatattttctttgctcataccttttatggtatgacctaaaaagttatagatgtccatgctcggaaactcactcttacttgacaactttttccaatgattacactttacttccctcttgctccataagttccacaataacctttgctcaaaagtaatggaatgtaacctgaagatataaagaagtttgcttttgagataaactctgaagttagctttctacaaaagtaggcacaccttaaagcatctgaacaattcagtattatcatatattgggctgtctcaaagaaagggagattttcatattcttctcatatatagaatgttatctcccaaagtttgaaccatagagagaccatatgctaagaaaaatgtcaatcccttttaagaaccttgtagaaatgctttatagacctggcaaagtactttgaactctcaagctagttgtattatttttcttctatttatacgtatttatttatttatttatttatttatttatttatttattcattcatttattgagatgcagttttgctctgttgcctaggttggagtgcagtggtgcgatcttggcccactgcaacctctgccttctgggttcaagcgattctcctgcctcagcttcccaaatagctgggattacaaacatgtgccaccacgcgtggctaatttttgtatttttagtagaaacagggtttcactatgttagccaggctggtttcgaactcctgacctcagatgatccacccgcctcggactcccaaagtggtgagattacagccctgagccaccacacccagccagttgtattcttcatacttcagggctcaggtttcctctaaatgctctgtgttccctaaaatacttgccacaacctcatggccaatgtgtccatagaatgattttgtatgatacaataccttcctaaaagtacacgttacttaaaaacaacatagagcagctcagggcaatagagtaataacgcagttaaatgttaacattatctgttattttgattcatttttatgccagataaaccacatcagagagatgttgcttcaattttagatttgcaactattttcctttcctctgttcccatagtttatgtggaaaatttattgatttcagattactttccctaccactgacaagcttaattctttaaatttaatttaatttttcatttccatagtttttagtgtacaggtggtttttcggttacatagataagttctttagtggcgatttctgggattttggtgcaacatatcatctgagcattgtacactgtacccaatgtgtagtcttttattcctcaaccccctcctacccttcccctccaagtctccaaagtccactatatcattcttatggctttgtatcctcacagattagcttcctcttataagtgagaacatatatgatatttgcttttccattcctcagttacttcacttagaataatgtcctccagctccatccaggttgctgcaaaaaacattattttgttcctttctatgactaagtagtactccatgggctatatatatatatatatatatatatacacacacacacacacacacacacgcacacatatatatacatacacacacacacacacacacacacacacacatatatctatctcacattttattccactcgctagttaatgggcacttaggttggttccatatttttccaactgtgaatcatgctgctataaacgtgtgtgtgtgtatctttttcatataatgatttttttaatccttaggcagatacccagcagtgggattgctggattgaatggtagtactactgttagttatagaaggtactccatactgttttccacagtggttgtagtagtttacattctcaccagcagtataaaagtgttcccttttcaccacatccacaccaacatctattattttttgactttttaattatggctattcttgcaggagtaaggtagtatctcattgtggttttaatttgtatttctctgataattagtgatactgagcattttttcatgtgtttgttggctattgtatatcctcttttgagaattgtctattcatgtcctttgcccactctttcatgggattacttgtctttttcttgctgatctgtttgagttcctgtagattctggatattaatcctttgttagatgcagtttgtgaatattttctcccactctgtaggttttctgtttaccctgctgattatttcttttgctgcactgaagctttccagtttaattagttcccatttatttatttttatttttattgcatttgcttttgggttattgttcatgaattctttgcctaagccaatgtctagaagagtttttctgatgttatcgtctagaatatttatggttttgggtcttagatttgagtctttgatccagctgtagctgatttttatattagttaagagatgagaatccagtttcattcttctacatgtggcttgcctgtttcccagccccatttgttgaacaggatatccttttcccgacttatgtttttgcaggctttgtcaaagatcagtgggctgtaagtatttggatttttttaattgattctctgttctgttccattggccttcatgcctatttctataccagtaccatgctgttttggtaactatagccttgtagtgtgaagtcagttaatttaatgcctccaaatttgttctttttgcttagaattgctttagttatgcaggctgtcaatatccctgatgaacatggatacaaaaatcctcaacaaaatactagctaactgaatccaacagcatatcaaaaggataatacatcattattaagtgggtttcataccaggaatgcagggatggtttagcatatacaagtcaataattgtgtttatgtgacatatcacataaacaaaattataaacaaaaatcattatcatctcaatagaagcagaaaaataacttgataaaatccagcatctttttatgataaagaccctcaacaaaataggaatagaagggacattcctgaaagtaataaaagccatctgtgacaaacccacagccaagataatactgaatgggggaaagttgaaagcatttcccttagaactggaataagacaaggatgcccactttcaccacttctattcaacatagtactggaagtcctggcgagagcaatcagacaagagagagaaataaagggcatccacattggaaaagaggaaatgaaactgtcactgttcaccaatgatatgattgtatacctagaaaactcaaaagattcatccgaaaagctcctagatctgataaacaaattcagtaaagtctcagggtacaaaaccaatgcacacaaacaagtagcactgctttataccaacagtgacaaagctgagtatcaaatcgagaaatctatccattttacaaaggctgcaaaaacaaacaaacaaacaaacttagtaccatacttagccaaggatgtaaaaaatctgtacaagaaaacctatgaaacatggctgaaagaaatcacagatgccacaaatatagaggggtagaatcaatattgtgaaaatgaccagaaaataacttcctttagcatttcttacaggacaagtctagtactgatgaacatccttagcttttgttttgtggtaagttttttatatctcctattttttttttaagaatgattttgtcaggtataatattcttggttggaggttttttcttttagcactttgaatataccatcacactcctttctggcctgcaaggtttctgcttagaaatccactgactttacaccctgcttttccaggaaacattagtataaatctgtctagttattcatattaaattttctaaaaatataaaatgatattttttctcaacatttataattttagcattaactaacattcaccactaagtactgtatttggccttgagagttgagttaaatattttgttgggcaagaatcagaggtgaggtataaaacacattgttgtgctaaaaggaccatgcagattatccaacaaagtttttcattgctaaaatattacatcataacctgtataaatgatccatgataataatactaatattttacatttattacacatttgccaggttctatgccaaatgtttatgttattattttactaatacttggggcaatcctataaagtaagtactattgttatcccattttatagatgataaaactgtggcttatagaggctatcaggatctgtctgaaaacaaataagaagttgctgaagagaggtgaaggaaggtgttaaaggaaccaacaaggtacaagactaggaacagtaaaaagttatcatacctctaggcttgagtgacaaggagaaacaagattatctgaaatcagttaagagccgaaatggtgtaaaaagcaatatgtttctgaaagtacagttaccatcaaacaagaaccctaggtttcagattcccaggcaacttatcttttcactacagcccaagggcagagcttcaagaagtatccagtttagttatggtcattttctctgggtttagcaccttgcttttcccgcagaaaagtagggtctgaagcactaactgcaataggagtatagcagttaagcactgggttccggtgagcgtcacttgcttatgaaaatcagatacaccatctcaaaggctgttcattcttagaggcccttggagaggagcaggaatgcaaatcaaagaaaagcatgatagcttgaaatgagaagcagaaatagcctggtaaacattccacagtggaatgtttataagaaccatcttataagaaccatcaatacgtgtcttctaacaaattgacttgatacactttattgcgctctacacaatgctgaacacttctgaaaccttttctagagcctgtatttctagaggctatgttttctagagttgtgggccaacatgcctatgtcaagaggaagggaagtaaaaaatgtgaggttctgaaaagcctgtttattagttaaagaaatagagatctttatccaagaagagaaaaaaaaaatcagtggagtcaagtagtataaaaaaatccataattgccatgggaaaaactggggcttaaatgagaaaaaataaataaattaaaaaacgacttagttttatgttaaaaaacatggctctaattataattcaaaatgctaaattctgtctaaaaacaaaatggattgtcttgcaaggtgatgaattcctcatcccaggaagtatttcagcaggatgtcatgaaagggcttcctatattcaaatatcttacaagattatctcaaaaatacttttgaagtacatgtaagattctgggcaatgtcacaaaagtataatctttagaacgttgcaggcctctgtatgatctcttatcttgcaaggaaacatttgcctagacagttcagctggctgaaaatgagtttctaaaagtttccagaaaagaaattttaaaaatatgctttcttctaaattatattgttatgaattctaagtaaataccaaaaaacttcaataggactttgccaaaatttatattgcttttattgttctattttcatttgattagctctctgcagtgtacatcaaccctttagccagaatgcagagacaatgagaaatttaacatttttctcccattaacattctatcattagggctgagcaagttaaatttccactggttcagtgtgctctgcataagatagcagaaatcttccacattgagggagttcttcagggtacaggatatcatatcactaatgtattatctgctgaatgtagtcttcattttggagtataatgagagaataaacgattgtctgggcttggagtagatgacacatatgggattttgcttgaacaaaaggaattacaatcacctaatggttggaaggagttctaaatatctacagatcagatatttcttctaagatgaaattgctacttacagttaaccagataatttctcagtttgaattgtgggtcattgagggtcaagggcagcagccgtacagccacagataatagctaagtcttgctaaatatcagcaccctctgaaatcctactaaaacgtgtccaatgggaaataagttattttctgccgttctgattagcagtcatctctttttcccatgtgttcttggggaaaaaatttattttctgcctttctgattagcagtcatctctttttcccatgtgttctttaagtgtccagaaactctagggtctctttccccttctcctgttaaaatctttctaaagaagaaagctgagagactcatacaactcatagtgatctcaggtacatttgtattttaaaagcacttaattttattttgttgctcttaaaacttgtatttaccttatcttagctactgtatcaccataggaatagttcaataagacaaatgatgctattattttagtgatgtatacactacaataagataaatacaaacttgagttgtacatgctataacctagcacatctgcaaacatatatacacgcatatacacattcagtcaaaaagagaatccagaaagcactcattttactttattttaacccacagaatacaaacctaaatgactaagactacaaaaggccatttaaggtgctggtcagaaggccccacaggacagtagctatgtaactagaatattcttaaccccacttgtgcctttgcatcagctgaagtatttcccaggttaacaaaatacagaatattagtgtttgaggcaatcatagcaaatttgttcaagtctctcaacctggagataaaaatgcaaaacaaaataaaacacaacaacagcaacaaaaccctgagactcaaaaagatgtaggaattgattgtcacaaaacaactgtccagtgtcaaaatcaaaatgaaaactcagatttttcctacttgtagtcttcaaaatatttatataccccttcattcattctttgatattctgcatttttatgtaatatcttgaagttatgtggatattctttttatgtgagaaatttaagtgaagatgtgatttttaaagtagaattatggtaatattatatataaaaatgtattttttaaggaaaatattttgatgagtgcatacgtgtgtgtgtgtgtgtgtgtgtgtgtgtgtgtgtgttggcaggagcaagaaattaatgtttcagagtaaagatgtgtttttatgctattaagtacaactcaagtgtgtatttatcatatcataatgtataaatcactaaaataagtgactacctttgttttattgtcttttgtcttattgagctatgcctatggtaatacaataactaagataaggtaaacacaagttttaataggacttgctataatctagcatatttgcatatgtatagccacacatatatatatattttcaatcaaagagagaatccaaaaagcaactatgtaaacataatttaaccagaatatgaaatcattctcaaaaattagatatttttccaatatttcaaccacatttaacaactttgtaaaatattgaaaatactgacttagtagaaaaactttcttccatcaattctatatattcatcaaaatacaacactgtcattctccaaaattttatcagtacttctataattcatgtcagtgacaacttgtcattaaaagctgtttttaataaactatcaaaagcactacaaggggagagggggttgtaaagaaataaaaataaaaaagcttaaaattgagttgatgcaaaattagattatccccctaaaaaatataatgcaaatcatcattgataacttgattataggcaggaagtacattatagtctttgcatctcaaaatcagaagctgtcaaatgatgcttgtgggttgatattattttgaagttatattgtgattattagacacattctcaaatatttgtttgtaatttatctttatttgcaaaataataaccaggcatgaaagttgaaatttaaaaagtgtccagaaaatgaaaatagaggaaagcattaaagctgctgcctatgattaatttctttctcatttctctgggaaagaaaaaaaaaaagcagatgactcagattaatttccttataaatttgatggtaattggacttcctgatatatagactatttgtgtttgctaagagaagagcctttatctatagaaaggttttattaagagaatcctggattaagattgcttatagtaaacaaatatagaacctgtggattcagcaggcatgactccatggaaaatgtctgatatggtttggctctgtattcccacccaaatctcatcttgtagctcatcttgtaatccccatgtgttgtggagggacccagtggcagatgattgaatcatgagggcgggtctttcctgtgttgttctggtgatagtgaatgggtctcacgagatctgatggttttaaaaacaggagcttctctgtataagctctctctttgcctgctgccatccatgtaagatgtaacttgctcctccttgccttctgctataattgtgaggcctcccaagccatgtgaaactgtaaatccaataaacctccttcttttgtaaattagccagtctcaggtttgtctttatcagtggtgagaaaacaaactaatacaatcaattggtactagaagtggagtgcctttgataagatacctgaaaatatagaaacgactttggaactgagtaacaagcagaggttggaagagtttggaggtctcagaagaagacaagaaaatgtgggactgtttggaacatcctagagacttgctgaatggctttgcccaaaatgcagattagcaaaatggacaataaagtccaggctgagttggtctcagatggaaatgagaaacttgatgggaactgaagcaaaggtgactcttgttatgttttagcaaagagactggtgacattttgcccctgccctagagatttgtggaactttgaacttgagagagatgatttagggtatctggtggaagaaatttctaagcagcaaagcattcaagagatgacttgggtgctattaaaggcattgagtttcaaaagaaaaacagaacataaaagtttggaaaatttgcagcctgacaatgcaatagaaaagcaaatcccattttctgaggcaaaaatccaagcctgcttcagaaatttgcataagtaacaagaagtggaatgttaatccccaagacaatggggaatatgtctccagggcatgtcagggacctttgaggcagctcctcgtatcacaggcccagaggcctaggaggaaaaagtgtttttgtgggccatgcccagggtccctatgatgtgtgcagcctagggacttggtgctctgtgtcccagcctctccagccagtagctgaaaggggccaatgtagagctcaggtcatggcttcaaagggtgcaagcctcaagccttggaggcttccacatggtcttgagcctgcaagtgcacagaagtcaagaattaaggtttgggaacctctgacaagatttcagaggatatatggaaacacctggatgcctgggcagcagtttgctgtaggagcaggctcctcatggagactctctgctaggtcagtgcagaagggaaatgtgaagtggcagccaccacagagtccctactggggcaccgcctagtgaagctgtgagaagagggccaccattctccagatcccagaatggtagatctactgacagcttacaccatgcacctggaaaagccgcagacactcaatgccagcccaagaaagtagctgggagggaggctgtgcactgcaaagccacaggggtagagctgcgcaagactatgggaacccacttcatgcatcagtgtgacctggatatgagacctggagtcaaaggagatcattttggacctttaagatttgacagccccactggattatggacttgcatagggcttgtagcccctttgttttgcccaatttctcccacttggaatggctgtatttacccaatgcctgtaccctcattgtatctaggaagtaactaacttgcttttaattttataggctcatatgtggaagggaattgccttgtctctaatgagactttggactgtggacttttgagttaatgctgaaatgagttgatactttgggggactgtgggtatgacatgattggttttgaaatatgaggatatgagatttgggagaggctgggcagaattatttggtttgactctatgtcctcacccaaatctcatcttgtagctcccataatccccatgtgttgtgggatggacacagtgggagatgattgaatcatgagtgcaggtgtttctcgtgctgttcttgtgatagtgaatgggtctcacaagatctgatggtttttaaattgggagtttctctgtacaagctctctctttgcctgctaccatccatgtaagatgtgacttgctcctccttgccttccaccatgattgtgaggccttccaagctatgtggaactataagtccaataaacctctttcttttgtaaattggccagtcttgggtatgtttttatcagcagcatgaaaatggactaatacaatgtcatataagctgtgtagctatctaactataaaatgaatatgtcttataacttaaacactccttactccatgagttagctcacatagttcaatagagactaaatgtaatattctggcccagagtataggcctgatatgacaaagatttgggaggctatccttgatgtctcaaacctccctttgctttgcttgtgtgtcttgatagaatgtatccttgaattatgtagcaaatcaaaattctgacattaccttaccttattcatgtgaatctgatttgataatatgatctttgtgattgcttgatcatctgtttatatcctgcctcttagaacattgtcagtatcaaatgttctcccaaactcagtcttatcaccacaattttcttgacaaatatcatggcaccacaagacgtcccaaattcccacatcattcccttccagattctcttcccaatagggctccagtattaccttatctgcttttattccatacccctcctgagatttctaatgcttctactgtgcccttagtactcggaggatataatcagcataatgctatgtttctctgacattttttttttctgaatgattttcacagtaactttttttaactgtaacctgattttcttctgaggcactacccactgaaaaaaaaattttcacatggaagctgttttatctttcacatattctgtctcactgagcccaaagatagatgtctatcttgcttctcatttcttttcatctcattttatctctatcatcccgtaactctcacactgactacccactttggcacaatttcctacaaaactttgacaattcattccttggtgactttagctgtcactcattataatgtgatgatttgtcacagttagctgttcctagcagacatacattgctatgaatagttttatttattcatctggaaaaattgtaagtgtcatgagatccaaagaataaccacttctttagaatccaaaccctctaacatcaaagatacttgcacccttttctccaaatcttttccacatttttagaaaatatttccaataacttggtcttccagttccttgtcctcctgttctccaatggccttgacttctggtctatctcagccactcattcctatctttataccataacatttaatgcctattttttttagaactctgaagtgtctattattatttataaatcttttatatagatatagacacagaaaaaaacacaaatctatagatacagacataaatagaatttgaggaaacttcttgaggacctcctctctcattggccaccaacaaaattaggcatttctaacagagattggcaatgtttatatagccttttgtagataacaaggtgattcttcagacattcccatacaattgatacaaaatgatttctcctctgctgatttttatttccatatgcaatggcattcattttaagaaatgttttttgaagattcaatactaacccttgattttttagcataactttggtacctgataataacttttaaattatccacttattattttttgtacctgccacgtattaaacgtgtatctgaaggagacagagaccagtgatgtgtttaaaatagcagagacactgaagaagtgattatgtgatctaaatagacagggattgagaagcagaaggatgatcaggggaaataactaatatttattgtttattaaagtagaatttaccttcatcagaatgtacaggtattaactgtttatctcaaggagttttacaatcatatacacccatgtggccactacccaaagcaagatatagaacattttcatgatttaagagagggttctcattcttatttttagttcatccttcacagaaaattcccttcctgacttgtatcatcactgctccttttgcctttgtttggactacatagggatggagttcatatcttttcacgcaaaagatattgagagaaattctaatcttataaggggaaatatgaatacttattatttaaaaaataagcaggaagataaattctcaaccagtaagaattacgtttaaaatagaaagaagctgtgtgtttacaagtaaagcatgtataatagatgacaatttctctttctcacacacacaaacacacacacacaaactcacgtaaatacacaatattataaagacaatggaaatgaatagagccttaaactgtagtaaaagttggatgggctatggttgaagaaaggaagctcagacagcaatcagggaatttcagggaaacataatcatcagtgatttgtaaagattaggctgtagagaaagcctgagaagctatttttaaaataagccttataacatcactaatcagcagtagtgactggccaaaatatcagcatcgcactgtagtttctcacctaaatgttgatttcacattgattcaaaaggttttgtttttaaagagaaaatattactgcactccattctgacgtggtttgctagtatatggatcaggaaaagaatgcatacattaagaacagtaaaataccctctattgaatcacattattatatttatccttgattgtaactattttatcccctgcagtatacccattagaaacaaaatgggtgtcctaaacacatactgtcctcttcactgtgggttaatgccctatattagtcttaaggtttttgcataatatgatagcacaacaaccaatcgaatgtgtacttttctagaatatgtgcagtttatttcctaattatatccgttgctattcccggtctcacctgcagtccctggacctttttgaaacaagtgaaggacattattgttggttatagcacctgaaataagtgattcccgcagattggtcttcctctttcagtaagagagatctcttttaaaaagagatatcaaagcaaagcctaatgggacatttttcgttgtcctaactctgcttggcatatccagtgttagacatttcccaagaaattgaactgatgccactctgactctcctggaatcagtgctcaaaaaagcaaccaaccagcaagttcttgtaaagcacgcttcagtccgcatcactcctcagttcataaccttttagtgggtaaaaacaaggtccttttcttattaaattgcttctattaatgttgatttcttattaatttgtatgttatttttatgtattttgaatactaattctccttcaataaaaaacattttaaaatatattctccaagtttgtggcttacggtattttcaaatcattttaatgtagtcaagttggtgaatgatctgttttagagtttgatattttgtaggtctaattttttagttctttctctattctaatatttaagtatatattctatatttgtttccttacactttgaagttttgtcattcatatttaagtctttaattcaattgcattttttaaagtgttatataaaatcaaaaacggatgccaccttttatattgttaaaattgtctcagaaccatttattaaatagtcatttccccactgatgcccattgttaatacatcagagtctcttgtcatttatcatttctattagcttttgactccactgccaccttcccaatgaggactttacttattttcctataattatactctacccttcacacaatcacagataagctttctatgtacctttcttggataatttttctctgtagcaattatcactactgatgtattatatgttttagttattcatctcattgatttattttccctcagctataccacatctccataagaatagagttttatttgctctattgttgctgtatcactaaactttcaaacaaaattagaatacaataagtgctaaaaacatattaactcatgaaatttatagtctgtatgttttttgccattcctatacaaaatgtcttaattattattttacaatgtgtcaatattttgtatctcaatctattcacctggtcttcttcactgagagtatcttggaactgggttaaatttacttgcacagctataaaaaataccctatttagggggatgttaaatcagcataccaatttgggagaaactgaaaattttttacattgagacttcttttccacaaatattgtttatctctttagttgtgtaggtcttatttaattgcctttaagaatatttgtaattttgtatatacaattcttgcatacattttgctagtgtgtttcttaagttcattttgtatttgttgctgttgtaaatgataatttttatttatttatttatttttgagatggagtttcactcttgttgcccaggctggagtgaaatggcgcgatctctgctcacagcaacctctgcctccccggttcaagcgattctcttgcctcagcctcccaagtagctgggattacaggcatgcgccaccacgtccagctaattttgtgtttttagtagagacggggtttctccatgttggtcaggctggtctcaaactcccaacctcaggtgatccgcctgcctctgccccccaaaatgctggggcctaaatttttttatagaggttaaattaggtttttaaaatacagactgaaaaatgagttttattttctatttcaaacacagatgtactttgtctcttcttgtgtattcttttgtcttaatatgatggtgaatacctctaataagttgttgaatgaaaaccataagtcagttttatctttctccttattttaacaatagcatttacaaattcaccactgaagttatatttgttgtaggagttttcctgggggtattctttttcagattaaaattttttatttgacttatttacttcatatttttattaaaaaagaatattttaaaactctattaatgtgttatttagactgttattgtgacttccatttttatgttctgtagacagcattataatgctagaataagacttaagtcataatattgtagtatacttttgtatattacttgttaatctttaaataatttttatgtatattcttacatatatattatgtatgtataataaaaacagtctttattagtcttttctcatttggctttgagtttggtgttaaagataaaaatatcccataaaataaattaggaggggtttttgtttattttttcctggaatagcttatgtatattttgacatatgtattacattatgttactatatattgaactcactctaaaaaccatctcagtctgaaattttcccctacagaagaattaccaattgctgtttcaattttgttaataattttaggactatttagtctttttgtttctcctgattcaattttggttaatgtggtttcaggaattgttcattatttctaatttttaaaaggatatatgttttttcttttaatcatctatgggaacattgtatatattgcattttacttttagctttttattatgtaaaaataagacatccacaaacgtagataaaatactgtcacaaactcccatgtatacacatctatcagtttatgtgcattgcatcaataaataaataattctacagaaattaaagttaattaactagaacaacttatatgaatagctatgattctcgaaagagttgtataacagatgcaaattcccagatgtgtatgatagaacatcatttaagtttagatgtaataatttatagctaatatttaagaaaatatatcacaaaaatattgctataggctagttttaatactactgctcaattctgcgataatttcactgttatcccttccaaaactgttcttatgttttattatgtcctcacagtctgcagcaacttgtatggcattttagttctgatgtcttccttttcaaattgctggcagagggcacctagtttctggttttagggttcacacagggcattatctcccaaaaagttcaatccaatgtcttttcagtactaggagggatttaaaccttagagttcaaattccctctagaaataaaaagaagggatttaacatttagagtttgatatgagatggaatgacaaggcatggcgttgcgaataatttgggcggagctataattctacttcactgtttatgaatagaaaacactattttagatgactgaccaatttttttaaaaaccatacctattattttcttctcctcgcaacatcatgttagggtaagagtggtgctggtttttttttgtcttttttttctctcctttctaagatttgttctttgttaaaagagacagaaatgccatgcttcagtattattcagaggcaatatatattatatattccatagtttggaatttatcaatatttagttgcatctaatatttccttgaagcaagttggaattttccacttagcaatttttatgtaagattcagatcataagtgcacatactggaacatgagttaaagatgggatgaggaaggatgagattgttgttatcctagaaactagttgatagcgtttgcctgtgtccacacccaaatctcatcttgaattataacccctacaatttccatgtgttatcagagggccaggtgggaggtgattgaattatgggggcaggtctttcctgcactgttctctggatagtgaatgagtctcacgagatctgacgactttaaaatgggagtttccctacacaagctctcatttattgcctgccgccatccacataagatgtgacttgctcctccttgccttctgccatgattgtgaggcttccccagccatgtggatccgtaagttcaattaaacgtctctcttttgtaaattgcctagtcttgggtatgtctttatcagcagcatgaaaatggaatattacactaataatagttaagtaaagaatttagaatttgaaagttaagtaagtaatttagacgttaccatattgggaagtaaaatggaaacattaacttcactttacaattgtttttttcaactatatggcatgttagatacaagacaaaaaaaaaaacgagaaagcaaacactaggacccatctaacaccaactaattcagaatcgctgagggctgggctcaggtgttggtaattttaaaattatctcctaagttacaaggagtgagtgttgaaatactcaccagaaaagtatttaaaatcaaatgttaataagcaacactattagatggtaattaacatattaaatgtgcaggctttaattatatatgtgtgtgtgtgtatataatatatatttggatttagaccctctatatttcatagctaattaaaataattattatgttccaatatttacttcctataatgggtctttaaatgtattcagaaataaccaaactatcattttagtttttaattgtttaaaattggggaaaaaaatctttgagactaaaggatatgcaattaaactcactagccagtgtacaatttccatggaaaataaaactaaatgttctgaacatcacaatattcatcaaggaggaaaaaaaagccctttgctatgggcttttgtatggttaaatttttagaatatttataaaaataatccatataaaaaagacattatttaaaatatagcaagaaaggaagatgctctggaaaataggatctgtatcatttcagttaataaaacaaaatatgatgactcaagagacataaaggaaaacaatatgaagatgacttttgagcatcaggtttagagaatatgtttatgtaagaactccatttcaaaagacaactctttttctttaggaaaatttatagacggtctttttgaatgtcaaatgtgacagatgcccatcctcatagctagaatgaaggataaagagatagttgagttacaatgattaaagttggggaatttttagcttcttgggacaacccggtagactcatgggggaaaaaaaagcctcaacaacatggtagatcgccagcaacagtctgagaagggaagaaggactcttgtaggatttgatttgcctttgaagagaggcaagggaataactacgtaggagtgggaagagggtatcaggccaagaaggagccagggttttataaacccacagtttggagtcttgatccatttcattttattttaaattttaaaaagagtgtgaccccatgtgtatgaattacacacacctaacaagcccttctagatagtccaaaaataaacttcatgaataccaaaactataaatccaggattctcaaattagggcacttaagaatagactccagtgtggtgtgagaagagatggagttagaagaaggataaatagtcttaaaatagggtacacagactatgggttacactaaaacttttcaaagaacaacatagccataaatattaagataattaatcagtggattctaatttccatttttactccttcctaaaagatatagctacagtccaggtctcttgttcattttccatttccctttctcttttcaaaattactcttctctcactttacaaaagaaaggcacatttgtccagcctgccagaactttttagcactcttcaagttttcagtgttgctcagcagtggagtgcacaaaattctcgggaacaaagggacaattctaattattagtgttgaggggcctccttcaatcaagacaacaaaaacctttagtgtgttttgtatctttctatgctttttacatatttttgttcaggacaatggatggtattagcgataggatattttggcctgtgtaagtgcgataccatggagtttgtccccgcaaacttcatgttaaactttggtcctcaatgttgaaggtgggacctaatgggaggtgtttcggctcatggggacagccattccctcatgaacggcttggtgccatccttgcagtaatgagttctctttttattagttcccaagaaagttgatttttaaaaagaatctgccacctccccccgcttcttacatcctctctcatgtgaactctgcacatcccagctctccctttcctgctaccacaagtggaagcagcctgcagccttcatcagaagcagatgctggtgccgtgcttcttgtacagcccgcaaagctgtaggcctagtaaatcccttctctataaattactcaacctcagttattcctttatagaaacgctaaatagactaagacagttggataatctgaattcatgaatattgtagagcatggtggtagaattaaggaaaaattccctttaatgtctttccctctactcttcaataactattgtcaaatagtacattattcctgaagaacagttatttgagaattttggcaaaagtttttttttaatgctatgaatccatctccttctaaaaatattacttacaaaatttctgaaatctacgaaaaagctattaatttttaattataaaacattaatattagtaaaagtgtaagtaaagctagaaatctcatttagccaccaacattatcttgggagccttttaaattagcttttcccagtgtgaaagctaggacttagtgtaggaaaaattataatatctgttgcactattgatagtttaaaaatattagatgcaaagtctatcatggaaattaaattggtatcctgtgaatacagaactatactttacagatatcagaaaacaggagagaacattgttcaatacattttgtcaaaacttgctgtaaataaagagtacaatttgagtgatgaggtccagggatgtttccaatctctatctattaaaattggatattcatatgtattttaaagaaaatcttcattaatgactatgtgtgatgtgcaattcttgtcaaataatattatcctataaacatatgtccagaacactatcactgttgtttgagtagattctggctggatgggcagtgatcaggcacaagaatggtttactgttcatccttccactttaaaaattaccttatttgaggaatgctatttttaaaataatctctttaaattatgtgtcaactgtatacattggtcagtattgaaaaaacagaaattcaaatatcttaaaatagtagattatagcaatgtaagaatctgagtagatatgaagaaatgtatgtgctgatgttttaaattaggcattcatgaggagctagtaaagtacaacagaaatagtcaatctggaaattgtggaatgtagttggaagctttagtaagacatgagttttacatttatgaagagtaaagtaagtatagcctgggtgtggtggctcatgcctttaatcccagcactttgggaggccaaggtgggtggatcacttgaagtcaggggtttgagaccagcctcgccaacatggtgaaatgctttctctactaatgcaaaaatatgccgggcatggtggtgcacacctgtaatcccagctactcaggacactgaggcaggagaatcacttgaacctcagaggtggagattgcagtgaactgagatcacaccactgcactccagcccaggacagaacaagactctctaaaaaaaaaaaaaaaaaaaaaaaagtaagtaagtcagtatagaaaatacatacaaatttattgacttatttttctgggctgaacattcccaatcaaaaggcaaaacaaagtaaatatgtgtaatgtccatgtcaaaattagagccttaaaaatacattgaaagttgaatgaggaaatttgatcacagcaacaatgaacaagtgtcttcagtcattgatatttgataagattataggtctataatctcattattaattccagagtccaaaaacttctgaaaaaccaaaacagttttataacttatttggaaacaagacctgatataaacagatgtgtggctatttacagcttttatcttactttatcaaacttagtatgatatattgttatatgtttccttacagagatagttattagtttgagtacagggcacttccctagaccctactgagaatttatataatttatggtgtatgtactctactaacattgtaatgtctgaaaattatgaatatcaaaacatatgtgtcagcaaagaatttataaaggaaactgttgacctgctcagaatattgatgtaaaataaactacaggaatcagtagtcatttttctacactgaaaagacctttgactcaggtttccctgagttggtgaaagaacccaattggcagatgaaggcacacttcagccatcatagggagtagttcatctgaactcaccaaaagagtgtacctaaataagcagttaacaacagaaatctggaaaatactgcttttccattcttaatggcactttggagctccaaaatactggaaaatactattgctgtatgaaaccagaaatatatgtaaattcagccctcaaaatattgtgacaacaaagtgaagaaaatacattacctgaaacatgaatatgatatattcattcattcaattagcaactattacaaaatgcttaaagtgtgtctggcactgcttcaggtgctgaaaatgcagtggtgacatggacatttgccttaatttttttactatgcggcatgttctgaagagcttccttatgtttaggagatggatttcctaggtcagagctgctcttctcaaattagaagtctgcaacttgctcttctagacgctcttcatctagggctcgtgtatgtcacttacaatttgctaaacagatgaactcacccaagacttttgtccagaaggaacaactagaggaagaaaacactgaaagggacatttttctaaatgttttagctgtggagtcattgccagtagctgagaagttggagttcccgaagcagcaagtgatcagtatataaactgtggttatctgactcccctggcaacagaggtgggatctttattagagcatccctactgtgaggttcctggtggcttagcctccaagtctaatgatcttgccctttggagagtccataagcaaagtttcagcttttaataaatttattactttctgtgatacctatgtgtttctgcaattaacaactctgaatcatataaaaagtgaaaaaaagtttctgacctcattggctggcattctaggagggcaaactgatgaattcttaaactgatcagtaccagacattttttcaaaaagaggatggatagtgaatgaggggataccattttaaaaggcaagggcagacctcccagagaagatagcatttaaaactaagtgagatgtgacagagaagagggagttagccacggagatagggagttagctatctagcagagaacacttaaatgcaaagttgctgaggtgggactttgcttagaatatctgaagaacagcaagaaagttaatgtggctggactaagtccagataaatttagataaaattaggtctgagggatagctaggggtcagaattatgtagatcattgtagaccatagcatagataggtgattggttgattgttagatagatagataggtaggtaggtaggtagatagatagataggtaggtaggtagatagatagatagatagatagatagatagatagatatggtgagtattcagcctgttttacaaaatccttagaatcaacctaataatataatgctcattaatcaaagtgacaagttagaacatttagttttgtggctttttattaacataatttaaaaatagttttatattaaaataaagagaaacatagtagaatgctgattttgcaggaatttgaaagttattacgtgagtccctaaggatagtttaaatttgtggacaatttagattaagtttcccaacctcttatttgtacggtatcttttgcaattaggtaaactaagttaaaaagtttaagaactatattgttaagcaacatacattcagaaaaatgagtcagttttttttagataaacatttcctcttttttagttttatacatttagtgaatagaagtgcagatttattacatgtgtacattgtgtagcagtgaagtctgggcttttcgtgtactcatcacctgaatagtgaacattgtccccaacaggtgatttttcaatcttcccccacatcctcccctcccaccttttgtagtctccaatgtctcttattccactctgtgtgtccatgtgtacccattgttaactcccatttataagtaacagcatgaagtatttgactttctatttctgagttattttacttaagaaactggcctctagttccgtccatcttactgcacaagacatgatttcattctctcctttggctgactagaataaaaatttaaattaatttataaagatgcacttgcctatttaaaataagtgtggtctagtgaaagagtacagaccttcaagtcactcagtcctggattcaaattttgttctgccccttattgctcatgtgatcatggtgaaagttacttaaatattcctcactctagtttcctatttgtaaaattagaaaaaataaaacttaacacacaaaattgttatatatatcaaattaaataaggcaactttttttttttttttttttttgagatggagtctttctctgtatcccaggctggagtgcaatggcacgatctcggctcactgcaacctctgcctcccaagttcaagcaattctcctgcctcagcctcccaagtagctaggattacaggcacccgccatcatgcccggctaatttttgtatttttgtagagacggagtttcaccatgttggccaggctggtctcgaactcctgacctcaggtgatacaccggataatgcagcatttctaaggcactaagaagctttccataagtcatgcaacaaatatgttaatttcctttctttattacatttaattttttatctttcgatatccagtttgtttcacagcatagctaaagagccagaagggaaaggagaaaaagatgcttggaataacatttatgctaactaactacagtgacaaaaataaaagactggtttaccaagaaacctctctgagagtctctatatcatatcctgaaagcttcatgtctcttgataaattcacaggttttgagtttgttgaatttagcatctcaccttctttagtgcttcctatctctccaaagcacctggagatataaaagccaacaagaataaaacaacctgcctcttttacctgacagtaggatggaaataaactcaagataattggcttttaagatagctagtaggtacgtttatgtaaacatcatagagttttagaaagtaccagtgactggaaaagctcagaagctaacatcaaggtcacaccactccagaacaaactaggaaatacatatttggagatgtgttggccatctagaactacagccagctagaaactgataaataaaggtaccaaaaatagggatcagaagggttacacaatgatgtgtgtagaaaagaggtcacaatcagaaatgtaagaaattaaaatttaatgccaaaagacaaatttgttgaatatttcagtgcagtaggaaatatgtgagagaggacaaatgaaaagaatcttcagtgaaatagtgtgattagtagattttttcacagttaataggcagcaaatggagaacattactagtgcaaggaggacttagtgaaggttatgtactactttaacagacaaaaaaaaagctcagaatacgaacacaattcctcagcaaaagaacagtagggaagtattggtgttgaacctagaggcctgtgtatatgagtatccaccgggaatggctgattcgtgtttcattttgctaacaaagcataaatcagtgagcttattttgcaatgcagtattttcagtgtactggaatcattacatgtactggttcaaattctgcctcctctgcttaactaccactatggccttgggccacagattcagtttcttcaacttcctttgtagaatggaaataataatccctatcatatagcatataagaggcaactgatatattatttacttcagtaattatgttattttagtactgataaaagtcaatatatgaacatctttttttctcacaaacctacatatcaaccacattcagatatccctgtatattattagctcttttatatctaactaaaacatgaacagcaagaacatcaaactagaaggcctaaggaaaggatatggtctttactcaaaacatttattgctagtgcttctgcatgaaatgattaagaccttgctttacatataggtctaaatgtattatcagttcaaataaatcccacttaaatttaaagtgttatttattttcttttctataagaaatatataagttatttgatcctccaattccctaccagtgccagacatttcagtagctattctgggcattaaatatcctcctaggtttaactgctctcagttaaaggaattatttcaaaggtgttgagttcagaaaagaggctccctctgaagtattcaaaggatagtggtgctaaaatatgcagtgtttataaggtttcaggccagcgaatttttcatcggccttctgagaacacagtaggattttatcatttcatatctctattttgagatctctcagcaatcagtattgtgggtcctatttttgatcaatcaacctccctattggtttgtgccaggaattgaggatagttgctaggctgacaaatgttcttggggtttaaatttggtgaatatttactctctaacaaaaagaacacagatactacattcagttcccactttttgctcttgattaggaaataattatagcttctgaatttatacagtgatttaaacattttcccaccagggtgctggcattctgggaaaaaagaacatataatgtttgatttcaggctatcctgtgagtctggattttaaaagtagagtcaccctctgcaccagtttattgagtatgcagtaactaacaacagctgctctgtgtgaaaactgaaggacaagcatgcagttggtcagcttgataccaccacccatggtcgtttaaataaatgaggggaacaaaattagttttgccacgacttaggcaaaaatggatactgtctaatgctctatgtgaaaatagagtcagtaatctgctatttgaaattttactgacatttagacatttattgaagacaattttactttatcatcaacagaaaaatttgtgtagagctgcaaatggcctgactagacaaagtcttctctcctaaagggttagtgccaaaaagtgaataaataactgtcatttcaaggattggtgccatgttagagttctcttgctggggaggaaattgagaacagtctcaggtgaaaagagaggaacaaccatggcaatattatatggctttgttgacccagctagcacaaagcaatggttttaaatgtgttttctaaacaaattcaactaatcatttccattcatccattttgtaggatggatagatttcaaaacaaattgccacttggatagcttagctcacaggaagagtatgctctggaccctgaggaatgagtgaggagccaattgttaagattattcctttgcctacatttttcaggatgtgtgtcactatccactctgcatttagacagctctcaaactgggcaatagtcacagtgtatactgcatgggttttaaattaggataaaatgttagaagcttcctcagcttcatggccaggagaaaataaatttgcccatgccagacagagatggccacagtttgattaagggactttaaaaagttaagagaagtatccgaaatttgcaaagcacccactcaagggaattacatggcagtgctcatgaaaataatatgaaacaccctgcaaagcttttcactaagctttgaccttatcacttgctctttaacttacttctggaaactaatgctgtggaaaaaaataggagaaggtacttgaacaaacagcttaaattatattgtccaaaagttccttacacagtccaaacaccttcaaaacctagagtttcttggctttagcattgagcaataatcttgcctgataaacggatatatactgatattacctaatagctgaaaatgtttttactcagttaccaaataatcattagtgcagaatagatgtgaggcctattttcggtgtcagccagaagcactgtttactcctccacacttccaaaaattcctctgttctatcttcccgcttgagcttgcgttttatttaaatgtttgtaatacatgctgacacacaaaaaaatgttgtttacttcaacttactctaattgtggctgtccaccaagaacaaatcaaatttctcagtttctgtgaaataagcctcttgctctttctcatcttatttttaacttttgacaataaaaatgcatgcatatgaacttgatcaaagcaataactaggaaaaatgaactagcaaccctggatctaaacctgactcctactcacatttctagccctcaatatcttttatataaaataaaatgatctatattagaatggtatctaaagtccttttcagctatgaaatttcacaagtctttcattagactttcatcatctgtgtatacacagaaaacaataatatcttgccttttgcaagttctatagtttttttattttaataatcatccaattcatctttcttaaaaaccagcctccttgaaattaaactgacatggattaatatctcacttatactctaatgacagaaaaaactttaaaatttttggaaagaaatcattaagaaaaatttacatgtaagagaacatatatattctatatcagtaaatatataggtgtgatacagatctgtgtctataattatatagacaactatatcaggatatataccttatcagaaaacagactgaaaatatatcaatacaataaaacttaaaatgtactaactagataaagccaagaactgatgactactgagaaataaataaaatggtattatgaatgaatttgcattgttctaactacatcacatatttccaatgacagcttcacattgatttaatattggccaggccaagactggaagaagaatgtgttgtcctggaccctagaaaaccacatctgattgttattgtgaattgtatttcatatggctgtaattattctgaattgtgttcactaatttcttgtcacaaaaaaatgcttaaaatacagtaagaaatgggcttaagcagattttaaatggattagtaaaagcactagagtattacttctatttttaaagaaataccatgtattttggaatcgtgaagaactgtgtcagcacatttttaaaccactaggcttttgttgttgttgttgcttttctttccaattccagctttttattatttttttaaattttattttaagttcagggttacaagtgtgggtttgttacataggtaaatttgtgtcatagggctttgttgtacaaattatttaatcacccaggtattaagcctagtatccattagttatgtttcctgatctctccctcctctcaccctccaccctccgaaaggccacggtatgtgttgttcccctctacatgtccacgtgttctcatgatttagttctcacttgtaagtgagaatatgcagtattttgttttctgttcttgtgttagtttgcacttgtaagtgagaacatgcagtatttggttctctgttcctgtgttagtttgcacttgtaagtgagaacatgcagtatttggttctctgttcctgtgttagtttgctaagggtaatggcctgcaaaggatgtgatcccactcttttttatggctgcatattattccatgatgtgtatggaccacattttctttatccagtctttattttctttatccagtctatcatttagtttgattccatgtctttgctatcgtgaatagtgatgcagtaaacgtacatgtgcatgtgactttatgatagtatgatttatattcctttgggcatatacccagtaataggattgctaggtcaaatggtatttctatctttaggtctttgaggaatcaccacactgtcttccacaatgactgaactaatttacactcccaccaacagtgaataagtggtcttttttcctccacaaccttgccagcatctgttattttttgacttttatatgatagtctttctgactggtgttagatggtacctcactggggtttggatttgtatttctctacagatcagtgatgttgagctttttcatacgtttttgtttaaaaataaaattagaaatcgaagacaaaaataaatgtggtgaacggtgtaagtcagtttattctgtaattatagggggatgtttcagtatgctgtaattcctatcctatagaacagcagtccatggtccccaaactttttggctcataaggagcacacaacctagatcccaggcatgcacagttcataatagggtttgtgcttctatgagaatctaatgccacagctgatctgacaggaagtagagctcaggcagtaatgctcccttgcccacccctcatctcttgctgtgtgacccggtttctaacaagccacggaccattttcagtcttgcagcctaagggttggggacccttgctatagaaggcaattagtatggggttaataccagatgaacaagaaagataacatcaggcaaataaaacacacagtaaaacaatgtatataacagcacaatggttttattgacggcagaagaaaaaaaatttcctttgacttgtaaaaagaatttgttttatttaactcagtatttttcccattctttgtgtgagttgaatcttcttttttcactctaaaatatgttttttctttctacaagtaatactatccaccatagctgctacttattctgaagagaaagtagagaggtctatcaacaggttttgaccagaatgtttcagtcaatggctcctttcttcacataaactctattttaactagaaaggaagaaaatgaagttgaaccctcaaattaactttttcatactgtgtcaagatacatttctgctgaaacttatctgcaaacgtgaagtgtttgcataaatataaataaatctctgatagaataaattttggacactgctgtcaaaagcaagcaagaaggaacgaaggaagggaggaagggagggagggacggagggaagggagggtgggggaaaggggagagagggagggagggggaaggggagagagggaagggggaggggagggacggagggaaggaaagaaggaaaagtttctgaggcaaaaacttataacctgaaggtttaatagggtagatgagaaaacaatccctggaagtaaacatcaatgataaaagaaagagagactataatggaaggagagaaaatacccattggtttgctaccattcagaccacagcttcaagaggcagtacagttgatagctgtaagttgtgagttgtttccagagaaactgtgaaagtccattgcattgatctattggatgctgaagtaagtagggaaggaaggctagtgaattactggttcttttttgtccatttttcctactggtaaaaggcaagctcataggttaactgtcctgtagctgcaggttgtgtttcctgggttccctaggcagctgtggaagaaatgagggttccagtggtccagtgaagtcagtatgtggttctgtggactcctccaagtatgtgtgtaaatgtgtgtgtatgctggttgggggatatttcatctgttttgatggtggtggtgatgacagcagtggcaataacctaagctttatggttgaagtaatttcatcagtcattcctaatgccattcgggccaggaaggaaagcaatctgccaagtcctgagggtcaggggaagtcaggtagaatcagagggcagaaactcattttcgctctcactctttagtgatcttcagatctcacataagaacactttgcattcaattcttgcctaggaggggaggtgcaaatctaattcttcaaggtgataattagttgcaatctcctaaaaaaaactaaagaggactagaaaccaagccatgttcaaactattgcaggtggtacagaatagatgtttctcatcattcttcttcactcagactccctagattcccctcactccctctcagcccttcagcaggtcaggagatgacgtatctttctttcttttttgtttattatactttaagttctagggtacatgtgcacaacgtgcaggtttgttacatatgtatacatgtgccatgttggtgtgctgcacccattaactcgtcatttacattaggtatatctcctaatgctatccctccccctgccccccactccctgacaggccctggtgtgtgatgttccctttcctgtgtccgagtgttctcattgttcaattcccacctatgagtgagaacatgcagtgtttggttttctgtccttgcgatagtttgctgagaatgatggtttccagcttcatccatgtccgtacaaaggacatgaactcatcattttttatggctgcacagtattccatggtgtatatgtgccacattttcttaatccagtctatcattggtggacatttgggttggttccaagtctttgctattgtgaatagtgccacaataaacatatgtgtgcatatgtctttatagcagcatgatttataattctttgggtatatacccagtaatgggatggctgggtcaaatggtatttctagttctatatccctgaggaatggccacactgtcttccacaatggttgaactagtttacagtcccaccaacagtgaaaaagtgatcctatttctccacatcctctccagcacctgttgttgcctgactttttaatgatcgccattctaactggtgtgagatggtatctcattgtggttttgatttgcatttctctgatggccagtgatggtgagcattttttcatgtgtcttttggctgcataaatgtcttcttttgagaagtgtctgttcatatcctttgcccacttcttgatggggttgtttgtttttttcttgtaaatttgttggagttcattgtagattctgaatattagctttttgtcagatgagtagattgcaaaaattttctcccattctgtaggttgcctgttcactctgatggtagtttcttttgctgtgcagaagctctttcatttaattagatcccatttgtcaattttggcttttgttgccattgcttttggtgtttaagacatgaagtccttgcccatgcctatgtcttcaatggtattgcctaggttttcttctagggtttgtatggtattaggtctaacgtttaagtctttaatccatcttgaattaatttttgtataaggtgtaaggaagggatccagtttcagctttctacacatggctagccagttttcccagcaccatttgttaggtagggaatcctttccccatttcttgtttctgtcaggtttgtcaaagatcagatagttgtaggtgtgtggtattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctctttgttggttccgtatgaactttaaagtagttttttccaattctctgaagaaagtcattggtaacttgatggggatggcattgaatctataaatcaccttgagcagtatggccattttcatgatattgattcttcctatccatgagcatggaatgttcttcaatttgtttgtatcctcttttatttcattgagcagtggtttgtagttctccttgaagagctccttcacatcccttgtaagttggattcctaggtatttttattctctctgaagcaattgtgaatgggaattcactcatgatttggctctctgtttgtctgttattggtgtataagaatgcttgtgatttttgcactttgattttgtatcctgagactttgctgaagttgcttatcagcttaaggagattttgggcttacacaatggggttttctagatatacaatcatgtcatctgcaaacagggacaatttgacttcctcttttcctaatgaatacctttatttctttctcctgcctgattgccctggccagaacttccaacattatgttgaataggagtggtgagagagggcatccctgtcttgtgccagttttcagagggaatgtttccagtttttgcccattcagtatgatattggctgtgggtttgtcatagatagctcttattattttgagatacgtcccatcaatccctaatttattgagagtttttagcatgaagggctgttgaattttgtgaaaggccttttctgcatcttttgagataatcatgtggtttttgtctttggttctctttatatgctggattacatttactgatttgcatatgttgaaccagccctgcatcccagggatgaagcccacttgatcatgtggataagcttttttatgtgttgctggattcagtttgccagtattttattgaggatttttgcattgatgttcatcagggatattggtctaaaattctctttttttgttgtgtctctgcccagctttggtatcaggatgatgctggcctcataaaataagttagggaggattccttctttttctattgattggaatggtttcagaaggaatggtaccagctcctccttgtacctctggtagaattcagctgtgaatccgtctggtcctggactttttttggttggtaagctatcaattatttcctgaatttcagagcctgtttttggtctattcagagattcaacttcttttttcttaatgtatttgaggccttccttgccttgcctttgttgggctgtggctgctgaaatatttcactcacaattatcaatggtcatagaagaaccaaaagacacattggtgaataccctaggataagaacatactctactatccctccattgtgtaataacaaacttatccagccttacattcctgcttcataaccttcagttagatccatttcctcacatgtttccctggttactgctgccatatactaatcaggcatttcatttctttgctgtttaagttttttctccccaaagcaaagtctattcttctctttttggattgtgaggagatttgatcattggcccctcatttggtcctggggccaatgagggatattggggactgattattttgagaacaaacattatctttttacactcctacttaggtcaattcggtagacagtccctagaaaacggcaagctgttctcctatgacaagttgttttagggctgtctctactgaccaagaagattaaagaaaatttagtaagttgatattcccaggttcatttatctaaacacaactaccccaggttttagggtctcactctttctctatcaaggccctagtttgatgtaggaaacttactaagaggacacctttcatctcctctacaattttcccattctatgttcagatctgagacttgatctttagcacaatctaccagaggaacaatatataaacaaacaactccttgaaagctcccataaagactctttggttttcatagaaaacagctgttgttagactgtcatttttatctttctcaaagtttccaacattactaaaagctcagttattattgtccccataatgatcaatgtagcagctgcttgtattccagcactttacttacctgtactccattccaattaaccccagctcaaggtgtgaataattatgatatctctgaacaccaaaaattattatcctccccgacttaccatgagctttgtgattgcttttgccttcaaacaggcagggaatccaattccaaaataccctcctgaaggatgtgtgctgtctagaactagtctaggatttcctcaaacacagagcctgaggaaaagaataagagcaaagagggaagtgaaacaaagaggaagagtaaatacaaaaggtgtctaatggagttgacagcatcaccagaaaaacagctggttggttcagatgtgaacagctgatatgttcacagggaacatatccagagacacagcataaaacccccatgtagtagtctgcttaggctgccaaaagaaaataccactgactagatggcttcaacaacagaagtttattttgtcacagctctgaaggctggaagtccaagatcaagatgtcagcaggtttgatttctcccgaggctctctccttggcttgcagatggccaccttctcactgtgttctcacatggcctttcctctgagtgtgtgcatccctagtgtctttttctttctatgaggacaccaatcatatgggactaaagccccacctttgtgacctcatttagccttcattgcctccttaaagtccctgtctccaaatacagtcatattggaggttagagcttcataatatgaatttgtgggggagggattcaattcagtctagaacctccacttctcaaaacagtctgttttgtatatgtgagggagtagtggtgaggttgagaggacacatcaagagaaagttcaagcaattcaactattgcatattccttatttcctgtgtctcattgagcaatgtcggccacataagcattaactccccacactttgaggcctatctgggcagactttgaagaggacagaaactttatgggtctattcatcaagtcctcatttgtaacaataattgttttcaattaatgctgtttatcaggctctatggtctctagcagtgctaaggctgtaattaattaggaagaaagccaagaaggcctggaggaggaaactggtagaaaagggaactggaagggtgaaaatatatagtattggagagctaatagtatattttttctggattgataagttttatcattacatcagataatatgtttgacttttaatgatttgagatattagacatttcattctaaatgaagccaaactagcaacttgtaatggagaactcatatgacatagtctatgctgatgatacaaatctctgaaataatgtttctgtgggatatgggaaaattagctgttagactgccaatttgtgcaacttgggaatatttggctacaggagagcttgtaaagcggtagtccttggtattgtccttcaaagctaggggtgaaggggtatgaggaaagctcttatttttacaaagtattatgtacttttcttgtcccttttcgaaaattatctgaacttacaattttagagatagaacaaatgattactgggttaaagactggatatccttagaagcatgcataatgacatataataaagtgaatatagatcttttttgttttcattgcagatttttggccctggactcttatactttcaaggatagtcataagggttttagtcattttttaaccaggatcagctgagacagtgatagcagagcattacaccaagtgcgaggccttctaagttcagggacttgtgcaattgcaaaggacatgcaatcatgaagctggccttgtctacaacatcatttattgcaaaataaagaacaagaaacaagtatttttactatttcacacagaaaatatgtatttgtacaaagaaagtagaaaatatattattttgaacaaagtaaaaattaatataaacaatctttccccatatatcaaaatttaaacagtcaatatttaaactttaattcagaaaatgacaacataatttattaatattttaatactatatcatatttagttgttttcttcatacacgattgcagtttaggaacatatatacatatcatacatatcattaagtaaaactggaatatctaacatgttctgatataatttttatgatagatataatagagtacttctcatatatcccacacccagctttccctattatgaatatcttacaatattatgctacattggttaaaattagttaactgaaagatggaatgaaggaaaattagcttacattgatacataagtattaactaaagcccatactctattcagatagccttagtttttacccaatgtcctttttctgttccaggattctatctaggataccctatgacacatagttgccaagtctctttatgttcatcttaactgtgacagtttttcagactttttttttttggttttgataaccttgacgattttgaggagtacttatcagatattttgaaggatgcccctctactgcaatttttctgatgtttttactcatgattagactggagttagggtttggggaagaatatcatagacataaagtgccaccgtcatcatatcatatctaagatagatgctaaagggatgatttacaactgttaatgttgaccttaatcactgatgtgccataatgttttttaggtttctccactgtaaggtcatttttcctcccctttccatgtagtactctttgaaaggaagtcactatgcataacccacgcttgagaggagaggagtcacgttccacctccttaaggcagaataatacctaggtagatttattctgtcactttcccctatttatctatttatgtattagtaatctatgcttctattaatccattttttatttctgtcagtatggcttcattccagcagagagaaatctgactcccagtgtccaccatccatttgttctcctcaattccagtgtgcacaggagcaatacaaaaatcattaacccatacccccataggaacaactttatcaacaaaattataatgtctatgtacagttacttctgcctttagtttcacagcctctactcatttacaaaattacttaggttgccacgttttcttccaatccccttaagtaaggctgcattatacttttgtactaggcatattattttatcacattttacatctcatcctgggattcccccatacctcctgaaaatagtgtttttttaaattgtcatatattaaagctcactctttgcattttaaattctatgggtttttataaattcatagtttcatgtatttgccgtaagaacataacacagaataaattcagtttccataaaatttagttttttatcttttcaaccatcttaactcccatctgaacctctggcaacaactgactggatataatttatttagttttgccttctctacagtgccatataattggtcccatctagtatgcagctttttcagactagctctttcacttagcaacatgtacttaacatgcatccatgtcttttcataacttgagaactcatttacttttgtctctaaataatatttcattttatggccaaccatattttattaattagttgatgattatttggattatatccactttttgcctgttataaataatgttgctatggacattcatgtaaaagtatttgtgaggacatacatttatatttcttatggatatgtaactaggagtagaatatataactggatcatatggtaactctatgttgaaccatttgaggaactgccagattgtttcccaaagtggccacatcattttatattctacctatctacaaatatgaaatatatctcaaatatttaggtcttcttggatttattttgtcagtgttttatagctttctgcatatagaaagctatatatattttaattttatacgacaagatttcaaagttttggtgctatttaaattttcttccttttagtttcaagttctcatattttgctgctggtgtataggcaagcaattgaatcttatatgttgacctttcactaggtcagtttaccacacgcactcattagttccagaagtttttgtagatgcatagacaattatgtcatatgccaacaaagataattttatattttcctttctaaatgttatgtcttttatttcttttttcttgtcttacttcagtagataggacttccactatgacattgggtaggagtcgtaagggaatgcatccttgccttattactgatcttaggtgaaaagagaatattttctcaccattaagcctgttgatatggaaaattacattgagtttttttcagtattaaacctggaataaactccatttagttgtggagtaaaattatttttgtatctttttggatgtgatttgttgataatattttgtatatgttcataagacatactgttctataattttcctttcttgtaatgtctttattagcttttattaggataatgttgcccttataacaaggagttagaaagtgttccctttgcttctatttactgccaaaaattgtgaagaattggtagcatgtcttattcaagtatttggtagaattaaccaccaaagccatatgagtatgctgattttgtttttaactgttattttaagttcaggggtacaagtgcaggtttgttacataggtaaagttgtgtcatgacagtttgttgtacagaatatttcatcacccaggtattaagcctagtaccattagttatttttcctgatcctccccctcctcccaccttccacctcaccatcaaaaggccccagtgtgtgttgttctttccactctatgtgtccatgtgttctcaccatttagctcccacttataggtgagaacttgtggtatttggttttctgttcctatgttagtttgctaaggataatggcctccagctccacccatgtccttgcaaaggacgtgatcctgttcttttttaatggctgcatagtattccattgtgtaaacgtaccatactttaaaaactgaatgaataattaacaacttcccaaaagaaaaatcaccataaagcccacaaagatgagacagtatggtgatttttcttttagaaagttattaattattgattcagttttctaagtagatataagcccatttatattttctcattctctttctataaaccttggtggtttgtatcttccaaagaataagtccatttcatctaatataaaaattgtgagttttcaagatatgaaatcagcctaagtgtccatcagtggatgaatggagaaagaaaaagtggtacatttagacaatgtaatactacttagacataaaaaataatgaaaccctgtaatttgctggcacatggatggaactggaggacattgtgttaaatgaaataaaccaagcacagaaagacaaatattacatgttctcactcatatgtgagagccaaaaaaaactgaactcatggagatagagagtagaatgatggttaccagcagctgggaagggtagtagggcatggggaatatagaggggaaggttgatgagcacaaagatacagttaggtagaagcaactaaatctaatgtttgatagcacaacaggacaactaaagttaacaatagcacattgtatatttcaaaataactaaaaaagtagaattggaaagtttctaacacaaagaagtgataaacgcttgaggtgatagatattccaattaccctggttaccttagctagacatttattgatttttaaaaatattttcatagaggcaccttttggttaacttgattgtccctagtgttttactgtttaaaatgttatggatttctgctctaacttttatttcttctctttgttttgggcttaaattgaccttctttctatagttttctatgtgaaatatggattaaaattactgatttagatatttcttactttcttatatatgcatttagtattaaaaatttctgtcatacccctgctttaactatatcccatacattttggtaagttgtatttgtattttactcagttcaaaatatttctaaatttttgttgaatctacttttttgacttataggttacttggatatatgatgttaaacttgtaaacatttgcagtgttactatttttttatttctagttcaactctactgtagtgtgagatactttctattatttctattctttttcagttttaatatgtattttatggcccagaacatagtatatcctggtaaattattcatataatctttcaaactatgtgtattttgctattgttacatggaatattctaaaattgtcgattagattaaattaattgatggggctattcaattcatctatattctcaatgattttctatctgctggatctattgtctactgaaagaagagtattgaatctccaactctaataggagacatgcctaattctctttgcagtttttgccttatatattttgctgctctgttattaggtgcctacacatttgggactattatattgtcctagagaattcacccctttaacatatatcatatctatgttattgtggatgattttcttgttctgaaatctgctttgtttgaaattaatataactacttcagatacttttgattagtgttataaatttcttcctcagtttacctttaagctattggaatccttatattaaactgtttcttgtagacaacatattttttgtctgtttttctttaaatccatactgaaaatctttatttaaaactggcatatttagatcatcgacatttaaagtgactcttgatatagttggctcaatattctccatatatgtagctgttttctcttttttggcagttgttctttcccctccaccacttttctgctttctctagctttaattcagcattttatataattccactttatctcctctattagcatgtcaatgatacttccttttaaattttacattgattgttctagagtttcaatatacattttttaaccagtaaagtgtattttcaaatgacactatatgacttaatgtgtaatgcctatgtttatttatatatgtatatgtgtgtatatatgtgtatatctatataaaattctttctacatatacatatacaaatatgtatacatatgcaaattatctacatatacacatatatgtatgtatagattattttgtcatatatacatatgccacatatacatcatacagacatatatgtatgcatatatgtatttatgcatatgtcttatatgtatgcttatatatacataggtatgtatacatatgtcttacataggtatgtttatgtatacagatgtatacatatatatgacatatacatgacatattatatatgacagaaaattctaattcctcccattgctgatgatatttctgttactcattcactgatttgtatactataatcacccaacacattattactgttactttaaaaaaggttatcttttagattaagaagaaaaataaatgattttatttaatcattatttattccttttctgatattcttttctttttaatggagatccaagttcctgatggatataattttccttttccctgaagaacctcttttaaaatttttttgccgacaggtcttttgatggtgtattttctcagtttttgtttgtctgaaagtctttatttctgcttcactgttgaaggagaaggttaagtttgctggatacagaatttctgtttgggaggttttttaaaattttaaatattcactattctctcttcctgcttgaatggaatcaccatgctgtgtttctcactgtaactccttgttctttgctaggtacagtggttattttccctgtctaatttatttcaagattttcttattatcttagttttctgaagtgagaatatgttatccttaggtgtaatatttttggaatttatcctgcttggttttccttgagcttcctggatctatggttttgtgtatgtcattaattttgaatgctcttgaccattattacttcaactattttgtctgcttttgcctctctttcttctcccccctggcattccaattacattttcatttaccttttgtaattatccccacagttcttgggtgttcagttttattctcttctttgcattcagaagtttctattgatatatcttcaagttcactgtttcttcccttggttgtatccagtggactgattcactgagatggagttttactcttgttgcccaggttggagtgcaatggtgtgatctcggctcactgcaacctccacctcctaggttccagtgattctcctgcctcagcctcccaagtagctgggattaccagtgcatgccaccacgcctggctaattttgtattttttttttttttagtagagacaggttttcaccatgttgatcaggctggtctcgaacttctgacctcaagtgatccacccgcctcggcctcccaaagtgctgggattataggccatgagccaccacacccagcccaaagtcgttcttaaatcactgtaatgtttttgatttttaaaatttattttgaaccctttgtattaagaattctgactctattttttttttttttttttttttttttttttttttttttttttttttttttttttagtgtttgacttctgataacttctaagtcttactcctctgtatgtcttttgttccacatctgagcaagctaataagaaagcctgggtgctttctgctttggtgcttacaggagatccaaaccatacaaccctctgcttgcacacaggaactctcacctcaatctcactttctaaccacaagcaaaacccaaaggcagtctcctttcctttctcccataaaccattgcggacctacttgggaggcctgcaccccattgtccacaaaaacttgaattctgtaagtaataattttttaagctcttttggagtgggtttcacatcctcagtctcaacatctgaattaaatattgactgagagtgaatcctgcaccttcagaatggctacaaaatgctctcttagagtttgtgtgtgtctctgcttacataactatctgttattgaatgttgactacttttttccatgagttcttaacatcttaattattttaaaaaaatcctctgatgattccaacatctgtctctttcctcagatgactgtttctgctgcttactgtggctttaaatactttttttggccctttaaaatgtcttataatttttggtttaaagtccaacttgtatcagttaacagaactgaggtatatcagcctttaatgtcaggatttatattaatctgggtaggagttgggctgtgttcaatgtttgttatagttttagatgccatagtcctttatattcctgcagtactcttatttgtgtttatttttttgactttgggattccctaagtcttcttcagacagattctgcatgttgtaataatttcagatgtaatccccttcagttattaactgaagccctgacctaataatggtcaggtatggggtaggaaaagcacattataatctcacatgaaatctcattcttttagtgggcctgtgtctctgagctgtgaccttcacaagtatttttctcatgatatatctttccctcctctgtgccatttatgtaagacaagactgctagaaggtgctagcatgaaaagaatgtcatttccaagtttagacaaggctctggtaaagtctttctcccggaggatagacctttgttacagataatgcactgggcatattttacaatgattgctattcctctgttcttgccagagacaggaggaaacctttttttttttcttcatcatgggaacaaggtgaggttctctgaggtaacattccctaagacaggaaccccaggactttccaactctaaggatttcccacattcaggatccagaagttttcaaaattacctcttaagttttcctactagtttatggccccagaggcttctactccaggtaagcagttctctgcaactctgaatttgcttgtatttctagattttaaggtgacagtttgccctgtaatatcagttctctgacgggtccaagacaagccatcaattttaagtttctttaactatttcttattgtaaggatgggaattggaaatgctaagctctttaaagatttgggctaaaactggaggtaatgctcatattctgtttttatcaaattcactgttaaatatatatcatctatccttcacactcagacaaaatcaaaacaatattcagtgatcagtcactcatttttagatatttgggttaactgacgaaggctttcatttccttctcctatataatccttgtacaatggaacaaggagataagcagtgaaaggccaagggaatgtctggagttaggacttcaggtgattcacaacttggctgccactcacccgagactgcccaagcccagatttcttccttctataagaatattgattcttgcaaataagatgaacctaaatgtggtccaggagtcagcatcttctacatggtactcagatcttcaaaaagaaaaaaaggaaaaaaatacaaccccattaaataagacagttatagctgctgctttttctttttcatcatccttgtctctgttttccttttcttacccctcttcttcatgtaaggctttccttataacccaatataattagacagaaacataatagtaacatattaccaagagtgcaattatttctactttaaagtataaaactggtcaaacaaaattgataatattaatctcaagttagttattttaatacagacagatgaaaaaaggactcatcacttcagtaagtttcacataccacctcttctaaccagaaaggagtattctctcaagtaaaatagttcctcattctttcaaaaatttaaagtgctttatctataatgctttggtatcctaatttccctttatctggattacataggccattgacattcaagcatagtaaaagaaaatgctaaaattttatcttgaatgttaaagcacaaggacttctgtgaatgatgagagatttctcgagtgtcactggtcaacactcattccaacatattgacagaacgaaaatactaacacctaactccctagtaaaatatatactttcagtacagaaaataaaataaccctgtcttctacttgttgagaaaaagtaggtaaaatattaaagtggaaaaatatggcattagagagagaagtacctgaatttgaatcctgaacttgctatgcagcttcaatgagttatacaacctctctaatccttggtttccttaaccttaaaatggatacactaatatttaactggaagaattgttgaaatgtttaatttggctcatcaaaataactaatgcagaatgatagatattcaataagtgataactataattattgttaatgtgtaaaagttttcttgcaaagatatatttcattaaaaaccatcacaacttgcatttgaaatgaatagagaaagatctgctactctatttctactcatacctccagatagcatgatgcttcttcctgaaataaaaataggaggaagggctgggcgcggtggctcacgcctgtaatcccagcactttgggaggccgaggcgggcggatcacgaggtcagaagatggagaccatcctggctaacacggtgaaacctcatctctactaaaactacacaaaaattagccgggcttggtggcgggcacctgtagtcccagctactcgggaggctgggacaggaggatggcatgaagccaggaggcggagcttgcagtgagccaagatggcgccactgcactccagcctgggcgacagagcgagactctgtctcaaaaaaataaaatagaggaggaggaaggggaagaggaggaggagaaagaaaggaggaggcagagatggctccactcctgaatacgttttaggtagtgtggtatttaagcacttcatcttggccaaatttgataacaattaaagtttgtttccaggttccttgggactctattttagtgttcgtttccactccagattagacctttccaaatactctcagaaactttagatgtcctccaatcaaactctgctctcttgaaaagactgccagcagtcttttatacctctctatattgccattccagaaatactggtatttggggtcatgtttctaactagggaattgagagttacagatagcataaggagtagtataaggatattgcaacaaggattttgtaaaggatccctgagtaagggatctcaagccttagatggaagaaatatatcatgtttgcatgtgtgttagtgtgttagtgtgtgtgtgtgtgtgtgtgtgtgtgtctcatccagcttgtggccctatgagccctgtacagaaaatggtagaggctgagaacatagacattcccacatttaataatgcaagagggtattcctttagttgaatacttcttttcagaaatccacacaaaatcagatataaagaaattcaacagaaaagaaaaatcaggctaggcacgatggctcactcctgtaatctaagcattttgggagactgaggcaggaggatggcttgagctcaggagttcaagaccagcctggccaacatggcaaaactctgtatctacaaaatatacaaaaattaggtgggcgtggttgtgcatgcctatagttaagctgcttggagactgagacagaaggatcacttgaacgcaggaagctgaggttacagtgagctgccatcacactactgcactccagcctgggtgacaaagtgaaactctgtctcaaaaaaaacaaaaaaattacctaagcatggtggtgcatgcctgtggtcccaggtatctgggaggctgaggtgggaggatggcttcagcctgagaggtgaaggttgcagtgagctgagatggtgccattgcactccagcctgggtgacagaacgagactttgtctccaagtaaaaaagaaaaaagaaaaaagatcacttttctagtttgtttatttcataaattggcaacaatttgttaattttttcaaaagagttttaaaatgtgttatttattccgaagaaacccataaaacattgagaaaggaagaaaaacaatagtttttcttcatactaacacatagcaaatattgaatgaacaattcaattccatcagctttcaaaacccaaggtatttggttcttgtttgtgatggtgctggtagtggcaatatatatgtaagtgtgtatattttaaattataaagcattttgaaatccttgtacattaattattgaaactgcagtcatttaatatggagtttcaccagtctatgtgtgaaagactaatgaaagggttaaagaattcacaatttcccaaaagaaaaaagaaatcatgaaataaatccactattagagtctaaatggtaatgcagcctcatttaaataacaaggaaattataactttccaaataataaaaagcttaaagcagcttaaaaatagctctgggtgaacacacgacaactaaaaacaaaatggaagaatggaagctcagttcctaccttaccactgaggaattttaagttatcattcctgtaaacatttctccagtggctccacggaatttaaaaatgccttccaaattgccttcagttttcacaggccatctaaaagaaacatgattttcctttcttagcaaacatgataaagaccttgaggagatataagcaatttattgatgaggacaagaatggcttttaatttgccatgggggatttgagccagaagttactggaacaccaaatctgtgaagctgacatctgtaggtcaaaaataaaaacaaaagagcaaataaaacacaatccatgaacaaacacattttttaaaaattagattaaattgtatagttccagttggaagaaattttcaaaggaaatagtatcatcttttggttcattgtaatatgcaaaaaaaaaaagcatttgaaaagattatatcagagaagcggagaaaatgcataacatctagtttatggtacaattttttctctctgctatgaatgttaggaagagttgggtatacctctttgtgtggacatatgttttcatttatttgggattgtttctgtggtgacttatttattttgtgaccttgccaaacattcggggattttccagttgtccttctattttttgatgtatagttcaattccattacattcgtataacatactttgtattatttccatttgtaacgttttgggggcttcttttgtggtacaggagatggcctatccctttgctccatgtacacttggaaagactatcttttctctcatttgatagagttctttataaatatcaatttgaataatttggttgatattgatgttcaaggcttctatatcgttagagattttctatttactttttctgtcttatcaattactgcaaaaggagtacaatatatatttggtttgtccattttttccttttagttctatcagtctttaaagttctataagtacttcaatgttttgttattggttccatgcatatttgatatttttatgtcttctccagatagaccctttatcactataaaattaaaatttttctttatccccttttttttttttttgacagagtcttgctctttctctgtcacccaggctgaagtgcaatggcaagatcttgcctcattgcaacctctacctctgggactcaagtgattccatgcctcagcctcccaagtggctgggactacagacatgggccaccatacccagctaatttttgtatttttagtagagatagagtttcactgtgttggtcaggctcatcttgaactcctgagctcaggcgatctgcccgcctcagcctcccaacgtgctgggattacaggcatgagccactgtgcctggccatctctttatcccttataaaagtcattttgaaatatgctttgtgtgatattaatatagtcttccagctctcttttcaatagtatttgcatatgttatttttaatttttaaactttctatatttttatgcttaaaggggattgttctatagacagaatacttttggtcttgcttttttttttaaagccaatatgacaatctctgcattttaattggaatatttagaccatataaatgtaaggtaaagtgataatatttgtggttggccaaataatgccatacccaaagatatccacagcctaatccacaggatctgagaacgtacatgataaaggggattacattatgttgcagatgaagttgaggttaataatgagttgacctgaaaatagggagattatcttatttaattaattacagggtccttaatactggaatagggaagtggaagggagagactgtggcataaaaagggcttggcccaattttgatatacaaaagtgatcaataggcaaggaatatgggcaacctctataaactgaaaaagaaaaagctgtttggattctttcacagaagaaaagcagtcctactgataacttcattttagttaattgagacccatttcagaaatccaatgctgggaagtaatacagaatagtgaaggtaaagttacaaagatgaaatttttcatctcatcaattggcattcgtgtgtatgtatacgtacataaactcatagtatatatatacatatacacacaaacacaaaacccacatatatctacttaattaaatcaattaaaattcagtcacatttttagtaacttcaatatgtaatttagcagttacagtggcatctatccctaaatagtttttatttatggggtatgatatgtaataactgaagtggtgataatacaaagtactatgatatttgacaaaagtaaagtgcaaatcgaatccaaatgctaaataaggaataaaattagtactcgagtgtaacaaatcatgactgcagaagtgtttaatgaaaagtttacatatgaaatggatattgcaaagagctcttaaatgcctttactaagatgtttagactttagtcaagagttagtggggaagatgaaaatgttttctcttttcttttctttccttttttttttttaagtagtgaaatcatctaaaccagaatcctcttttagaaagatcatattgatggtagtaaagaaatggaaatggcaagaacatacgagaagggtgtctaggttaaaaactaatgaaataattcatccatgagaaataaaagaataaactctgtactggaaggatataaaaaggaaacatatatgaatactacagaagtagaatgaacagaatttgaagacagaaaacctataaaatggtttttatataaattatttaaattatatataatttataagttggatctcctgggttttgtactcagtggttaaactccttgtaattccatgtatgaactattatttactttgctagtatttatatcttacggccagcctcttaataatttgaataatattattatgtccatcagatagaaagagaaagggtagtaaaatggaatccaattagttgtctttcctacttgccagtaatattctgggaaaaaaaaaaacagttaatatggtataagcttatacgtttttactttatatactgccttaatatataattagaagatgaatgtaagtaaaagtcctactatatttgatctttggatgacttcacaaccaataattgttttttcacctgaacttcacatttaaaactttcaagcaagagaacttagagaatgcacaattgctcactccaagtacttgtaacagtagaatatttatatatgtaaaaatgtgaaattattatttataatctatcccttttgtatatataagtctcatctggtaattatgccacaaactcagaagaaagtgtaatcacaggcatataaatatataatatatatatttttatgtcatattcattatcacaatataattttatttgataaataaattaagcctagttaatactatagaaaaggactatgactttatttctcttaatggattatttgtagcaaaaataatataattttgtttgaaaaacagttatttacaggtataatatatagaggaaattggttggaaataaagcaattatttgctatgaaactttttagatgtcacccctacctaacttgtagaattcttggtcttttggaatgtatggcatagagacctttatgaaagataattccattacctctctgtttcagatgtattgtttcaggacaggcaagccccaaaattggggtttagcccaaaagagttcttggcttcacccaggaaggaattcaagggcaagctgctggcggagttagacagcaatcttttttgaatggtactgctctttgcagagcagggctaactcataggcaatgcacccagatttgctaatgtatgggctcttggcaactgtacttaactcctgtaaatccactttcaattatgtgcaaattaatgggtgggtcaatgcaaattggggaacgggttacttaaaactttctaagaaaggagcagtcatttctgggttgttgccttggaaaatggtagtaacttttgggccattgccatggcatttgtaaactgtcatggcactggtgggtgtgtcttatgccattgagcaatgagggcagctaaaggtcgttttctttgccatctgcttgttactgtcagtttcttcattttatcctggctggacaagattttgttttggtcatcggggttgtgaacggaataaaaagttctgccagtctctcaccttgtatagctgagttcataagttgttccttcatggaattttttttttttttttttttttttttgaggcagagtttcgcttttgttgcccaggctaaagtgcaatggcgcgatctcagctcactgcaacctccgcctccctggttcaagggattctcctgcctcagcctcccaagtagctgggattacaggcatgtgccaccacgcccagctaattttgtatttttagtagagacagggtttctccgtgttggccagggtggtcttgaactcctgtcctcaggtgatctacccacctcagcctcccaaagtgctgggattacaggcatgagccaccatgcccggccccttcatggattttaatcattgcctcacaaaccaccacttattaaattaaaggtctttactacttcagtaagtacatatttgtacttagcaaagggagatataaaatagtccagtgaaaacaagaaattcagctgaggatcttaatgtatttcttattacacatagcaagatcttattcttaaaatctttaaaattttttaaatcatatatatctggggcagggaggaaggagttcactgtgttcgtaagcttggcttcaaatatcaatagatgtaggcaagtaggtaattcttagatgacaaaataagaatgtgtattgttatgaaagctggcttttctgctccaagaacaataaagttggctggttggcaagataagagacagctggaagctgaagattaagtgtgtaagagtattatattttgaaatttgagaaatgacctcagcgctacttgctcctaccactctatctgcagcaaaactgtttataacattatgttccaggaaagtataggaaacagatctaccgacattgcacatgatgaaaactcataaattcaaaaaaaaatgctttctaataacatacagaaacaaggctaaaagttagaactacagttcaggcatctatgctggtaaagtccctaagccttattaatcaaattattagtaaatttgcaaaataaagaaatgacttacaattgacaacttcatgggcaaaagaactgaaattgtgggagaaaactgaaaatcacttctcaactatttctgtaatgtatgtcaatagcaaaacccagaattttcaaaccttattttccaaagggaaaactagaaaaagagctgcatgctgcacatttgttattaaggggactgattcgaaatcagtcgaaatgtaaagatgaagtttttcaccattgaaaattatttccagatatgtggattttttggctacagcaagataataaacagtttaggaacaaaaacagagctgtaaatcaccaccactcatgatccaggacttcaagtaatggtgaaaaatagaacaataattattgcccccgaccctcctaaaaacacgcagtcttctgcttggggaagaaaggagagagaagagaaagaaatcacagaaatagccaaagggaaaaacgaaagaggaaaaggtgcaaagcaagaaagcaggagagtgaagctgagttttatggctccttctgttccctggttgcgtgcacccatatcttccctggtctaaagagttctaaagatgatgtataagggagcaatgcaaaaatagcagagaataatttgggtaatttattaggtctgtaacaactctcattttcattatcatcacattaccttttacgttcactcttcccagcttgaagtgcaaaatgcagatggcaagttcctttgagaaagcacattgttttgttgcttaatgtttcaaaaggaagatgtataatgaattgagcataacacataattacagcttgttcactgtatttagcatcgaaaagttcatagccagatggaaacatctgacgaaaactaggagtgtctcttactaagcatgtgccaaaatatgtctaggacctaaatttatgaatcctgggcataagcacttttaaatagaaatgctaatagatatttgactatagtgtcaagaaaatccctgctctaatgaaaatgttcagatgtttcaataggctaaagcttgacaagaataagggatacagaattttgtagaccctgctgggtttttttttttttttttttccattagaaaaagaaggagaaaccgtggtatccaggcacagggaatacatttctggaagctgttttagaagaacacaccagcaaaagaaccaatacattctagttacattgtaaaatattagatgcttttattttattcaactattactcaatataaaatattgttcacagtcaaaagaaaagtcatccttaagccttttattagaatttttcataatgttatttagatagactcccagcatgcctgtttaagattgccttacaaagcagaggcaaaagtctaggctgtcttggaaaaagggttaaaagtaatttaggttttattccaataatatatacttcatagaaatggacttccgagtctcgactatatgtttataaaacctgaacataagaataattccatccctttcatccacctcacatttataagaaaaatagcaaatgtttccaattacttggtgtttgggatgagtgtacaatggaccctttcattttatgaatgtgacatttgagtaagttaagtttgtagatacggcatttcagcaagtttgttgtacgtaaagacattattgaaatgaggttcagaacatttgcattgcaatgtatctacttaaaaatacctttgtatcctcattaaaatcttagactccatccctccaaaacatacgcacacacacagacacacacacacacacacacacacaactaacttttcatagtgttagcaacgggagaaaagaaaaggacagataatacctcatcatttatttcattttatggtaggaacaatacagagatacaaaactattcgtgaaaacttccttgttgtccggtgtcaactgaacaagttagattgcatttactgtggcctttaatcacattctcctgagttccaactatgtgtaattcctactcaggatacctactgggatgtgtaatgggcatatcgaacttgaacatgcctcagacagaatttttgatacattctacctgtccggagctactgttctttgattccctaccaaattttcagttcatgagacctttatcaacacttttgcagcccaaaaatgtagtggatagctttgactcttttcttctctactaccttcatgctgccagcactccctctcccatatagttagtttattggattgtattattctacctcccttatcattgtttgtatgatttactacatttgtctcctaaacgaactccttgttttcattcttgacctgttaaagcatattccctaaaggccagctaaagggatctgtttggaacatatatgtttatgttctaggccactgccactttcttgatctaatttgtctcacattttgctttgttcactgactttcaaacaaactagtattctttctagtccatcagaagccaagctccttcttccctcagagtatttgtacatttcttctttgcataaatgctctaaatttacatttttcattcaggtattgtattagtctgttcccacactgctaataaagacatatccaaggctgggtaatttataaaggaaagaagtttagttgactcaaagttccacatggctggggaggccccacaattatggctgaaggcaaatgaggagcaaaatcacctcttacacagcagcaggcaagagagcttgtgcagggaaactcccaattataaaaccatcagatctcatgagatttattcactaccatgagaacagtgtggagaagcctcccccatgattcagttgtctccacctggcctcacccttgacttgtggggattattacaattcaaggtgaaatttgggtggggacacagccaaaccatatcaggtatcaagtcaaactttattttctcttgaaggatccccctactgactctcagctttgtcagtaaccagtatatcactatttcttctcagtaattgaacataactgtctgatactagaatgccatatttatctgttctaatattaatagaatgttatatttatttgatttacttatggcccatctttctctccatttgaatgttagttctctgagagcaaggaactcatttgttctgttcactgtatatccaacatcaggcactgagtaaatattcaaaatttattcttccaaaaagtcagcaaatttctgagatcaccccagtcatgacctgtgataaactttaatggcagatatccataagattaaacggcaggttcattgtttccagtcaaatacatgcagcatttacttttgcctaaagtattctattgttttttgctgtgcttgtccaaaattttattttttagtaaataagtgactctttgttgaagcatgaccaggacaaacttaatgtcttcagctggaccatgctttagacaggcttcttccttctctagctaggcccacccagcctctctttccttatagcatttactttagaaaactttcaatggaaaatcctttctcttccctttgagatgtaaatttaagaggctttttagcctcttatccaggactgtctttttcgaagaagtgggagccatccctttgaaatgtgattatcaagaatgatagtgcccctatcttccagtgtctatgaaagctaactagagggagccgtgttccaatttgtaaaactacttcctgtctgaagatacaagtttacacaaatggcctgaaatatcctccttcacctcggctactaataatcctgctgttggtttcagctgaattgagttcagactcagttctggtttcactccccttcaacaatagtgttcaataaactcttcgttgcctctttacctttctccagagccatttttgcttcagcaggttgaattaactaacagtaaaatgcagggatcttaagtggcatttcaagaagtttcaacaaatgtgtgagtccatgcaatccctatccctctctagttgtagaatattctcatcatcctaggaagttccttctcatgtgctttcttccaaactccagcttcatagaaacaactgctgatttatttccaccattatgactaattccatttattccagaaatgcatatgcatagatttatacaggatgtgtgtgctcttttctttctgggttaatttacacagcttgatgtttttgagatttattcgtgatgctatttataccagtattttatgcctttgtattagtgagtagtatgccacagtgtgactatatctgttggttgatagatagctgtggtttctccagttgggggttattatgcatgaggctgctaggaacattcgtgtataacgcttttgttttataaacttacatttttatgtttgggagatgaatcctcaggaacagaattgggtcataagagaaaatgtaagtttaaactgttaagaaactgcctaagagtttcccaaattgcattgctttacattttcatcaacaaagtatgagttctggctgtttcacatcctctccaacatctaatgtcaggctttttaactggaatcattttagtaagtgtgcttagtggctcagtatagttttaatttgcctttctctgattgctaatgatgttaagcactcttccgtgtggttattgaccatttacgtaacttcttttgtaaaatatctacttaaatttttcccatttatttagtggcttcttggtctatatattacctcttttatagtagtttttagtactctgaataaaaattatttgtcacatattttcataaaatatgcttctagaaccttcctccaatacatcaataaccaacccttctctgtagcccctcccttaatctatctatccaacacccattcaacttctaaactttcaacatactcatggatattaggtctcacctacaaaagctcaggtggcctaaacccaggtcacctacattggactcatcctaacccctgtagatccagaaaatctgagacaggtctcagttaatttaggaagtttattttgccaaggttgaggacacatgccactgacacagtctcaggaagtcctgacgacatgtgcccaaggtggttggggtgtagcttggttttatgcattttagggagacatgagacatcaatcaagtacatttaataaatacattgatttggtacagaaaggcgggacaactcaaagcaggggcttccaggctataggtatatttaaacattttctggttgacaattggttgagtttgtctaaagacctgggatcagtagaaaggaatgtttgggttgcaataagaggttgtggagaccaaagtcttatcttacagatgaagcttttagctagcaggcttcagagagaacaggctgtaagatgtttcttatcagacttaaagtctgtgttgatgttaatgccagagaagtataatgaggcatgtctgaaccccacttcccttcatggcttgaaccagtctttcaggttaaagtttaagagtcttgactgaagaggaagtccatttagatggttggggggccttagaattttatttttggtttacacccctcaatctcaggccataccaacctgacaaaaagctaatttgggatatgtcccttcctcatacaaagaaaaacctcttctccttcttaggcctcgtgggatccgtccagctgtgaattcccatcttcagcttactgaccaagccactctacatggcatcatgtgggtccatcctaaaaaccctggacccagcttgccccattaactcccatttcaaaaaaactgaaaaaatgctcttttaatggccccagcactgggactactcaaccccaccaagccctttactctgtatgcttattccaaccaagggcttgctcttgggctactctgtcagacatatggcaatgtcctgcaagccactacatacctctcaacataaccggactctgtcatccaaggttggccatcctgtttaaggattttggatgtggccatgctgctggcctcagaagcacaaaaactaaacatctactaacaccttactgttgcatcctctcataacctacaggaactcatgagccatcactccctcctttccctactgccatcctgcctacagcaaatacatgccttactcataatcaatctttagtcgccttccaaagatgcaaatctctcaacctggccaccctccttcctatgagtacctccaactctgaactgtctcactcttgcttggaccttttagattccctttctttccctttccaacacgtagaagaaacccctaacctgggacacctacatggcttattaatggaagtgcttttaaggaaccacatcctgagtagactacaccatcactgacaaaaaaaatggactcttggagtccaatctcctcccatcccataccacctcccaacaagtagaactagttgccctaaccagggctctcaccctagcaaaaggaaagagggttaatatatacaccgactctaagtatgcatactacatgctacattcccatgtcctaatctggcaggaaagaggttttctgaccaccaaaggaaccccaatagtaaatggcaggctaataggtaagctgctggaggcagctaaactaccactagagattgccattatccattacaaagaacatcaacgggctacaaacaccattgctaagaggaacaccttggtggattcgtagcctagcaggcagctcttaaaatcccctgactactatccatttttttcccagcatacaccctgtatatacccaggaggaacaaacctcactctcccaggctggcgccattcaggaaggagaattctatctcaataacaaaattctcctgcccaagtcccaggaaccctctgttctctcatatgtacacgagcattccatgccacttagtgccccctactccagctcttaaaaacttacatacattgtcccaccatggctgccaatctcaaaggtattactaaggtctgttccatttgcactcaaacttccccctcagggaaccatgaggcccctcctttccccacacaccaggcccaagtacacctgccagaacaggactgacaaatcaacttcacccacatgccccctgtaaaactggtccagtatcttctgacaatagtaaatacatccactggataaacaaaatgttttcctactaccaccaaaaaggcacacactatcagttctattctcttcactcatattattccccagtttgaactcccctcttccacccagccagacaacaggtcagcatttgtttcataggttaaccaacagctggtagaggctctaaacatcaaatgagtcttccatatcccctaccacctccaatcttcaggtaaagttgcaccggccaatgcccttttaaagcagcaactgaccaaactctccctagaggttaagatggcctggacttcacttctcccattggccctcatgtatttacaagccattccctgcaagcccctcagcctaagcccatttgaactcatgtacagacacccctttatcctccagaatctctctctattccccttctgtctatatgggatacttggccagcattacacttcattaaacatctaataaaacactacgctaacacttacttgcccaagcctgaaggctgatcctctgaatactcctccccctccctgcaaccaggggactgagtctggattgcagactcctcctcccttctccaaactaagtaaatgggtcctcaccaagttatcctaggtatttccatggtggcaaatctagcatcttttccacaatggatacaccattccaaactaaaaagagcaccagacccacatccaaaaatttccttaacccaaagatattcttcctccctcaaatcactgcacttaacaagaattccagaggttgtcagccctaaaggccctggcccataacactttccatctccaattttaaatctttcatttgataacttgtttcagatctttcctggtacccctttcccatgtcctgaaacagtccacttcaatttctcacactaatccagaagctatggttgcaaatcaccttccaaaatttcactcctactcaaatctccctttgctccctttgtcttctttgtttgtgagatgctctaagtccccacccacaacctttgacagttgagcaccctttgccaacctaatgcactacctcctcagccaagcccagtctcccctctcctctagttgctgaatatgcttatccacacaaacccaacagttttcctgccatccccacagacttacacacctggactcagtctagcatgaccctgcacctcatatataaggctgttccattttctgaaactttttataccctcggccatctaaacaccttccccccacagacatttttttcttttcaaaactctaaactcagggccgttaccctcctatgactccttactcctggtctatccctaatacaggcaaattccctcagaccacccactggaagtttcatttccacccagacatcactcacagttcaggtccccctctgcttttgcagatctttctccaaccccaaccatgggactctggtgggcagtctacctccatccctgtacaactttaccctcactttcaacccatgtcaggatcatcaaaatcaccaaataaatcactgaacaggatcttcctcagccttcaaaaatccactgcgattttctgcaacccccccttccatcttggcacccacttcttccatctcctccccacctctctctgtaggcgagactcacatgtactcaggttgaggaaatccactggagggaatgcaataactcctctctctcatgcttcctcctgcctagcccttcttccaactcacaatggctgttaatggacaaaacccattatttcctttttacaaaatcacacttccttcactccttcccccactaacatactttatcagtcactcaccagagctgtccttgaaggtaacttttcaatatgggagaataagaaaaatgtccaagagggtataaggaaaatggttgtgcttcagtcaggagtaggctgaggcagatatctggtacagcatgacacagcaggtttcgagtgcaggtgcataaacccctgctctatgtaatcagatttatgtagccatttaatgtaacctgtttgtgtgagctcatatctggctttgagtctcttttgtctgtgagaaatataactgcactgctgactctgtaggagagagacagaataaagccatgtcccaactgcctacagtccctcgagtgtactttcagctacctgccacctgtccaccagctcctctcaggccccagctcggattggaacctgacaattgatgtagtcatcaggatacagagccatgctgctaggatgggctctggtgaaaacatgggtggtggtggatgggtcccctgtgagtatagagaaggcactgaagcacctggaagcatagagcactgagaaggagcacgcctttgccagcagagttggatgggcatttttgactgtgatacaggaagtgcatgctcagtccctgtgggatgcagtacaggtaagggatttccagacacaagcaggacacctggaggcccggatacacagcttggaatgtgaattaggggctgctgtcctcactccatatgtggggcgtcacatacatgaggtgactactgccatggcagccctcagggaagcagagggccattggcaggactgggggtatgtgccataaaaaaggggaaagcaccacttctgcaggggaccacctcatggaacaagaaggggcgccagcaggttacccacatgcagatatgggttgatttaattttggctggggttgccagagagaaaattgataggcaacccaatgaagtgctgttaactttgtggaggcaattgtccccaaagcagcaattccagaaaatgggggcaggatgatgctgcttgacccagtctcacccagctgttccagctcaaggactacttgcagacaggtggtggtatagagctttttggtttgattagggagctggccaaggtgcctgccttgagggggacaccggatgactgaaggccacatgtggaattggcaatccactggtgagccctagacctactagccgctgagaaaggggacacatgtatatatctccaagaagaatgctgcttttatgttaatgaatctgccattgttcatgacgcagcccgcaggctccttgatagggccacagaaatccaacgtcaagtcagagacttctagtggcaagggtaatcccttctaaaatggatgatgtgggttgcccttttctttgggcccctaatctttttccttctgtgactaacaattggccagtgcatacttaatgttatatctcacttcatctcccaaagactgaactctcttatccaggcaatcacccagaaatgtattgatactgtcctcctcctccaccaagtccattgtcagagcctccaggaaagcgactctgaaatcaaacacctaccactttaaaacctgaaccctgattacaatgcccctattcagcaggaagcagccatgtccccttccttttatactaaagtaaaggacaggaatgttagcccaacctgtgccatcttgtagaccccgccattttacacaccctggacagagtgaaaaattccactgggtctgggccatgagaaacatcctgttgggcaggtcccaggactaagtgcctgaccatgggaaatttctctcttagcagcagctacccacaccaccccgtcccattttgcaacactcccctacccatccagacctataactgccctcgtctataagtggggcttgggctttggcactcgctgttgtccccctctgcaagcatcttcctccaataaacctgtgttgctgtggagccatgcctcccacccccttgtctctgtctctttttcatcccaacaattatgagcctatatcctgtcttcattcctgtggctttattgtaataataaaattcagatatagtaagtactcgaactcagttcctccatttcaagattgttttggctattctagtctttttatatttctgtatgttttacagaccatcttgtccatttttacaaaaaacaagcaagctaggattttgatatggattgtactaaatctctaccccaacttgaggagttagatttaattgtgtcttccaatacatgagtgtgatatgtatctgtatttgtttaggtcttctgtaatttctctcaacaatgtttcccacttttcagtataaaagtagagagacatttggtagacaagtagacatttggtaaatgtctaatcacgttatggttttagaaagtattttcatattgtaattttattacatttcccaattattcattgttactatatagaaaaacaatatatttttatatttatttggtattttaagactgctaaattcacctagtaattatgattattttttggtaaattatttaggatattctatacagacaattatatcatctacattttcttgttatctattgcaacttaattctctttcaggtaaccagccaagcatgaaagccatcctgtgtccattcttttatagagtagagatagtcatttttggtatttagttcattcttttttttttttttttgcaaactctgctctctgatgaccttagaagaaaaaacaagtattttttttttagttggcttattctcattagtaggggaggagaaattctcatttgaaaacttctccagcctaagaggaagcagaaatcctctttttattgtggttctttgtaattataaaatcaatattatgtttattattttaaaagtttgtacaaatacaaagaataattaatgttatactaatggtcccaccaccaaaaattaaaaaaaaaatccttataatgccattagttaatttttgtaagattaaagcattttaaataaaatcaaagaaccacaaacctgtcctcactccaccctccccttgtcctcttattcccagagatttcactgctataaatttactgtgtattcacctcacactttaaccacaggcataaagcaataaagctaatattacttctaaaaaattctgctaaacagtatcatagtgtgcaaataactctgttttcaaaaatgatacttttcaagatttatttatgttcatatacagatctaattaattgattttaacatatacgctattataaatacatcttaatttatctattatatatgataaacagttagataatttcctttctttcctttcttgttttttgttttgtgttatttatttgtttgttttggtaatcacaaccagagccacaatatgcaacattttattaattttctgaaacacatgtattagagtttcttcaaggtccataccagtctaataggaattttctgtgataatgggactgttctatgatctgtgctgttcaatatggtttccattaggcacaggtggcttcctgagctcttgaaatatgggtagtgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaagaaatatgggtagtgagactgaataactacatttttaattttattattatttttcattatactctaagttctaggttacatgtgcacaacatgcaggttgttacatatgtatacatgtgccatgttggtgtgctgcacccattaactcatcatttaacattaggtatatctcctaaagttatccctcccccctccccccaccccacgacaggcccgggtgtgtgatgttcccctcctgtgtccaggtgttctcattgttcaattcccacctatgagtgagaacatggggtgtttggttttttgtccttgcgacagtttgctgagaatgatggtttccagcttcatccatgttcctacaaaggacatgaactcatcattttttatggctgtatagtattccatggtgtatatgtgccacattttcttgatcccgtctatcattgttggacatttgggttggttccaagtctttgctattgtgaatagtgctgcaataaacataatgtgtgcaagtgtctttatagcagcatgatttataatcctttgggtatatacccagtaatgggatggctgggtcaaatggtatttctagttctagatccttgaggaattgccacactgtcttccacaatggttaaaccagtttacagtcccaccaacactgtaaaagtgttcctatttctccacatcctccccagcacctgttgtttcctgactttttaatgatcgccattctaactggtgtgagatggtatctcattgtggttttgatttgcatttctctgatggccagtgatgatgagcattttttcatgtgtcttttggctgcataaatgtctccttttgagaagtgtctgttcatatccttcgcccactttttgatggggttgtttgtttttttcttgtaaatttgtttgagttctttatagtttctggatattagccctttgtcagatgagtagattgcaaaaattttctcccattctgtaggttgcctgttcactctgatgaagcaggtttctttcgctgtgcagaagctctttagtttaattagatcccatttgtcaattttggcttttattcaattaggaaaagaggaagtcaaattgtccctgtttgcagatgacatgattgtatatctagaaaaccccatcgtctcagcccaaaatctccttaagctgataagcaacttcagcagagtctcacgatacaaaatcaatgtgcaaaaatcacaagcattcttatacactaataacagacaaacagccaaatcatgagtgaactcccattcacaactgcttcaaagagaataaaatacctacgaatccaacttacaagggatgtgaaggacctcttcagggagaactataaaccactgctcaatgaaataaaagaggacacaaacaaatggaagaacattccatgctcatgggtaggaagaatcaatattgtgaaaatggccataccgccaaaggtaatttgtagattcaatgccatccccatcaagctaccaaagtctttcttcacagaattggaaaaaaactactttaaagttcatatggaaccaaaaaagagcccacattgccaagacaatcctaagccaaaagaacaaagctggaggcatcatgctacctgacttcaaactatactacaaggctacagtaaccaaaaaaagcatggtactggtaccaaaacagagatatagaccaatggaacagaacagagccctcagaaataataccacacatctacaaccatctgatctttgacaaacctgacaaaaacaagaatggggaaaggaatccctatttaataaatggtactgggaaaactggctagccatgtgtagaaagctgaaactggatcccttccttacaccttatacaaaaattaattcaagatggattaaagacttaaatgttagacctaaaaccataaaaaccctagaagaaaacctaggaataccattcaggacataggcatgggcaaggacttcatgtctaaaacaccaaattttataaattttaaataaacataatttaaatagctacatgtggctggtgtctaccatatttagagagtacaggtctattccaaggaacagaattattagataatcaggtatgcatatttaagcattactagctaatgtagaattgctctccagaatagactccaatgtttgttttcaactgcctgtaatatgcaatgatctatttccccatctccttggctatatacttagttttattagtttatacattttttagataatttgatgagtataaaattgtatctcattaacggttgatttgtaattccctttgtggtgctgtaatactcatacatctatcaaggactcttttttcctccctttaaaattatctacttattttttctttgtaagcgtcatctttttttcattgtgggagttcttcataaacttgtcattttacttgataaaaggtcatacttaaaagtctgaggcttctcattcacttgaatctgtagtcttttgttacatagttgtttaaatttttgatacatatctatattttccctcattgtttcaagtgttagtgcctttcctaaggaaccttttcttattatgatgtcacaaatgtattctgctatgtctactgggagaatacactagtggggatagttctgtgtatacagtgattaagcacataggttctggagccagtctgtttctttcaaaatcacctcattgcttttgaagaatcaggtaagttagtcaacttggtgtttcagtgcctttgtctgtaatgacaaaaaagatagaaatgacgatattaataatacttacctcacagaattgttctgaggtttacacgtgttaacaaaatggaagagttagtacaacattcagcatgctatgttagctattatcattctaaatgtttagctgtgttttctttttttggttggttactgtacatatattatatgatgaatctgttctatcatctttcacatgcatatccaaataactaaacattcttcagatgaataatgtatattattttcatcttgaagtttttgtctatataattttagatattcttttctgttccattgctttctctatttttgtgccaaaactgttattttatttagcataaactttatagcaagccttgaagttctgttcagcaaatttttctgtgctcttattttttttttgtcttaaaattttttttggctacttaatccttataattctgcctattagcattgcatcagtttgagttttgtaatgacattaaaaaggtatttatgatatcagtattcctcaccataggatatttattcatctttagttcatttttatgaccttcaaaaagttgtttaatttttcccataaaagctttgtagatatatatatatttaaaaatactctctttggtggttttttgctatttaaagtaggtttatactgaaattataattttaattgtctgcaatatatgtagaaaattattacttatagttgtatgttaaccttttctacaggcattaatggttatagctaggataaacatcccattgggttgcagcagcatctggttgtacttaagctttattactggcacctgaaaattttcattttttttctttctagctcagcaatgtatttaattttttaaagatatggtttatactatattcttcccagaaaagaagagaagtctgttggtttgggtccattctttcataatgtttgaacttaaattctctatataaattttaaaattattgattcatgttccataaataactgaagatttccttcttctttcataaatatgtaaataatttgtagctaattatcttttcaatattgaatgttcttctcattaaaaataatatgtcccaaatcatacagatatttatgttcataaataacattttgttctagttatttcccagttaatattttttaattattgtatattttccatctactatagtataacttggttatttctgatggacaagaatgaggttttttttagatgtaaatcttcaatccaatgtatttggtcatagaactgtgagttaacaaatactgttttaagctattaagtttgtaataatttgttatgcagcaatagaaaactaatacaattgacttgcttctaactttaataagttaaatgctctacaattatgtcagatgttttctttaggatcctagtaaatatattttatcaaattaagaaactttgtttctgtttctcatttatgattgtttaaattaaaaatcaatgtaaaattatgtttaatgcttttctgcatctgtaatataatcatatcatatttctcttttgatatgttactctggatattagtagtgtttcattttctaatactgaatctgccctgcatttctggatcatgattacatttctattattctatattaagctaataatatgtacttgtcacttatctctagaatctacctatgatgagtgttttctcttagttttatatcttactggacattatttgaatcatcttaaggcactgggtagaagtacttagacaggtatgctcaggttgatatcccatccagaagttgtaataattttcttgtcaaagttcatctttgcccaagggccttgaagtgaataaaaactatggcaagatactgccataggttggggttttttttgagcaagcagatttgaaaacagttgagcacacagttgagcatccactaacacttgtggaagggaagggaagaaagcaggattgggcagagtaggaagtgaagctacctgcagtcccaatatcagtgtcagcctgggcagttcttgagttagaatggccatccagagttgtctagactgcacgtgagccatcccaggaaggacataacctcgcggaaagtggctttctgaagctgagacaattccctgaagtgctgacatctgaaagctgtctactgtcagcactcccagcaactgggacaccaagtctttccttgaaatgagagttgggttatacccagagtatccactacagacatgtatgaagagacaataaaacaaaacttctgcagacttgaatgatccattcaggcaaggacaatgctgatgttggctgtcctaaatgggatggcctggcactcttgaaaaatctcaaatacattaaaaggaaccttgtgtattaccatagatataaacatattatgcattgctttgtataatgcacctcttgcagaatgactatcagatattttcagtgtttagagtttcttccttctctgaaatgtggaaggcttatcatggcctaagtaaccttccagccaatgagaggtaggaaattattacatatcctgagccataattattccaactgcaaattttataaaacaaaagtaaatatcttctggtatgtgaggttttagctgcaacaaggctctcctccagtgccgtgccacctggatggtatagcttaggatctgtgcagacaagagaatgtcaagtttctctccagcccagctcaaatggacaaagaggtcattttatattttatcacctaagaatttgatttgaaaagaggatcagaaaccacaggaaatttgatttatgccagccctgcatccaaggtacccacagaagaataatatacttgtttttatgagatagtactgatccaaatgggggcacaatataaaaatggcttatggtttggccacagggtcagtccaaaggtcaaagcctcaagtacagttcatttgttagcagatttcagaacaactaatttcacctgtattggatttatttttccagcctcttcaaaaccattttgtttagatttatatcacaacttccctctctttttttccatttattaaatttgaaaagctttccaaatactgtttcaccaacttgtaccactatacaagtgacaaaacttttattaaaaccatttttttttagagtaaatctggaaaataaggaagtaaaacaattactttgggtctgagttttgatggataatatagtctagtttgaaaacctaactacacacatttgccacactaatatttttgtatactttggcaaatggttaatatctttaataaatggttaaattccaagaaaaattttggctcacaagctttatttcatttcttatgttggacctttacagttatcagtccaaactgttgatgattcagtgtctgatatattctgccttccagaaaactttaatccttcttgtttacctcaaagttcaatataaacacattcagtgcaaagtcttatctaaaattcacgttgttgaaaaagacattttccttattcatgtaaagttactcatgtaaaaatatgaaacatcaagagtagtgtctcataaattttgtgtttcaaatggaaagactttacatgacttagacttaatatggcttagattgtgtggctaaaaacataaataggtaataagtcaaaacaggctaagtggttattgatatccattgcttaatttagaatatgacaacaatgatttatcttatatttctttttgaggagaaataataggatgcagaagagattcagtatttttagaggtaaccagaatgcccttggaaagttttctttttttttttttttccagagatggggttttgacatattgcccaggctggtctcaaacttctgagctcaagtgatttgcctgcctcggcctccccagttgctgggtttacaggcatgagccagcatgcccggccccttggataagatttttttttttaatactttaagttttagggtacatttgcacaatgtgcaggtttgttacatatgtatacatgggccatgttggtgtgctgcaccaattaactcgtcatttagcattaggtatatctcctaatgctatccctcccccctccccccaccccacaacagtccccggtgtgtgatgtttcccttcctgtgtccatgtgttctcattgttcaattcccgcctatgagtgagaacatgtggtgtttggttttttgtccttgcaatagtttgctgaggatgatggtttccagcttcatccatgtccctacagaggacatgaactcatcattttttatggctgcatagtattccatggtgtatatatgccacattttcttaatccagcctatcgttgttggacatttgggttggttccaagtctttgctgtagtgaataatgccgcaagaaacatacatgtgcatgtgtctttatagcagcatgatttatagtcctttggtatatacccagtaatgggatggctgggtcaaatggcatttctagttctagatccctgaggaatcaccacactgacttccacaatgattcaactagtttacagtcccaccaacagtgtaagagtgttcctatttctccacatcctctgcatcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcacccactttttgatggggttgtttgtttttttcttgtaaatttgtttgagtgagctcattgtagattctgaatattagccctttgtcagatgagtaggttgcaaaaattttctcccattctgtatgttgcctgttcactctgatggtggtttattttgctgtgcagaagctctttagtttaattagatcccatttgtcaattttggcttttgttgccattgcttttggtgttttagacatgaagtccttgcccatgcctatgtcctgaatggtattgcctaggttttcttctagggtttctatggttttaggtctaacatgtaagtcttgaaaccatcttgaatcaatttttgtataaggtgtaaggaagggatccagtttcagctttccacatatggctagccagttttcccagcaccatttattaaatagaaaatcctttccccattgcttgtttttgtcagatttgtcaaagatcagatagttgtagatatggggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctctttgttggttccatatgaactttaaagtagtttttgccaattctgtgaagaaagtcattggtagcttgatagggatggcattaaatctataaattaccttcagcagtatggccattttcacgatagtgattcttcctacccatgagtatggaatgttcttccatttgtttgtatcctcttttatttcattgagcagtggtttgtagttctccttgaagaggtccttcacatcccttgtaagttggattcctagctgttttattctctttgaagcaattgtcaatgggagttcactcatgatttggctttctgtttgtctgttattggtgtagaagaatgcttgtgatttttgcacattgattttgtatcctgagactttgctgaagttgcttatcagtttaaggagattttgggctgagacaatggggttttctagatatacaatcatgtcatctgcaaacagggacaatttgacttcctcttttcctaaatgaatgccctttatttaagatttttttaaagataaaaataagactgtagtgggagatgaacgatgagaatacatggacacatggggcagaacaacacacactggggcctgttgtggggagcagggggagggagaataccgggaagaacagctaatgggtgtggggcttaatacctgggtgatgggttggtctgtgcagtaaataactgtggcacacgtttacctatgtaataaacgtgcacatcctgcacatgtaccctggaacttaaaagttgatgtgaaaaaagaaaacatacacacacacacccatacacacacacacacacacacacacactcacacacacactaaggatttccagaattaattcaatggataattagctggttatgaagccaaaaacatggccctgcccctggtttatagagatatagatggtatagatatagatacagatatagatatagatatccataatgtgaataaaaatagggctgtaagaccaccgatctagaaaactctcagaataagcagaaattaagtcatgttatttcccttcaggttagtgcactgaccatatattgagataggctgtgacataatgtgtattggagttgaaatactcacagttgccaggcgcggtggctcatgcctgtaattccagaactttgggaggccgaggcgggtggatcacgaggtcaggagatcgagaccatcctggctaacatggtgaaaccctgtctctactaaaaatacaaacaattagctgggcgtggtggcgggcgcctgtagtcccagctactcgggaggctgaggcaggagaatggcgtgaacccaggaggcggggcttgcagtgagcggagatcacgccactgcactccagcctgggcgacaaagggagattctgtctcaaaaaaaaaaaaaaaaaaaaaaaaaagctaaaaagaaatactcctagtccccattatttagaagagattagattcttagattttcttaaactaaaattaaagaagtatatctgaactccacagagtggaaaacatgtcttaatgagtactcagtggttgttaaagtaagggcaatgactagaacaaaaactaagaggaaaacatgccaatccatcttgctagaattttaagacaatatgccaccttcattctctctttctctctcttttcctctgtcccctaaactgtatgctgctcattacctgtcttgcctccctcccttcatctccccagcttgacacactttcccttattttattatatgatttattcccatttgtggaattttccaagtgacatggagaaaaggttatcctggggcttcatcaaaattcttctctaagactgtaagaataaattaaagcaggcgtgtggcatctctgctggtggggaatggctacccatgtttaacagtgtaacttaatattaacaaaattaattgctaggcttgagtactctccagctcacatcaaaagtcttcagcctactgttccaagtatatattttcagcatggttttctagtctatataatgtagatactaattaagtcctgtggtcatttttttccaataatagcttgtttccaatagtaggaatggtttttattggtttaacttatatttttctatgtttatcatcacatctcttatgtctgattccaatttaccaattattacggtttaacagccaagttttaaatattaattatatttatgttttaaatatatttgttatatatactatatataacatgatatatagtatatataacatgatatatagtatatataacatgatatatagtatatataacattatatataacatatatagtatatataacattatatatatatatatatattatatatatatatatatatatatctcccagaaatttgacaacattttttattccaaaaataaaagcatccagcaaagaagccaaaaacatggccctgctcaggtttaaaccatctgacttcagggacataattacaggcagaaactgacttaggtccaattatgtgcagggatctagctgggtgcctcctgtttcttcaaagatgagtagccagaattagaatttaaattgtcagctcaaagaaacacaggatgtatttagtttctgctagttaaagagtcatctgagaacccagaagggaagactcatgtcattgatatatttctctgagcttgatcctagtttttaggttagaaaggggtcctaggttcctgagaaactgtaaacttaacactcttttcaattactttgtactttatgaaataccttatggccagagcctgctattcaatgcaaatgaatgtaactctattctcccacattgcacataagggatggagtgtggaggggggagggaaatggaggggaaaatgaaaatctcttgaaataataatagtaattagtttctctatttgaaaactctaagtttcattaaacagcaataataaccagcagtaagtaaactgccacccccaggagagggaaaaatgtcaaatttcatcctaaaaagacttgtgaaaacacaggcacagtcaattccattttattctgaagatttatttcataccagtcaaaattaattcaaacctgtctccctgatgcaatgagtgtgaagaactaaacttactgtcattggattttgctacatctcaccatctctaaatattgaatatggatggcagaaaaaagctattgtttgaaatttgtgttaaggaagctttagttcaaaaaaaatgctgatacaatagtgtgtgagcatatgtgtgtgtgtgtgtgtgtgtgagagagagagagagagagagcgagagagaaccagagagaaagaaccagggaaagagagaaaaagagagagattttccttttgggggatctatttctgtatatacacctctcctttgtatcatataaatgtaataaaaccagggaaggggggaggggctcattttagccttcctgaaagaaaggctttagtgctaaatgttatgtaaaatgatttcactcaccactaaagaagtgacatatttgaaaaatgatacggcagttctttgaaattcactaaggagttccagaattaattcaatggataattagctggttatggagccaaatcacaacttgcatgttgcaattaaaatagtaaacaatcatttcacttactgtatgactgttttccttgtgaactgaaaaaatttattacaaaatatgaaatcagggaacctagaatgtacatatttacaggtatttatggaatctcaaattctattccaggtgaatttagaaaaaaatagtttaaacaatagtcaatattctttctttgacaaggcaggtaccctaattccgctacctgaagttggcataatatctattaacagctaatgccaaaatcaaaaaaattctataattcacataatataatagacaataatgttaatgataggtaaaatgtatgcctaattcatttaaacagattcccttctcttatcacccatcaatccaattacagcaaaacccaaattagtaagcttttaccagtatcatgcattgcatacattgtactaaatgagaacatagtatatacacataaagaaatgctttcaagtgagtttgaactacccttcttttggggctccagaacaaatcagcacccatttggccttttaaaatccattaaaaggttggtcagtatcttcttagtgattagtaaggcagccaacactctctcccatgctttgtcaaaggtcagacatattgcatgtcttgtctctcctaagaggggtttgtccatctttggaatctttaaacatgattcaggtttactagcctcagctctctgatgggctcaaaaaaagttatgattccaccaattatctagatttttcttgttgcaagtgaagaagacactattttaatagtttcctacatactatgcagaactagaggtgacctaataaacatttgtgtgtgtgtgtgtgcgcgtatatatatatatgtatatagtatatatacatatatacacatgtgtatatatacgtatatacacacgtatatacgtatatatgtatatatgtatatatacatatatacatatatacacgtgtatatatgtaaaaaaatacatacatacgtatatatgtatatatacatatatatacgtgtatatatacacacacatatatatataattttttttttttgagatgaagtctggctctgtagcccaggctggagtgcagtggcgctatctcggctcactgcaagctccgcctcgcgggtccacgccattctcctgcctctgcctccccagtagctgggactacaggcgcccgccaccacatctggcttatattttgtatttttagtagagacggggtttcactgtgttagtcaggatggtctcaatctcctgaccccctgatccatctgcctcggcctcccaaagtgctgggattacaggtgtgagccaccgtgcctggccacacttgtttatatttttaattgttgtaaacattgttcacaataggtacataatattccacagcaattatctaccataatttacttgactattgcactgttgttaaatgtttttttccacttttttaccattaagaaagaaattgcagtaagtatgtttatgcacatagcttattttttattcagtattacttccttaggacaggtccataaatacaaaatacttctttaaaaaagaatagggtcagactccaactgatgggtttgaatcaagttctaccattgattgtctgtattcttcaggtagttgggtaaccctccaagcattttttgtaaaatattttcattttgcaaaataataatagtagcatctgtctcttaaagttgctgtgacaagtaaatgaaatagcacaaatgcagtgcctgggagtggatcatcataagggaagcatgcaattattgttattataagataatctttttatagatttttacaaatgactttccataattattgagcatttcacaccatcctaaaatgtttaacaaaggcctgcctttagaaatcttttatatttattttcatccagaaaacataagttctcttatgtacattgttttattatcacatatgttgtatgatatagtcaaaacgccagggctatgtatgaaggcaaatatacttgggatcaaatcctggtttcgtatttaaccatttacaaacttggaatttatttttaacttctcgattttcaagtccctcatgatattaataattactcctagtcattaaaaggattagaaataatataggtaaattacttagacatattgcatactcaaaataggcttctcatcctaaatgcacattagaattacctagagatctgatgtccagctgcatcccaagccattcccatctaaatttggaggctggccccaagtcagtatgttgttacccctccctaggtgagacaaatagtcagctggtcaaaccactgcctccttaccatattataggcttaataacaaccaaaatgcataaatgactttataatttacatatcacttccataaacataatgggatttgattactacaaaatatttgaagcattattttcattgaaaattcttatatttttacaaatgtaagtggattatgaactatgataatgagtaatgttggcacaattccctttgctctatctcaaattcatggtatttcatgttagctcataaaattgacaccagatctgtttacaaatctcttgtcacatttatatcatatatcataacacctcaagcacaaagtttttatttaaaaaagccagtcaaatccttcacaaaatctctgattttcttctgcctcttattcagtgacctgatcatagatacatagacagatggataaatagatagaataccaaaagttgcaaataacttcatcttatatgtaacctgccaccccccaccctttctttgctatgaacaccaagaacctaggtctataggcattaaaaacactgttgaaacttgaaaagagtaaaataattggttgggatttcagaaacactgatcttcatacagaatccaacagaaaggccctactgatgaatgaagaagtggctttctagattattgtaaaacaatgattttgtaaaacagcatcatgtgttactcccttccactactaaaaaaggtacaacatgctttttctggcccctctgtgtatgactacttgacttagataactcatattgtcctgtaagtttttacagctcagttcttactggattttgtattagaaccttataatttaagaaaataaaaaaggtattttcttggactattgaaaaagtacctgtttggggctatttcaaagatacatggagtcccaacatattaatacttgttaaaataagagtatcggtgacataatggtatagcttgaaaagcaaacaatatatctttaaaataaattatacaggtttaatagaaaatgatacctcaatatcactggccaatgtgatataaaaagtctagctgcatttagccaatagatgcgactattttggcctctaaaatttctactcctgcttctaagtgtccttgttgcctgtttttagatatcacaatattatgaaacattccaaaagatgcatacaaaataaaactcttctgctgactcagcttctgttgtatctcaacccaataatgatatgttgagaattaagactctgtctactatagcatatattttaattatacttttataaacctgaataaaatataattaaaatgtacttactatagagctacaatagagctacaatatgagaagtctattattttaatgcacacattatagaaaatgtaattgacttcttaacaaaaccagaaactctgcctcataaccaggaaaattaatctctacgctgggtagatttattaggagttattattatcctaagctaaaaagttaaaacaagtaaatattttataaggggtcattattaacaaatgtacattgattccctcctcttcccagattttttccaccctattgttcacttaagggaaaagcaggttgatttacttatttcaatattttcttctcaatttgtgtctggaaagtaccttgtgagtatgatctctaatgtttcttgctgacatgtagcaggattattgctgtagatttaggaaaacagaatcccaacacagtgtacaagatggtgctccatgacatgccacttccaaagacataaatttttccttagcaggagcacaatgcttcttgttattgtaaccaaattctcattgattaaaacaaaaactcagcctgcataagtaaccagctgcaattagttatttaagctgtatctactacacaaggcaatttttatacagtagtgcaagcaaaaaaagatcactttatctttctttttctatctatcattataaatccagagaaaaattaatggttcttcagaaaaactactttttaataagtcagacattcttggttaaaacaaaaatgttgatgaaatgtttagtatggtttaataaaaataaaagctaaagtatatatggagttggggggttttattcaaataatttatgacaatcatttgatgaagaaaatcttattaactattttcaatttgggaataaagaggtagctaattacctcctcaaaataggttaaaacatgggattaggttgctcaagagagataatagttgtttacaagaaatacaatttctatgtctgtaaatattttagctgcttaagtgtagtaatccaatagacaagctgtctgtatttttaaaatataaacaggataatttacatttgacaatgtctagtcagtataaagccaaaatgttgctagtcagaagttgtcaggggtaattgacttcaaccttatatttttctttttaatacctgacaatttacaatatgagctttcccttggaaacctcctcattttctctggactgtctgcccggaggaacaccgagtggctaattcacagtttgccttcagtaaattccgtgaactggttgttactagaaaagcaatgtaatgcttgtgtgattgatttagtcaggtaaaataacaacgtgtgataattggtcacttgtggttggaatactagcacagacttccacatggatatcataatcccagtgactacttgcccatattaggagagtctggtcatctatgaaagctaacagccagcaagggaatggctaagatcccagcggtgagtgtataattaattcccaaggactccacaggacactttctcttctctccagaactttatagatgaaggcagagtattatttgtaaaagctctctgcttgtcctcagtcaaggtcatgagaatttcagaaataaattcacaaaatggatgcactgcactcaacatcttcatgtgttaaagatacaaataaaatttacctggaaaaaatagccactgatcatagacagagcagaagtactttcaagaagactgaatccatgctttgcacaattaagcagtgctacccacccagtgaggatgccttatagtagctcatattttcataacaaactgactggtaaatttaaatgaaaagtttagtgggtacaacagtgagtgacctgctaatgagttgttaaatcaaagaaataaggaaagtaagataaaaagaatagcttatttaagcaaaaatcacaagtctaataagacacagcggctacatagcagtttattctaatccaaagctatacttcgatttataaaaagggagaaaacctacataatatcctcaataaatgtcttccatgtctgttgggatagaatgttgcagtagttttgctatagcttcaaattcaaaatgcacaatattaagtttgttttttttaatttaatttaattttattattattatactttaagttttagggtacatgtgcacaatgtgcaggattcttacatatgtatacatgtgccatgttggtgtgctgcacccattaacacgtcatttagcattaggtatatctcctaatgctatccctcccccctccgcccaccccacaacagtccccggtgtgtgatgttccccttcctgtgtccatgtgttctcgttgttcaattcccacctatgagtgagaacatgtggtgtttggttttttgtctttgcgatagtttgctgagaatgatgatttccagtttcatccatgtccctacaaaggacataaactcatcattttttatggctgcatagtattccatggtgtatatatgccacattttcttaatccagcctatcgttgttggacatttgggttggttccaagtctttgctattgtgaatagtgccgcaagaaacatacatgtacatgtgtctttatagcagcatgatttatagtcctttggtatatacccagtaatgggatggctgggtcaaatggcatttctagttctagatccctgaggaatcaccacactgacttccacaatgattcaactagtttacagtcccaccaacagtgtaagagtgttcctatttctccacatcctctgcatcacctgttgtttcctgactttttaatgatcgccattctaactggtgtgagatggtatctcattgcggttttgatttgcatttctctgatggccagtgatgatgagcattttttcatgtgttttttggctgcataaatgtcttcttttgagaagtgtctgttcatatcctttgctcacttcttgatggggttgtttgtttttttctcgtaaatttgtttgagttcattgtagattctggatattagccctttgtcagatgagtaggttgcaaaaattttctcccattttataggttgcctgttcactctgatggtagtttcttttcttttgctgtgcagaagctctttagtttaattagatcccatttgtcaattttggcttttgttgccattgcttttggtgttttagagatgaagtccttgcccgtgcctatgtcctgaatggtattgcctaggtttccttctagggtttgtatggttttaggtctaacatgtaagtctttaatccgtcttgaattaatttttatataaggtgtaaggaagggatccagtttcagctttctacatatggctagccagttttcccagcaccatttattaaatagggattcctttccccattgcttgtttttgtcagatttgtcaaagatcagatagttgtagatatggggcattatttctgagggctctgttctgttccattggtctatatctctgttttggtaccagtaccatgctgttttggttaccgtacccttgtagtatagtttgaagtcaggtagcatgatgcctccagctttgttcttttggcttaggattgacttggcaatgtgggctctttcttggttccatatgaactttaaagtactttttccaattctgtgaagaaagtcattggtagcttgatggggatggcgttgaatctataaattaccttgggcagcatggccattttcatgatattgattcttccaacccatgagcatggaatgttcttccatttgtttgtatcctcttttattcctttgagcagtggtttgtagttctccttgaagagctccttcacatcccttgtaagttggattcctaggtattttattctctttgaagcaattgtgaatgggagttcactcatgatttggctttctgtttgtctgttattggtgtagaagaatgcttgtgatttttgcacattgattttgtatcctgagactttgctgaagttgcttatcagtttaaggagattttgggctgagaaaatggggttttctagacatacaatcatgtcatctgcaaacagggacaatttgacttcctctattcctaattgaataccctttatttccttctcctgcctaattaccctggccagaacttccaacattatgttgaataggagtggtgagagagggcatccctgtcttatgccagttttcaaagggaatgcttccagtttttgcccattcagtatgatattggctgggggtttgtcatagatagctcatattattttgagatacatcccatcaatacctaatttattgagagtttttagcatgaagggttgttgaattttgtcaaaggccttttctgcatctattgagatatcatgtggtttttgtctttggttctgtttatatgctggattacatttattgatttgcgtatgttgaaccagccttgcatcccagggatgaagcccacttgatcatggtggataagctttttgatgtgctgctggattcggtttgccattattttattgaggatttttgcatcaatgttcatcaaggatattggtctaaaattctcttttttggttgtgtctctgccaggctttggtatcaggatgatgctggcctcataaaaggaggttttttctattgattggaatagtttcagaaggaatggtaccagctcctccttgtacctctggtagaatgtggctgtgaatccatctggtcctggactctttttggttggtaagctattgattattgccacaatttcagagcctgttattggtctattcagagattcaacttcttcttggtttagtcttgggagggtgtatgtgtcaaggaatttatccatttcttctagattttctttttctttttatactttaagttttagggtacatgtgcacattgtgcaggttagttacatatgtatacatgtgccatgctggtgcgctgcacccactaactcgtcatctagcattaggtatatctcctgatgctatccctcccccctccccccaccccaccacagtccccagagtgtgatattccccttcctgtgtccatgtgatctcattgttcaattcccacctatgagtgagaatatgcggtgtttggttttttgttcttgagatagtttactgacaatgatgatttgcaatttcatccatgtccctacaaaggacatgaactcatcatttttttatggctgcatagtattccatggtgtatatgtgccacattttcttaatccagtctgtcattgttggacatttgggttggttccaagtctttgctattgtgaataatgctgcaataaacataagtgtgcctgtgtctttatagcagcatgatttgtagtcctttgggcatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttcatttgcatttctctgatggccagtgatgatgagcattttttcatgtgttttttggctgcataaatgtcttgtttggagaagtgtctgttcatatcctttgcccactttttgatggggttgtttgtttttttcttgtaaatttgtttgagttcattgtagattctggatattagccctttgtcagataagtaggttgtgaaaattttcttccattctgtaggttgcctgttcactctgatggtagtttcttttgctgtgcagaagctctttagtttaattagatcccatttgtcaatcttgtctttttttgccattgcttttggtgttttagacatgaagtccttgcccatgcctatgtcctgaatggtaatgcctaggttttcttccagggtttttatggttttaggtctaacgattaagtctttaatccatcttgaattgatttttgtataaggtgtaaggaagggatccagtttcagctttctacatatggctagccagttttcccagcaccatttattaaatagggaatcctttccctattgcttgtttttgtcaggtttgtcaaagatcagatagttgtagatatgcggcgttatttctgagggctttagattttctagtttatttgcgtagagatgtttgtagtattctctgatggtagtttgtatttctgtgggatcagtggtgatatggtgatatcccctttatcactttttattgtgtctatttgattcttctctcttttcttcattagtcttgctagcggtctatcaattttgttgatcttttcaaaaaaccagctcctggattcattaattttttgaagggttttttgtgtctctatttccttcagttctgctctgattttagttatttcttgccttctgctagcttttgaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttctgaatcctgagttctagtttgattgcactgtggtctgagagacagtttgttataatttctgttcttttacatttgctgaggagtgctttgctttacttccaactatttggtcaattttggaataggtgtggtgtggtgctgaaaaaaatgtatattctgttgatttggggtggagagttctgtagttgtctattaggtccgcttggtgcagagctgagttcaattcctgtgtatctttgttaactttctgtctcgttgatctgtctaatgttgacaatggggtgttaaagtctcccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatcttggttggtttaaagtctgttttatcagagactaggattgcaacccctgcctttttttgttttccatttgcttggtagatcttcctccatccctttattttgagcttatatgtgtctctgcccgtgagatgggtttcctgaatacagcacactgatgggtcttgactctatccaatttgccagtctttgtcttttaattggagcatttagcccatttacatttaaagttaatattgttatgtgtgaatttgatcctgtcattatgacgttagctggttattttgctcgttagttgatgcggtttcttcctagccttgatggtctttacaatttggcatgtttttgcagtggctggtgccatttgttcctttccacgtttagtgcttccttcaggagctcttgtagggcaggcctggtggtgacaaatctctcagcatttgcttgtctgtaaagtattttatttctccttcacttatgaagcctggtttggctggatatgaaattctggggtgaaaattcttttctttaagaatgttgaatattggccccccctctcttctcgcttgtagagtttctgccaagagatcagctgttagtctgatgagcctccctttgtgggtaacccgacctttctctctggctgcccttaacgttttttccttcatttcaactttggtgaatctgacaattctgtgtcttggagttgctcttcttgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgcagatttggtcttctcacatagtcccatatttctttgagagtttgttcgtttctttttattcttttttctctaaacttcccttctcgcttcgtttcattcatttcatcttccatcactgataccctttcttccagttgatcgcgtcggctcctgaggcttctgcatttttcacgtagttctctagccttggctttcagctccatcagctcctttaagtacttctctgcattggttattctagttatacatttgtctaattttttttcaaaggttttaaattctttgccattggtttgaatttcttcctgtagcttggagtagtttgatcgtctgaagccttcttctctcaactcgtgaaagtcattctccatccagctttgttccagtgctggtgaggaactgcattcctttggaggagaggcactctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactccagaccctgtttgcctgggtatctgcagcagtggctgtagaacagtggtggctgtagaacagcagtggctgtggaacagtggcttttcgtgaaccgcaattgctgctgcctgattggtcctttggaatttttgtctcagaggattaccgggccgtgtgaggtgttagtctgcccctactggggggtgcctcccagttaggctgctcgggggtcagagacccacttgaggaggcagtcttccggttctcagatctccacctgcatgctgggagagccactactctcttcaaagctgtcagacagggacatttaagtctgcagaggttactgctgtctttttgtttttctgtctgtgccctgcccccagaggtggagcctacagaggcaggcaggcctccttgagctgtggtgggttccacccatttcgagcttcccggccgctttgtttacctaagcaagcctgggcaatggcaggcgcccctccaccagcctcgctgctgccttgcagtttgatctcagactgctgtgctagcaatcatcgagactctgtgggcataggaccctccgagctaggtgcaggatataatctcctggtgcgccatttttttaaggctgttggaaaattgcagtattcgggtgggagtgacccgattttccaggtgccatctgtcacccctttgtttgactaggaaagggaactccctgaccccttgcgcttcccgagtgaggcaatgcctcgccctgcttcggctcgcccacggtgcgctgcacccactgtcctgcacccgctttctggcactccctagtaagatgaacccggtatgtcagatggaaatgcagaaatcaccagtcttctgtgtagctcactctgggagctgtagaccagagctgttcctatctggccatcttggctccctccctaatattaagtttttaacttattgctttaatagaattttagcaaaaaacaaattgaaaatattcagtcgcaatgactggaattgccatcatgaacccaaatttgaacaccttaggccaataatagcatagcctcacattataatatttattatgattatagtacctttattttacaaaaaaagagggggctttctgttgtgaatgcatttttcaaatcaaaaagtagaagagtatccactgtgtgcatttgtcctataaacttgtttttcctaaatttactgaattactatgaatggtactgctatcttgctgatcagtaaacataaatcaaacataaatatatgggttcatgaaaagtgcttaatgcaatacctacaaaaagttagctttctataattttttatgatgataatcatcatcatatttggattctcttttgcatccacgtagtgctacacttccctccataatttctacctgctatctctcttagcagttcctttctacagctcttgctgtgccttaactcaagcttctgttgcctcctgacttgacttgattgtcataataaagtacaaagtgatttctcacctctagttttgcctgttttgttttttccaaaaccatttatatccttaatattagtgacaccatgatttttctaaaatgaaatatatgttacattactgtttcgggtccctcgatgattcctaacaggaaagtacagaccctttcatggtataaatggtcctatgcaatgtgccctcccttttcctattaaatgttatatcttacccctcccatttctcaacaggagaactaaaacttttacatgctatgaatggttctgtgcagtctatcaatctgccttatgtttacctactaaacatcatcactcaccactcatattcagtcatattctagaccccaaaggtccaactttgagttgctcaaatcttccataaggtttcatggttgcacacctcacatgatagttgttacacttttttttaagtttccatatgcactatacttaaatgtttttttttttccctgctgttctgttgtagaagtaactaatttattctctgtgcgccctctaaattcccagtttacctgtgttagaaactatgctattctatcttatacacacacccccgacacacacacaaacacacgtttgtttatagacgttttggatggcaagctttgtttcgtcagaacatagcatgtactacagcacctggcatactacctggattattttccaatctccatgacaataattggaaacatttcaggattacttagtagtactaggacctcataaatattaacacattgattaagacaaggtattttctgtcatttaagaagtccagaattgtccaaagtgttgtcacttcgcagagtaatttaattctgatcattctctttgttactagacttgtgaattattcaagaattgtgtttttccttctttatgctggcttccagaatgtagacctccaatatttatatggaaaatacatatgtattttgtttcataaattcaatatccttattttacatttcctattttacttcatactaattttgttactatattttactttttgcccagcgttagcttggaaaatagaacatgaggaaaagcttatatgcaaagggtttattgagaggtaaaattccaggccagaggagttagttaggaaggaaaaggaagtgaggttagaagacgggaaagtaaaagtatttgggagtgtgatacaaacctggccatggagttagaaaacacagctggctgtttgccaaaagcagtgtcttccagaaaagacacgtagaatcacgttgcttcagtatagtccatcaggaggaggatggaaaagacattcactttccagattcttaaagtctccggtccctcgtttttattctccccatgggcgttaaagttcttgctttcctggattttcttcctttccctgtccaggcaattgctggaaaagctgtatgtcactccctaaggctggatgtcttcctctaggtcagaaagctttggacaggaacagaacttgtgtgtgttcctctgggtgagacttcggtgttagagttgcggtggcccactatggtgataccaagagggactctggttggtacattccacttcttacctccaaacaagctttagcagtaaatagtgtcagaagggaaaataaaggcagtggcatgctatattctccaataagcaaaaggcagaggcttaaagaggcagataaactgaggctggtacagttcatcccttgtgcctttctgcttgcatcctcttatgatatctggatcttatataagaacaggatggtatcatatcttccataaaagggaacatgcaggttcaacctctttaaaaatcttaacaaactttagcaaactgaaactatagtctgcaatgcagcagctagccatggtgtcaagatttccttcatccttagccatcatcttccctcatatggtttgcttgctttctggagtgacctagatattaaattcaaactcagagaagtatgatttgttgttgtgccaatatctattcacaattttcattggtcatggaaataccataagacagtctagttaatcacttaggctccaggtctattcttgtcttcccccatggtgcagttgtaactgtaggtatccctggtcaaagtcactttcccaactcagtaaaataagtttgctcttgggctgctagtctcctggcctactttcctttaatgtatcagattttttttcagatgcctgattaaatatccaagatattatttcctaggaataagtgcatatctttatctatgactgtttctcttttcatataaagtggatgttgaagtgcacccctcatagatctagtcactggaaggatttttctttacccttattcttaaaaatcaccctttagtggaactataatgaataacagattaactccagttagtatcatcatatcatgcttacatttctgtaaaccaggcctgagcatttttcttcactttaattatgttgtagggaaacccccatgagactacaggtgtgaagcaagatagaagcatcagtgcaaaagaggtaagtgtcaaaggaatgtagaacacctgttcataacttacaagttagcaagtctgttacccacaggatgacaactttagttgcgtaattacttgatgttccatagtcaggtacatagtttcatctaaggcatagtagctgcagattaatatattcatttaataaacatcattttagctaaacaacacacttctaagtaattcataaagactatgtttcaggtcagatataaaaatgcattgtactgcatataaaagaaaatatatcaatatttgtggaacacatctcaagtagtgttgagtgaaaaatctacagcattaaatgcatgaaatagaaaaaggaaatattctaagttcgtacttcaagtatctagaaaaagaaaagcaaaataaatccaaaccaagtagaattggagaaataataaagatacgagcagaaataaatgaaatagaaaacagaaaaacaatagagaaaaccaatacaacaaagatctggttctttgcaaaacatcaataaaactgacaaatatgtagcacaacagagaaagaaaaagagaaacagagaaaacaaagtacaaatatcatgaatgaaacaggaatatcactataattcctgcaaacatcaagaagatatgaaaaactctatgcacataaattggacaaaatagatgaaatgggcccttttttgaaatacacacaaagtactaaaactattagcacatacaatttaacaatataaaaatgttatacaccatagccaagtgaagttcattccagggatgcaaaacaaggtcaatatttgataatcaatatagtccaccacattaattagctaattttaaaaaacatatcaattgatgtagaaaaatcttcagtttgataagcagcacctacagaaatcctacatctaacattttccttcaatggtgaaagtttgaaacatttcctcctaagatctgtaacaaggcaagtatatatgctctcagaatttttattcaataagcactagaaattgtagctagtggattaaggcaagaaaataaaaattaagggcatgcagatcagaaagggaaaatgaaagtgttttatttgcagatgacatgattgtcaatgtaaaaatttaaattcaatctaaaaattctagaattaatcagtttagcaaggtcacatgacacgagataaaattcaaaaatcaattatattcctatctactagcaacaaacgtggataccaaaattgaaaatacaatatcttttataacttctaaaaaaatgacttacaagtatatttaacaataatttatagtaactgtatcctgaaaactaaaaatactttattaaaaaaatcaaaaaagaaagagctaagtaaatgaagaggagacataccatatttatgggctagaaggctcaacatagcaagcatgaatttttgccgagttaatatacaggtataaaaaacttcttaccaaaattctatattttttgtagatatagacaagatatatagaatagctaaatcaattttgaaaaagaataataaaatggaaggaatctgtttctctggtttcaagatttaacatataggtatagtaatcagtactatgtgactgtggtagaagaatagttatatagatcaacggaacagaatagagaaccaagaaacagacacccacaaatctacccaactgatttttgacaaaggtgcaaaagcgattcaatgaggaaggataactctttcaacaaataatagtgaagcaattggacacacaactccatagaccaaaataatcaaatcttacactgtacacaaaaattaacacataatagatcacaaacttaagtgtaaaaagcgaaattaagactcttagaagaattggataaagaacgtcttcagaatgtagagttaggcaaagaactcttagattttaaaccaaaagcatgatagtaacaggaaaaactgatacgttggaattcattgaaatgaaaaattttggtctgcaaaaagctgccaagaggatgaaaagacaagctacagaccaggagaaagtatttgaaaacaatatatctaacaacaagtatctagaatttataaaaactctcaaactgaacaataaagaaataaacaatctgattagaaaacgagcaatcacaggcagaggcatttcaccaaaaggcatttacaaatggaaaataagcacatgaaaagctattcaacatcattagccttcagggaaatgcaaatgtaaatcacagtaggtatcactatacatctatcagaatggctaagagaaaaaagtgacaacaccaaatgctggtgaggacacagagaaactaggtcactcctaaattacttgtaagaatataaatggttcaattactctaagaagcattttgaaatttttttaaaaaacctcacatagaactaccatataacccagcaattgtactcttgagcaattttccatagaaaaaaaaaaaactgacattcatacaaaaacatgtacatgaacgtttattagttttattcaaaatagttaaaaactagaaaggacccagatgatcttcaaagagtgaattgttaaggaaacttggatatctttatcatgaaatactgcttagcaccaaaaagaacaaactattgatacacacaatgagctcaatgaacctccagagaattatggtgagtgaaaaacagttaatccccaaaggtttcatactaaatgattccatttaaaaactgttatggacttaatatgtttcttcaaattttgtatgcttaaatcttaattctagtacctcagaatgtgactatatttggacacaaggtctttaaagagattagtaaggtaataggtcattaaggtgggtcctaagctaatatgcctggtgtctttaaaataagaggtgattaggacacacacacacacagtggcaagactatgtgaagacaccaggagaagataggcatctaacagtcaaagagaaggcttcagggaaaaaaaaattcctgccaacaccttgaacttggacttctaggctctagaactatgagggcataaatttctcttgtttaagccaccaagtctgtggtactttgttatggaagccctagccaatgaatacaataaccatcctgcaatgaaaaaattatagaaatatggaacatattagtggttgtcaggggttaagaaacagagtgtaaggggattgggtgtaattataaaaaagcaaaatgagggatctttgtgatgatgtaaatgtcctgtatcttgactgtttcaatattaatatcccagttgagatattgtactataatttgcaagatattaccatggttggggggactgtttaaagggtacaaaggcttgctttgtattatttcttaccattccatgtgtctacaattatcccaacataggaagaagttaaactaaatatgagatattatgtcaatattcaggcagaagggatttaatagagactgtacagaatatttgggaaagcaaaattgtagaatcttaaataactgatttgactattgatttctaggctatgtccaatagagctacaaatctgaggtcagaaaattgccacccccaattactcatcaggccctggatcaaaccagtcactatagttatcccgaaatttcccgatccctacatttgtgctagccagcaaccatatcaccaagagaccaagagaatgggctccatcacatttgtgaccttttaatctcaaaccagtataactaatttgtgaaagttaatttatatacaacggtccagattaaggaaatcttgaaagttagtttttaaatttccaaattctccacctagaaggcagttggaatggaaatttttagaggaaatacatattaccaactacactaatacttttcttttagggccgtagtaagaattaaataaaataatatttgtggaagtgtttccttaactgctagtcaaatgttagtttcacttctaatcttcaggtctatgtagcttgaaaaattgcttcttctcctttactcttaggtttcattaatgggaaaactgatgaaggttggatgagaagccctctgtcaaatccatacatctgtagtcagtaaaatatagacttttcagcccttggcagttttcccttctctttctatgctatcagttgcatacccacattacaacttgtaactcttaaattcatacttttcactccgaccttaagctttgaaatttcatcttatatatcaggtatcttcaactaagatgttctaaatttacttcataattaattttctccaaattcaagacatcttggggatgggaattagggagatattggtcaaaggacacaaaatttaagttagacaggaggaataaattaatgaaatctattgtacaatatggtgactatggttaatatcaatgtattgtagtcttgaaaattgctaagagagtaggttttaagtgttctcagcataaaaaaataagttgtggatagttcatatgttaattagctcaaaaaactcctacaaatgcaagacactttgaattcgggttatatgtccagtttcattaaaacatgattcaatgatttgcagaaatatagacagtaaaagaggttaaaaatgaaagtaaggagatttcaaaaatagataatgaactgaagcaagtttatatgcctctcaagatatctcagttttgcctgtctccaaaatcttggaccaaccaagtgaccttgttactactttcttcactttttctcctaacatctctttctcagtctcttccagggtaaaggatggactttggtgtgttctcttttgtacatgcctcagtgagatgcacaaagcacaacttggtcagattcacagaggctcttgtctcctctaactcttcctgactcaggtgaaaaatcacctcacgcaatctggtttacccaagtaaaggcctgggtaacagaacctagaagcctgggaaagataatacactgtagtgaaccagagatagacaaaagaatgaacaattaatccctttcattttcgctgcctgtgaaactgttcaagatggggtgggcttatacatcctgtccgaaaaatgagccttatgaccttgaaactggctgtgttatatttttgaagctgtggccagttggataatgtatcaatttgtattttctcttctgctctgccttgcctcactttttcctttcctttcatttcatttcctttttcccagtactgcatttccaaataaagccactcacaatctttaatcaggctgtaaattttaagaaatctggaccaagacagtttgctccaagagtatcccacaaatgcagatcttcagagtgagattttattattggattgctcacctgtctgttggtaagtgagatgacaataacaaagtgaagatgataataacttgacatgcagtggtaccacaattgttaaacactggcctatggttaattgtgaacaaggcttggggaaatcaaatgggtacatcatttgatcactgtggagacaatgatacttatgaagattgtaatttcagatgcctattttaatgacatcagagatctagcaaaataaaataataggatcgatgcagctgcataaaagatgctgtgaaagccagagatcttctgcagtttaaacgagattctaatatgctgcagctgcatagcagaaaatgcttaaacttaactccagattataagcataagggtgtcatatcctcagtagatatgaaatcggaagcatctctgatgtcaatgccaggatcataataggaaaattgattagaatggaaatatttgagtagaagagccaaagactatggaatctccaagttcctcttacccctcctggctggcagaggcagttccttaccacttatcggagcctcctttttgccagtagaccacacaaagacctcatttgaggtagatatcaaataaaatgttgctcttcttctcactccaccaacacttattgtctccaggctaaccagaatcaggtttcagcacatcccatgtaggctgaaagacaattctctaaatgtcaaagaaagaggaagcctggaaaatatgaactagcacacacagattgaaatgaatgctcatggatcctgaaggtgttataacaagagatgaaaatgtggaaattaaatagaaaaaaattcatcgacaagaaggtattcacctatgacttaggattgaaatgttggcaaaaatatctgtaactggacataattttctggaatcgcttcttgaagcctgggtataacaatctagagcaaatgacatagagatgatataaattctttgacattgtattgaagaaagtctcagattttagtagatgagtaaattcagaatgaatctactctgtaataactaagaagaatcaatctttctatctgtaggtccagtaggtccagaagatacttaaaaaaaaaattaaggtggtagggaatgccttgacgagggaagcatctgaactttgagaatttcagtgatgactgacctctgcagtccagaggcaggaggagggactgccacggaattagggtatttaatatcaatagggataatgggattccaggaaagcatagcccgaagagcagaacatagctgtgagaagcaaggaaggcgtaattacttcaggcaataatgtttttttcctacaggagataagatgatggttaatcaatcatgatgttcctaggagtttgacagatagacatctggcaaggatatccttccatttgtgtaacaaaatggtcaaggtctggcaagaagaaagttaacagtcctgcagtgaaaaattataggctcccactcttttgaatacttaagtcagtttagagaccaaggcccactgattgaaaggaagcctacaacacttgagggaggaccctactgtgccaccacaagtatttatgaaagaaatagtcctccagttttccccaaagtgagtacaggcatttcccagggtaaccaccaagtgggaagaatggattactgaagtttttaaggattgctagagactgtcatgcgccaagaaagatagaatggaaccaaacaaatcttcaaacaaaagccaatcaatcaatccaacagcaaacaaaaatccctctcagttctgttgctagaatggagtttatgaataacaggtgacaaatggagtttttcaagtcattctgacagttggtccagcaggtccatggaaaaccatggtgttactcctcttgtccttgaatgcataattggaatatatataccaccatctggaaggattctcatatcttgtattggttagctgacttgaatatggtaggaatagtcaaataaaagatcctaaaattacttcctatatattcactggtcacagagaataaattaggagcaatattgcatactttgagtagttgcagaaattagcatcactattaaaagaattgaaggcagctttgcacaatgtctcatacttgtaatcccaacaatttgggaggccaagagggaaggattgcttgaggggaggagttcgagaccagcctgggcaacacagtgagaccccatctctacaaaaatttttttaaaatacctggcatggtgtcatgtgcctgtagtcccagctacctgggaggctgaggtggaaggatcacttgaacctgaaagttgaggctgcagtgagccatgatcttgtcacttcactccagcctgggtgatagaatgagaccctgtctcaaaatgtaaaaagcattaaaagatgcaaggtagttggtctctaccatgtctctattcaaattaccgatttaatatttgcaaaattcagatggcagtaatctactatatattacctaggtcatgccccaatcgtagctactgtactagatgtgataactttactacagcaaatcaacacatatcctagtacttgatattgtgttggcaattttgtccttctctgtccctatcaatagggaggatcaaactatttatttttatatgacatgggcattatgtattcaattagcctcataattatattaactccataggtctcctaactgtcagatcaggatagaagtccaggttccctacttgggaaatatttttagcactcattttaatatcaaaataaatatttgtcttttctgactattacttatctgactattaccattgaatttgggtcttggtgttgaattatcagtttattaattctccaaatcacattaaactataaaagtatgttgtgaacaattggttattatctaattggttattacaaatatacagaataaagattaacttcataattgatatttcataaatttggatgaccttagtaatgcccacgaatatatcccaaaacaaataagaaaatacttgtacatttctcacttgttttgtgtttgtatgttgcctatgttgttctttttctgaaagctggattgtcagttgtaaacgtggcacctccataaaccccttctaaggctgggaactacatttcccagaatcacctcccctgtatggttttgggttggtttgccaatcagagaaattcacaacatttagaagatagcagtgaaaaaaaaaggcccttgttcctgtggcagtcaaatgcatgacttgacttaacagacttctctatgagctctcaccgtatggtcatggcaggcaggcataatgccttcttgggcttcatcaccaaatctggcttctggttgacatcagtgattgagtgattgcttctccagttctgtggtgctggcttacagacctttgttttcccaccttttcccacttcataagttctggttcctacattaaataacctattatcataattctggtagtggctatattttccttagtaaatgatgactgataatagggaagaaaaataaacattaaaattttgggatccatagagaaagtttaaatttaaagaatagaaaaattactaaaataaaagaaaaatcatttaaaaatgtacaaaatggagtggtttaatgaaaaataatattttacctggactgcgaaacccagaataaagactgtcttaaacttaagtaataatgtagatacaaatattattaataaataccaccaggtggatgtataccaatgatttcaataaaagatatcattaaaccagagataaattgtttgtgaaaatgaataaagtttagaacataccctgagaatataacatgataatcatgaaaaaagaataaccctaaaagactgagagtctaaaggtaactagaagaacccaagtgtataaccccttgtattttttgtatataaattacatgggagaaattccactatttaccgtagtcctagatactttttttgccctggcccttatcatttctttttaaagttatttcctcaaagaggaaaagttgaaggcagcccttaaagagggaatcaagaaaataacaattgattctgaagtcaaggaactgaagatgtataggttcacagattggttggtcacatatcaattaattatactttttatttaaagtaagttttataccaaatgtaggactaaagacaaactatatatgcagattataaaactctgagagtacatgaaatgttaaaagtgctgtaaatttgctaagcattactagtatcatctttggaacaactctttagaagaaaaaagtggcattattataagcaaaaagtggattttttatggctattatatatattaaaatttttctcaaattgtttctttttataatggtctatgttaaggcctcataatttattgaaaagttcaactgacataacctcaaaagtgctttaaaatgaattaagaaaaatgaaattaatgcacattatttgcatgtaatggatttagaaaagccacgctcatatagttttttatccattataagtcaatacagaccatcaatattttgaccagtgagctacaccatacagcaattccaggctcatttaccctggcacccaacatagttcaaattccactttccatggaaacatatttcaagttttactctccaagggaaaaccaacacatttgaatgttaacttcaaccaagccaaaccagaaaataaatttgctttagaaaattcagtattcttcaagtcaaacctgtatgacacaggaatatccctgatgttatagattatctctgtcatcactctacttacttaactaggaacaggaagagagggttgactgaaatcacatttttacccatagaacagtacagcattttaaatcatatttctcaagggcctttgcaaagttatcatctttagaagttggcagtcaagttaacttgaactcactcaaatgtgaaatgtattgaataattaagtatctattcattgctgacaagaacactgagtttgtatgtacaaaataagtgaaaaaatagaccagtagtagaaaaatagccaactgtagcagagttcacttaatgtgtctctactcttgctgcgctagttatatttgtatgttaacctcttggggattacatcttaatagagatgttaacctctactaaagaatgttaaatgtattgactcttttattcattattttgtctcccctcagatacaatttataaaaagttgatcatttcaagacggtgaagttggtattgaaataggaaatagaaatccggtattcactggatgcatgaaatcaccatagaaatatgctcagaatactataaaatattctggtcagaaagactgtagccaaagagacatcaaaagcaacagcatctagtgcaattagtataaaacggtactgaaaatctatcaataaaaattaatgtatcagctgtgtaattaataagcaaagaggtagacattatccacctactgctcttataaattaattttgcaaattgaaacaaaaccaacaatttgtactgggaaatttatttgttactaacaacatgccactagttcaagagttgctatatcatgcaaaaaatccctataactaatccgtctcttgttcaactctagcctgaaaatggatgaatgtgtcatgagcttcaaaacccttctctaagaactaggagcatcccaagaaattatacagtctcatttggaacaaaatgaaaactcagtccacctaagagtttctcagacatttgacctttgtgtctgcaggaaataaaaaaattgaaacagcatttgtactctgtaattggtccaaccttaatggaaggtattcactgagcagaacactaagacaagcttttggtaaatggcacattactttataaagagctctgctcaaggcaatttatttgaaacagggaggcttatttaaagctaccacttggaattgtgtaaaatcaaatcaatttcatagtttctttaattttattgactttcttcagcttttatattttgtacatttgaaataacgaaaacatttgtgagacatatcaattttaactccactttaaacttaactttatcctttgagtttctttgtaaatgacgagttaatgggtgcagcacaccaacatggcacatgtatacagatgtaacaaaattgcacgttgtgcacatgtaccctagaacttaaagtattatatatatatatatatatatatgaaaaggtttgttttcatatatatatatatatatatgaaaaggtttgttttcatatatatatatatgaaaaggtttgttttcatatatatatatatgaaaaggtttgttttcatatatatatatatatgaaaaggtttgttttcatatatatatatatgaaaaggtttgttttcatatatatatatatatgaaaaggtttgttttcatatatatatatgaaaaggtttgttttcactctgaatatagcaatagaaatcattgtaccagagagtactctgacaaattttcagcatttaatgagaatgtgggcaggaagtcaaataacttgttcttcctgtaggaaggtaaagattattatattattgggcacttgtgtttacaatggaaagtccagaataaaggaggcctcaatatgctctgtggaacacactgtgctagaaagaatggcagcaaattttatggcagattttgccacaagacctcaatgtgtattacgccttggaactagatcagctttggaattcaaacacttcctcatttccatctctcaacattggattatcattgccctgcaacgaatattccatttgccttcatttgtagttgcaggatatttcctggtaatcattacatttcttgtaaccataaaataagtaccaaataatatctgataagaactttgcttcatttttttcctgctagaatcaaaatttagagaagcaaagcatcagaatccatttccaaaatttgattggtaccactcagtacaaagacccatattccattgtaatgttgatattttcatctgtttttgtatcatgtgtatctgctttataatttccctgcattctcaagtattaattttcaaatgatttttaacttattacttctgaattgaaacacaattgttttcattttgtctacatggatttatagcttcatatagttgcaatcacaaaattttatacttttagtaagattatattcatccaacaagggactatatccggaatatacaaggaactcaatgcaacaccaaaaaaagtaaataatcccattaaaaagcgggcaaagggttgcaataagcattgttcaaaagaagacatacaaatggccaacaagtacatgaaaaaatgatcagcatcactagtcatcagggaaatgcaaatcaaaaccacagtgagatagaattacaccacagttagaatggctattatcagaaaaaaaaataacagattccggcaagaatacagagaaatgggaactcttatgcactgttgatgggaatgtaaattaacacaactattatggaaaacagtacatagatttctcaaaaaactacaaataaaactaccatatgattcaacaatcccactactggatgtttatccaaaggaaatgaagtcagtgcatcaaagagctacaggcactcccatgtttcttgcagcactattcataacagcaaagatatggaatctacttaagtgtccatcatctgatgaatgaataaagaaaatgtggcatatatttacaatggaatactatttggccataaaaagaatgaaatccagtgatttgcagtaataggaatagaactggaggtcattgtgtttagtgaaacatgccaggcacagaagacaaatattgcttgttctcactcatatgtgagatctaaaaaagtttgttctcatggaggtagagtgtagaatgacatttacctgtggatagaaagggtgtggtgatggggggatgaaaaaaggtaggaaaatggatgccgacatacagttaaatagaaggaataagttctaatgttcaatagtacaacaggataactataattacaacatattacacatttcaaaatagctagaagagattttaaatgttcccaacacataaaagtgctaagtgctcagggtgactgatatcctaaataccctgacttgatcattatacattatatgcatgtaacaaaatatcacatgtaccccataaacatgtacaagtatcatgtatccatagaaaaaagtaaaattcaagctaaaaggattatgtgttaaatattttctattttcacattgctttaacaaaaaagagtgcacaatgatccattgtatttatatacctgtatcataatttagttaactgtttctcttctgtggaacaaataggtggcttaaaatttatgctgctacatttagactttcaagaaatacatatatattctcttcatgctttgcttcttttttctgataaatatttttagaatataggtcaccaagaatgagactgaatagtagtatgaaaattttgaaaatttagatacgtattttatcattaattctgattttttatcataaactaatatttaatattttaaactataaaatatatacaatatgaaaataataaaactaacatctaattaaataccactgagagttaattgaataaattataacactgccatatttgattcatatctctgtttttcttttaaaataaaatcttagaaatgctagggtcagctttccaacccttcatatgattgccttcaacttaagttccactctgaaaatggtactatcattcccaggcatgcttttgtgttttaccagatttgtatgtatccataaataatataaagtactgtttaaagagtttaaatatgcatatattttaacatattagtatcatgttctttcttcttttttatttttacataaatttttttgagttctattcatgtttttttcagtagttataattcatctattttaactatttagtagtttattgcatgtttatttgtccgttttcatagagtatttcatagcatgtttacccattttcatgcatatgtctttttgatttttattctattacaaactaatttggtaatgatcttgtttctgtttgtaagcttgtgcatttgtacaagaggttcttcatgattcatacttaatgtaattgcttggttcctttttacccatgatctcccttggtgttattggatctagtacacttgccaattgagataatatgaaattgtattccattttagttttaattacatttccatgattactgctgaggtttagcatctttttgagtattacggaatttagtttactcctacgtgcattacattttcataattttgcccagtttttccttgggttgtttttattttcttactgattccaaaggtatctgtaaattattgaaatgaattattttagtattgtgcttttcagcttttcttttcactttaattgtgcattacatcatataaaagttttcattttaatgtaatcttagttgtaaatctttttaaatttggtttgtttttcctgttatttttttaaaaattatttctctcccctaacatctaacaaatatttttcacttctgttttttctataaattttcaattttgcttttcacacttatgaaattacttggtaattattcagttactaattaaccttgttacttggtcaattttgccaacattttgagttattttaaaataaaatattttggtgtctttaatctctattttaaagtttctatttaattacctcttgctctttaactttgttttatttgtttatcttctttaccttctctattttcttctaatttcttgagttggaaaacttcaagaaatattcaatatttatttttttctgatgtaagcatttcatgccagttttgtgaaactattgctttatacacatttaacaaatttggacacattgtattttcattgttattagttcaaaatgtattttaatctttattattaatataactccttatctggtctgtgaattttttggaagattatacctgattatattttaacccaaatacattgggaagtgtgtgttaactttctattaatttctaacttttaaatataactaaactttgattacttctttgtgacccaagagagtgatgtcaccaaaatggtggagttgggtcttgtgtggtggctcacacctgtaatgccagccctttgggaggctgaggctggcagatcacttgaggccaggagttcgagaccaccctggccaacatggcaaaactctgtctctactaaaaattaaaaaaaaaaaaaattagctggcccatcgtggtgcacgcctgtaatcccatctacttgagaagctgaggcacgagaatcgcttgatcatgggaagcagaggttaaagtgagctaagatcgcaccactgcactccagccagagtgacagagcgagactgtgtctcaaaccaacaatgacaacaacaacaacaacaacaaaatggtgaagtagaagtaatctgctttcaccctccccacagaaaacaaaacaaaacaaaatcctgtccagtgccaaaattatcaccaccagtactccagaactcaaaactgaggctgtgataatccttgagccacagggaagtaaactgcatggggagggtagaagaaatggacttttccatgtgctacatgcttcctccaaactatcaggcacttcacagaaaagttctcctggagtcactatctctggaaaatgcgatgttgcagcagacagctggtttccccatcatcttgggttcctacacagaaaagctgttttttcttcaacccacttaaagcaacttgagtgcctttagggagaggaacccctaaaaggctgctggaaatagacagtggaggtggggttagcagtcccagtgcacaaaacatgggcactgctctccagctcagacaaaggagatgccaaatcaaagaggtagtgcaacacttggcatgaacccctaaccagcctctctacacagccagggaatcccctttgggttcctacccccgaccccaattcaggacaaatggcacatcaaacttttgtaaaagctgaggcaaacttgaaattagggcaccatgtagtgccaagaaggaggcagcaaattaggaataagggaaatcaacagtcaaactgcatagatactctaaacatacatagactagaaaggccaaactaacccagacaggaaagctgggaatacataactaatccttcagtgcaaagacataaacaacatgtgtccattagaaacaggtgtccattagaaacaacagcaaacaaggaattatgaccttcccaaatggacaaagccaggagccagtgaccaacccaatgagacagcaatataagaactcttagatcaataattcaaaataacagttttgaggaaactcagcaaactccaagataaagcacaaaagcaatttatcagaaaaatttaacaaagaggttgaaataattaaaacaaacaaacagaatcttggaaatgaggaaaacattggctgaaatgaaaaactcatcaaaaggtctcaacagcagaattgatcaaaaataatcagtgagattgaagataggctatttgacaacatacagaggagaaaaaaaaaagaaagaaaaggaaggaagaatgcctatgagatacagaaaataatcccagaagagcaaatctgagtcattgtctttcaagagtgaggtgagaaagaacaaggagtagaaagcttattcaaagaaatagtaacaaaaatctttctaaacctacagaatgatatacatatccaggtacaggcaggtcagagatcaccaaacagatgcaacccaaacaaaactaccccaggcatataattctatgtgatccagtttcttgaatatttcttacgatatgtcatgtaacctgttacttgggaaagttttccaagtgttacacatacatagtagtcagcaatgctatttaacaagtgtttctagatcttctcagttgtgatgaagcttatattgcctgtatcccttgtctctataacgactgtgacacaatgcttaattgcattggcatgtggcagtagcatgaaatatattttcactaacccagtgagagtttgggtgtttttgtaactgcaggattatcagccaatgctaatgtggtggatgtggggtaatattagagtcctagtggtgagaaaggtgacaatccatgttacacatgagcaacacttatgaagctgttatgtgctataacttgcttaaacatgtatctaataaacttgtagcactacaagaagtatttgaaaataaaaacaatattggcacatattgattggtattggctgtgcttacctagctattatgaaagagacccaaagaagatctgcttttaaaaagtatgttttatctcatcatttggtatagggttctatactactgagtcagatgaacttattacttgtttttgagattttctgtatccttactaacttctgtctagtggatcatttaaaactccatcactacagagtaaatatttcttgaaaagaatgtgaaaagtatccagcataaacatggaacacatggaatgtaattaaaattacaaacttcggtcaatcaaaagacaccattaaaagagtgaaaaggcaagtcagagagtgagagaagatatttgcagtacaaagaaaaaacacacaaatattctcgcaaatcaatcagaaacaaaagtcaagccaaagaaaaaaatgtaaatgatcttttacatccccaatgatatccaaataatcaatgcacatttaaaaaggtccttaaagatattagtcattagggaaatgcaaatcaaaaccatggtagcatacctactataccctaaaaatgttaaaatgaaaaagatgaaaaatagtctcacatactgctgcttgcagtgtgaatttgtacttctttgcaagactgtttttgctggatcaactaaagctcaaaatatgtgtaatcctatgaactttgtgctaaactagggaattattaaacagccatggaaatttatagtgactcacatagaaactcatttaaaaattcacttttttttttcaaattttacccctttattttttgctgtgattggcaaaatgattgatttagtagtagaagttaatttttggtccactgttattgatttcaactcttcctcctcacttttacctttgagatggctagtgctgcatgtgcctctctttaatgtgttccattaaagctttatgtacaaaaataggcaatgggttatgtttggcttgtgggccataattttctgaacattagtttaaaaggttatccttcccaaagctgtatgctgggattttaacacatgactcagggaaacactataactcaatgtcaaaggtgcactttaatggcgacaatttcaggttcattggccgaactgttgttagtaatatatttttaagccattcagcatccagcaaattggattattaaacagatacagatgccaatgaaaatacggcatgaaaaaacagtttatatttactataagcactatataaaagtctaacactgactgaagttcaaaaaaagcaactcaaaaagaataataatttatattaatctttccaaatattgtcaactgatgattgtggtagttgggaaactttaaaaataacagaaagtatgtagtgatcagatattagagtttgctaaattatttggattcccatttttaaaaggtctcattaattttgcaaaatgattgtccaagttgtatgagtggagaaattatcttccctaaaatatccacatggaaatcaatatataagccataagtctcagttagatagaggaacacaaaaataagtttctgttaactaactttaatgaataattgcaattttctttctaacaaaggagcaattctttcttggttaatgtttttgtatctgtggttatatgtagactgtaaaattacatttatttttgcaattctagcttgaatagatgttttatctttggaacttgtcagaaaaccatgggttttcaaataagactaaagctattttattaaaaagttgtatgataaatttgaagacttctgcaaaggacaatccatggtttcagatcatttttggaaaaaaaaaatcagttaaccagtattttctgctgtactgtcatttgtaattctttaagtttctttgtgcatgtagcattgtagctgagatatatttggccattgtagcaatattcttctcttcactaaacccaggtaacttaataagtttcttgaaactacatagaagaattgaaagtattattacaacaacatttagaacatctaaaaaaaggcatattcaaagatttcagtggtcacttagcaggaaattttcatttattttgccagtatgattctatgagcttttataataccaggcaggtcaggatatcaggtaatgtttcaagtcatttcacaatacttttaaagatgtacgtttagtcttgaaattactataatccttttatttttccttaataattcataccttcatttattcaacaaacacattctcaacctactacatgataatatttgggaaatcagggatgaacaagttagatgaattttctgctcttataaaatgagcattctagttgtcagaaacaaacattaaacaagcatagaaataaacctgataagtttagaatatgataaataccataagaaaaatgggcacatgacattaaagaatgtgacagttactgaacccagtagtacctaacaaatgagggacccaaagattcatttgcaaaggaaaagtgcaaacatgaagtagtatgtcaaaatttcctaaaatataagaattttctaaggaattatggctattttatgacaacaataatctgatggagaatataaaatatttcaagaatttaaactcacaataaaataatttacactttcctttattttttaaagttcctctaatctgatgggacactcccgcaatgatgcttcagctgtattttaacctcaagaaaccctaagatccctcactcctatgctgctgtcaacgggaggctaagaagcacagagaaataggccatacaaagtctacctctctgaacactctggtttgttgagatgacagatggttaagtctctctctgacatcaagagttagagccaaagttatcatggaattgtttcttttggaatgtcaagtttatgtgcaccgtatcactcttctgaaatggactcaagattcagggtctcatctcacttttgatttaactacactcatattcatccatgtgtgaaaaatggtgatcacactagaaagcttgttcttactgtttccttgcatatctgaatacctgcatcacattcaaatctaactcactgccttaatttaatagctgaaagaaacactgaacaagtcacactcctgcaagggcatggaacacagaatggcaagtatatccactaggattgtatttttctacaagaaatagcctggcaaatggtggcctaaattactaatcagtttattttattcttctacagaagttagcaaaccatgattggtcttaaggagccatcaaaatccaatttccttcaagctttctgcctagccttccttcacatatagcttccattctccagtttccccctgtgaacctggtaaaaagagatttcaaagttcaaacccgaaatataaataattattcaggaatatcttaaccaatttattgcatgtatagtttgtagttttataaatgcacagctttgggaggccgaggcgggtggatcacgaggtcaggagatcgagaccatcctggctaacacggtgaaaccccatctctactaaaaatacaaaaaattaattacccatgcgtggtggcgggtgcctgtagtcccagctactcaggaggctgaggcaggagaatggcatgaacccgggaggcggagcttgcagtgagtcgagatcgcgccactgcactccagcctgggcgacagagcgagactctgtctcaaaaaaaaataaaataaaagcacagaagtattatgcgatgaaattccatgaaaatgtatctttcagtaattataaagtaaaatacctgtgataagaaagcatgtaccatggttgaattggcagtgtatcttttattcatacttcttaataatgggcattttctttggtgtgtgtatgtgtatgtatatatctcctatcttgtgcttatgtagtcttgattaattattcaaggcatcacagaaaacagtagatacttttgtttggaattgaagaattgctttgcaattcatataaagcatgtaggtaccaggagtttaagtaacaaatataaaaagattatctggagcaattctcaaagcctttactatgtgaatgcacatgcagaatttccaagacgatattacagtattcagcattttccatgatccatatttcaccatgaacattttttctgacagattctcttactgagataccttggaacatggtttgaataatattgctctaacttctttcatgtcaggaagctctgaggtaatttttaatattttatacactgtactatttaacaaaggaaaatatattatttgttttaccaatgtcattttcctcgacaactgctacaaattggaacttaagttagatagctactttataatatatttgtattaatctagaaggcttaactatacctagattatacagtagttgctcaataaatgcccattgaatagaatcataaactaacttcatttccagactgcacaaaagagtcaatctagtaatgactggtggaggtggggcaggatagggtcattgctagggctcttacacacacatcatactatgtatcacttttctatatttatcactccattaagtctgttcaaaatcaaccttcctatctaaaattaccaagaattcaaattgaattccttagatgcatagtgatccaattgcttgttctatttgattcacacacaggcagcaatctgttttctttccaaattgtatttgttgtcattattttaatctagcatttgtttcatgttattggaatactctgaattatataggaggtttatacaataacaaacagttaaagaaacaagtcaaagtatcactctccccaggtgaacatccattttagctatgtgtctatttcttttgaacccaaattttagacagtgaaatctgtggtttattcttttaacagttgccatagacttgcggaaatgcctgctacatacatgcgtgttgaacaatgaacttcataactgacatatttatcagagaatcaggatgagagaaggtgatcacttaaaaagaaaagcctagtttgtataagatggatgttgatcacgtgctctccagcatcataattacatttgttctgttcaattagggttgggtactagacagaaaatattttgtaaaaggaaatacccaccttctttgaagcactgttatacataaattctttccaaaagtattttttaaaattacagagaaaatacaaaattgtaagtgattcattttttattattataaaaagacacacttaggccagtagtaaaattgttgagtttctttctcctaatagttaattcaccatataaaatatttagtttattcacagcagcttgttatgggattctaattgcctatttttccagaaatggtgaacaatctttcatttaaaacagggaacagaatagattaaacatgaagggaaaatatacaggcagtgaggccctcaacttcttcagcactgttttgttctgtcctctttttctctccctctccctccttctgtgtatttctattccttctatcccacacttttcattcagaactgctcatttttcattttataaatgacaagggccattccagccttattaagtggaaacttgaccgatagcattgaaaaggtcacctgtaattcaggctacaagtgataaaaatttaggcgttaagatcaacatagactgggagtaaaattttaaaaatagagataaagatttataggcatgaggctattcaagaagacctagtgctgccagtcactgagaaatcaacttgatgaccagaaaataagatcagattaagaaatatgaggttggtagggcctcctgaggcacagtcaggggacactgaaatgtatttttagtggattatgaagggtctgggaatggataactctgaaatccttttacagtacatcacaatgtgtcacatattccttgagaaactcaattaccaaacatcccagacaacatgattggctctagttgaagtgagaaaaactttaaaagtgacatgaaatgttaaattggctttagggttcagaaaagtattttatgtaggtatacaccctgattttcttcagcatagaaagcttatatttatagaaaagtacatattacctgtggaaaaaaattaagtagactttaaaggaatatttaaggattattctgagcctttaacatgaccagacatacatttttatttataattatttaaagtctctctattttattcttcctcagctttaattcacctgggagaggtgcttaggagctaattgaaagtaaacaattacaaaaagtgtatgttttgaagaattgttttatgaagtggggagcggggagagtttttcttaagggaaagaacaagatagaattattgaaataaatattagaagaaagaaatgaatttattgtatgtgcaataatgtactggaataaatgcatcaaacactttttcttcaagcataattgcctgggaataatagtagatttaaattcaaattttattttgtgaaggataacatttaaattaaatttttttttgtgaaagcaactatcttaactatctgtgctaacgacagctctatgatagaaggaactttgtttattatgcttactatgcagatgcagaaacacagaaaggaagaggattagcaactttcccagatctgagttgagctgagatttgagtcaaggcaatattgcttctggggctgtaacaactacattttattgtctcctgaacagatacttccttttcttacttaataagaatagaccttggaggtctggacctggacatgaacgtacacttttctaaagaagatatacacatggccaacaagcatgtgaaaaaaagctcaatatcactgatcattagagaaatgcaaatgaaaatcacaatgagagaccatctcacaccagtcagaatggctattattaaaaactcaaaaaataacagatgctggcgaggttgcagagaaaagggaacacttatacactgttggtgggagtgtaaattagttcaactattgtgtaaagcaatatgtcaattcctcaaagagctaaaaaagaactaccattggactcagcaatcccattactgggtatatactcagaggaatataagtcactctactataaacacacacgcatgcaaattttcattgtagcactatttacaatagcaaagacatggaatcaacctaaatgctcatcaatgacagatcggataaagaaaatatggtacgtatacaccatgcaatactgtgcagccataaaaaagaatgagatattttgtgggaacatggatggagctggagaccatcatcctttgcaaactaacaaaggaacagaaaagcaaatagtgcatgttttcacttataagtgggaactaaatgatgagaatttatgaacacaaagtaacaacagacactgtggcctacttgagggtggaaggtaggaggagggaaaggatcagaaaaaataactgttgggtaattggcttatgtattagtcccttctcatactgctataaagacatgcctgagactgggtaatttacagagaaaagaggtttaattgactcacacttctgcaggctgtacatgtacaggaggcatggctggggagacctcaggaatcttaaaatcatggcagaagggctaggggaagcaagcaagtcttcacgtggcagcaggagaaagagagagcaaaacaaaggggaaagtgctacacactttcaaacaaccagatctcatgagaactcactatcacaaaaacaacaaggggaaactgtccgcatgatccaatcacgtcccaccagatccttcccccaacactgaggattacaattcaacatgaaatttaccggggggacaaagagtcaaacggtatcagcttagtacctgggtgaggaaataatctgtacaacaaaacctcatgacaaacatttacctatataacaaacctgcacatgtacctaaaatctaaagtaagagttaaaaaaaattatacaggagtatacttagaaggcatagtttctgaattctaaatcattattcataaaaattttacccaatatttttcattgcatatttcctataaaaaataatagatcaaagactactaattgtaaaaagaaaaaaaaagcaagctgctaatatttattgtgcctttactctttgccaggccttattaaacgctttacctttgttacactgtttaactctccaaataactctaaaatgtagttacagttattgtttctgagaaaggatggaactgaggctctataagttcaagtcactatagactactggtctaggccagtagttctatttttaacacgtttatgaaacaccttgaaaagttattaaaagagttccctggtttcaacaccagaagatctaattcagcccaaaaatttgctgatgcttctggtcagaggaccacactttgaaaactactgctctcctaatggtgttagcaattgtctgaatcctgagactttaaccaacatatgaacacacaaaacgtgatgttcattccgtagatattgattgatgctgaatccaaacctcatcaaactaaattattcatgtaccatgacagacaggaatcctaaaggcatttttataaaagacatttgcctctaatccttaaggacagacacttaagtagcacattttggtacatagaaattagatttcagtactaaactctactcacttttctcaaagctattaaatcagcaaatagttggtatcaagcatcattgtaaatgaatgaaaattgttgttttaaataataaactttaaaagtgagagattaatagattcccaaattgataaagccagttagtgccagattctaccacaccctattttcagtttccttgaatgagtagtatgtcaacagctccccttggtcctccagtataatttctccccagatttcatttaggtacatgactactgataattagcaatggaatttaaattcctcaggagctcttgcatctaggcatgggaccaaggctaagttctagtcaatgggatgtaagcagaaatgatgtgcgtaacatcaagaatcagtttttcagagagataatttgcttttcttttctccttcttgtctttgatagcatcttcaacctttctggactacagcacctgccaactgacccccacatcatggctccaacgctggcttcatcacatatcttctctctcagtccctttggctctcagggtgcaatagcttaacaaaattgctgatctaggtgcctcagcattgtttctttgtcatagtctctgtattatcttattttgagccattcttttcctgcaaagatcctaactgaatgagataactacttcataagctatttgtaaggtttaaataaattaatgcatatttaatacatgaagctgtgcctagtttatagtaattactcaaaaatgttacttatttctccatccaaaacatacaaacaatagtatatccttcatgaggacttcttgtggactaaaaaggcagtatctttaaagtgttttgcagtctctgacaaaaccacactattacccttactcaaggttttaattgattgtatgtacacaaggttagtctatatgagctttggaaagatgggaaattcaaagtagaacagttaaggaaggaaagtgtatgttccactaataaaatatatattagttcctgtaatcagattgtgagtgacaatggaatccagtggacccattttgccctcagacagatggctgagaaattgctggtgtggcaagcaagcaactctgactgcaaaatggcagactcatttgcttgggggacaggaatgagggatggttcacatgggaagcacaaagtcacccttgatgaaagttcagagaagaaagagatcatcaaacttactctaattaccaaaaggtgatgacattagcagaagaattagagtttgaaatagtacttttggtagagaggactgatttctaagaaagcccatactcatgatacaaaggcagttggtgggccccaaagcagaatagctgcctcaggtgggcaagtagctaaagttcaccaagcactgtgtcccaaaactcacatacacgctatacctacctgcatcccatgatgccaggagagccacatttctgtggcaagggacagtgaacagagaggagccaacatgggaatgagaaacagagttataaacaaaaagcaagagaggaaccctcagggtaacagaatcagtcactcttgaatatgtgacagagtagaaggtaattacctcttatatccggatattgaaattccaattctagtctctggaccatacttctttgaaggttagaaatatcagtagctcagttggatctcagattggagctgctatgtgttgaattgcacccctccaaaattcacatgttgaagtcctaactcccagtatctcaaaatgtgaccttattcagaggcagggtatttacagagataagcaagttaaaatgagaccattggggtgggctttaaaccaataaaaaggggaaatttggagacagattcacacaaagagacaatgcatgtgaagagagaggcagagattgaagtgatgctcctactagcccaggaacacaaagattgccaggaaacctccagaagctagatgagaggcacggaacagattcttcctcacgatgttccaaaggacccaatcctgctgacaccttgattgcttaattctagcctccagaactgtgagacaataaatttatgttgtatgccacccagtttgtggcacattgtttcagcaaccctagaaaactaatacagaagttgacaagatccctgtattagttaagatttttaaaaaaataaatgatgaaaacaaaacaaaatcccttttatgaacttaactctaaatgtgaaatgtgtaggatcagtaaatgaaactctcaggagtgtacatgttctgagcatatgttgattcaggtagttaaatgatactatcaggagtttaactctaactctggctctcgttgctacttcttgcttcgggttggttttttaccctggcgagctctcttcaaatgaaaataagatgggacttaacaattccagctttaagaaagctgcaaccagcaattaaagaaagttaaactacctcttctttctcaggatcatagcaacataggttttacctcccgtattaccagcgttacttaattattgccagttatttcaaacagctggaaacaacttggaaagctgcttaactagagaggtaagtgggtaagaatagttgaagaattgataatttattcagtgcgatttctctcttttctatattgttctctgttatggtggagacaaatatggatatttttatttgagcatgaaaatcaagaagaaaaagaaataaagaaataacaggtaagatataaattatgaatttttttcttaaccttttttaaggtgtaatggtatttccaaaagtatctcttcctgaaaagaggaagattttattgtttaaaacattttgtagagaggttagaaatcctagatttcaccactaaaacaacagaaaaataatttaacattttgggaacccaactattcgtgtgttaaaaaaaatagttgcattgtctgagcagggacatggatggagctagagggcattatccttagcaaactaacaaaggaacagaaaaccaaataccgcatgttctgtcttataaaaaggagctaaatgatgagaactcatggacacatagaggggtacaacacacactgggagcctatctgagcatggagggtgcagaagggaggggatcaggaaaaataattgatgggtactaggcttaatccctgggtgatgaaacaatctgtataaaaaaccaccatgacagaagtttatccatgtaacaaacctgcacttgtacccctgaacttaaaatgaaagtaaaacaaaattaaaaaatagacacgctatgatttctgtgatttttgtagttggaggcaccagggattttatgcagccatgtttttttggttgcatttatgtaagcttttgttttcaaataattttttattgaaaatttaaatttaagaaagcattaatttttaaaactattatcttgatcataaaagtcttcagtacttgttgctgagtatttttaatgtagaatttatggagaagaaaattagaattatcaacataactatggtacagaaataactattgttaatgttatcatgtattctctttaagctatttttctataacacacctatgcaccttaggaagaggacatgctattggcttattatttaacgcttgttttaatgtctctttgattttgtgtcctttgttttaacttgcaacggatatatttgtgaggaagtagggaattaataatagagaaataaattaatttggcaaatgtattttgcaacttctttatcagattcaattaaatgtacaagtcactttcccttagagagttgcttatctaatgtattccaataagaaattcattgatgtgaattaaatcatttatttctaatgttattagggataaaaatgtaacagaccttatcagtcacacaaagataataggaaacaggtaaggagagtagacttacaaaggaaatgtataaccttcgaacaaaattgaccaccagagaggcacaactatatgcatgagctctgcatgcagacaagcaaatggaactgataggcattttaaagacatctgataaaataaatggctgacaacattgcacaataacttccccttgtgaccactgcttcctttcttggatgtataataactgagacttttgaatgtgacacatttatccatttgtgaaaataatataactctaatataaattattttagctgaaaataatatcacattcctgttcctgttttgatggcagagactaaacaataatatttcaaagggcgcctacatacacatacacacacccataccccaccttagtaatgctgaaacataagaaacaattgaaaaataacgtaagttaatttggaaaattatatagtgcaattaaagagtcttatcgaaaatcatttatatgcaaatatatttataaatgtggacaatctataacaggaaaaccttattctgattagtcttaaatatatgagtttatttatatattctattcagtcttctactgaattctgcattacatttgtatagtagatatccaaggaaaaatgttcagttgcccctcattactactataatgaaattaagttctgatgacagagtaatatattgaataaaaaagaatctatctgaaactttcatcaactcataatgaaaaagccataggaatgtatgttgaaaaacacatagtgtttgttccctgaagtgaataaaaatagaaaatgtggagaaaagagcagtttataggataatacttagaggaactgggttaacattttcaatgaaaggaatacaagcatcattgggtccttagagactagaaactataaaaagagaaattgaccatcaggcttgagtaaggaaggctgaggaactaggatatttcaagcttttaaaacaaggaaaagcatttcaccattcactaaacaacttaacctggatcactttctgaatccagtatgtgctctaaattgcccctggaataatttagaaagatgcttcatagaaaaagagagcattcaagttatcttagcgcctggaattattccagtactcaagaattagatctctactcactcaatttaccaaatccattgcaaagagactggggactaccgatgtaaaagtaagctgataacagtggaagttaaccattttcacttaaattgttatacaaaaatcaaacttttttactagtacagaatatagataattaacaccatttcaaaacactttcctttccctcctaagtaccatagctcccagtcttagaggcatcagaagacctaacatctaaaaatcaaaatttcaaaagaaatgttacaccccaatatactgataaaatattgaaacttatttttatatagtgcttagcattataaaaagcatttgcagccaggcacagtggctcacgcctgtaatcccagcactttgggaggccgaggcgggcggatcacaaggtcaggagatcgcgaccatcctggctaacacagtgaaacaccgtctctactaaaaatacaaaaaattagccgggcgcggtggcgggcgcctgtagtaccagctattcgggaggctgaggcaggagaatggcatgaacctgggaggcggagcttgcagtgagccgagatagcaccactgaactcgggcccgggcgaaagagcaagactccgtctcaaaaaaaaaaaaaaaagcatttgcaaacaaattaagtcatcctcataactacattttgagctggtagaacaggcattatcaccattttaaacacaaggggattaagaccatgaagttaaataaaataatcaagactaatttttattttattttatttatttattttttattcaagcaccaacgtgaaccagataatttttttaaaatgataatactgttacaaccaagactcagtactctagtgtttatattgtgtattttatataaaattacacaaaatagccataaaataatcaaatccagatacactgttttgacttctgctacaactacacgtgtctccataaaacagaaaaggcagttaagaaaaatgggatgctccctcctcagactgggtttcgggagcaaacaaacaaacaaaaaaacataaaatataagcaccccacccatgcttctgatcctgtcttccctttctggtatggtagtaccggaagaaaggaaatcaggaactggcttgtttctgcagcactggagaggactgtggtttgttggggaattacgcaccttagcgcactctaagaaaaggaagtaggaagcttgtctctgaaggcacagcttgccccattaagttggttcatggagacccatccctatcccttacaacttctcactcaagaataagctactcagtcaaaacagtggccagaatctgactaaccatagtccaggaggaatgactattaattttatttcccaaagcattcatactgagataaaaattctcaagaaaagctcttaccttgagagtaaggatgaagattcaatgtgacatttggggcattttatttttatctttatgttcaaaacaccaaaataaataagacttgtttcaattttaaatcatttgtgcaaagatggcttaacttggttttttgaaaaagcagaagaggtaggaaaggattgagataaactgtcgttgatttctcaagccaacccagaaaccaataatcaatttcctttgaaggctgtgtacataccaacaatatgtcaaattatattctccttcattcaaataccacgactgtttttttgtcccctgtgtgatcgaattatcttatttctatgaaagaagaagcatttatcttctaatcacatcaccaaaatttttcgggttgaatagattttatctcaatcttgttaaaggctttctttttttttcagaaccactgactgcctacagacacagaaaccaaattgtctgggcttgaattcagtgccacgacttgggaaagtcattgaattatgcgtgtgtcttgatttccccattgtacaatggtaataatagtaatcctactgttgggactgatgagagggattcagtttatatgagtatacttagaacagtgacttctaatgtacttagatcagtgacttccacaaaatatgctgtaattagtgttatatattatttttacttgttgttgttattcatgtctctttcattctaggcccattccagagccatcattcttgaatacttttcttggcattcctagaacaactgcactattgcacatgttcctcttagtttctcccatcatgtttgctggagtacagccacaaataaatttcttagaaagaatgactcagataacatttctattttcttgtctgaaaaatgactgtattgtgctgtgaaactttaatgctgagtggctggaaatactggtatacaattattttctattaaaacttagaagacactgcttctttgtcctcactcatactacattagtgatcaaagtctagtgctacttgaatagttgtacatttattagtgacatgtcatttttctctggaaacatttttacaatctcttggaattttttaaaactttttccactgaaagtttagaaggtttatcaatatatgggcctttcttcattttttttctataggcccttggagggctatgcaatctaatgattttttactttcttcaacaatgagaaattaattcaaatatttattatgaaatatttttatccatttttctgatatttttattaatgtattttcttcttttaaaaatttatttatgaaggaaagaggtttaattggttcatagttccacatggctggggagtcctcacaatcatggcagaaggcaaagaaggagaaaagtcatgtcttacatggtgtacagaagaagtgcaggggagctcccctttataaaaccatcagatattgtgagacttattcactatcatgagaacagcatgggaaaaaccaacccccatgattcaattaccttccaccaggtctctcccacacatgtgggaattattggagctaaaagtcaggatgagatttgggtagggacacagccaaaccatatcattccgcccctggcccctcccaaatctcacgtcctcacatttcaaaagatggcttcctaacagtcccctaaagtcataactcatttcagcattaacgcaaaaacccacagtctaaagtctcatctaagacaaggcaattcccttccacctatgagtctgtaaaatcaaaaacaacctcctggattaattttctatgaatttttatctcttttctctcagtttttgaattttgcattctgccagacttatatttgggtatatgtgttatgtgtgtgtatttcttttatttcaaagggctttttcctggtctctaaatgttgcctgtttatagcatttgattcttactttataaatttgtctttacatatcaatcataatttttaaattctcttctaattcctgagttacctttgtaatttttggtcttttgaattagctattctgttagtttttcaccttattgctgttaattttcttcatttgctgaattatccttaaccatttatttctattttaacaattagaaattgggttaatctaaatattatgtatgaatttcctccaccgttgtacatgtaagtccttttccctaatcagttgcctctttttttaaaattttattattattatactttaagttttagggtacatgtgcacaatgtgcaggtttgttacatatgtatacatgtgccatgttggtatgctgcacccattaactcgtcatttagcattaggtatatctcctaatgctatccctccccctccccccaccccacaacagtccccggagtgtgatgttccccttcctgtgtccaagtgttctcattgttcaattcccacctatgagtgagaacatgcagtgtctggttttttgtctttgcgatagtttgctgagaatgatggtttccggtttcatccatgtccctacaaaggacatgaactcatcattttttatggctgcatagtattccatggtgtatatgtgccacattttcttaatccagtctatcgttgttggacatttgggttggttccaagtctttgctattgtacatggatgcaaaaatcctcaatgaaatactggcaaaccgaatccagcagcacatcaaaaagcttatccaccatgatcaagtgggcttcatccctgggatgcaaggctggttcaacatacgcaaatcagtaaatgtaatccagcatataaacagaaccaaagacaaaaaccacatgattatctcaatagatgcagaaaaggcctttgacaaaattcaacaatgcttcatgctaaaaactctcaataaattaggtattgatgggatgtatctcaaaataatatgagctatctatgacaaacccacagccaatatcatactgaataggcaaaaactggaagcattccctttgaaaactggcataagacagggatgccctctctcaccactcctattcaacacagtgttggaagttctggccagggcaattaggcaggagaaggaaataaagggtattcaattaggaaaagaggaagtcaaattgtccctgtttgcagatgacatgattgtatatctagaaaaccctaatgtctcagcccaaaatatccttaaactgataagcaacttcagcagtctcaggatataaaatcaatgtacaaaaatcacaagcattcttatacaccaacaacagacaaacagagagccaaatcatgagtgaactcccattcacaattgcttcaaagagaataaaatatctaggaatcgaacttaaaagggatgtgaaggacctcttcaaggagaactacaaaccactgctcaaggaaataaaagaggatacaaacaaatagaagaacattccatgctcatgggtaggaagaatcaatatcgtgaaaatggccatactgcccaaggtaatttatagattcaatgccatccccatcaagctaccaatgactttcttcacagaatcggaaaaaactactttaaagttcatatggaaccaacaaagagcccgcatcgccaagtcaatcctaagccaaaagaacaaagctggaggcatcacactacctgacttcaaactatactacaaggttacagtaaccaaaacagcatggtactggtaccgaaacagagatatagatcaatggaacagaacagagccctcagaaataatgccccatatctacaactatctgatctttgacaaatctgacaaaaacaagcaatggggaaaggattttctatttaataaatggtgctgggaaaactggctagccatatgtggaaagctgaaactggatcccttccttacaccttatacaaaaattgattcaagatggtttcaagacttacatgttagacctaaaaccatagaaaccctagaagaaaacctaggcaataccatttcagagacctagacatttaaagataatatggctaagaaagagcagaaattttatgtttccatatgtgggaaaacattcttcttctgttttgaaaagcaaaatttcatctcacttgaatgatggtaattgcaacaacaaacatattaataaaattatgctcattttctttaattttcatcctgtccaatatgattttaccactttccatatacaacttgtttatttttaagtacagttactactccaacttgctcaattgcatctaaactttaaaaaataagcaaaaccccatattattttggtattaatatcaaatatttatataatattttactttattataatctttcacaggtaccatgttatttgaacctcatatagatgatatagagtacctaaaggaaaagattattatcctaatcttacacacatgggaataaatattcagagagattcagtcactttcccaagctagtaagtgaaatcgcacaatctgatggtttccagacctaaagctagagatctctgagcagtgtgttccaataattttatctcctcaggttttaggctgccaggcagagtttatgtgccattaatcatctagccagttgtctttatctgcgagaaacctcattctttagacctgtgggccatatacatatcgtcatttttacatgtatcccttaatagaaacatagttggaaagtattgctacaggccaccagtgtctcctagagacatttacctaaataagtgttctctattctaaacacatcctgatattaagttattaaatcttatcatgtggccttacctaaagtgcatttctctctttagatcatataccaattcttgaccacatatctcttactatatttcaacaagaaacagctaaagaaatatctctgtatatacttcaggaagatagagaaataaatggattaatggatgaatagatatatgatagatagatagatagatagacagatgatagatacttgtagatacagactatgcttgatgctctaaatccaaataagtgtccaattaattagctattttcttctcaagttgaagttcaacatgcctttggatgctatggcaataattaaggttctaatacactcaataaaagtaacaaaaatgtaacttttgaatattgctttactattcacaatctgctgggtacttttatatgtgttttctcttttaagttttcacaataattttgtgaattatccattattccatgattatccctaagtttcaaatgagaaagtgtttatttgttagatatagttccttttacaattactttaagttcattatcagcctagaacttcctaaatgttctgaggaatgatcctgactagccatctcatttctgctaaacaaatccttccactaatgtttattatttggtctccttgtaataactaacaaaattcttagaatgtaatgttttctctttcttgactaacatatcctgagactaaatgagttattcagctatcctgagctagggttattagttccacctacatcctcaaactttcagaatcctcatctccacctaaagtaaaggatttaaaaatagaccacagttttcaatataaaattttcttaaaaacacagaactattaaaagacataattcctaccaaggagaaaagatggtcatttcatcacacaaatcctttataattggtatctctccattggcagtgcatttgctagtaatccccttaagattagagggtgacaaactcacagcagtgcagaaggagcacacagtaacaaatgggaatcgtgaggacagaaaatcacatgactagaacagattcagaatcctgggctgctttatctaccacccgacattctgcctttcagcaaaaatagtgccataatgtgctccacaggcccaaagtcaaactcaatccccattctcacataaatatttcatattaaagaaactgtttcagagcctcagagcccacacaagcttgtttcaaaatgacagatgaccctctgccctacggagaccgatttcactgactacctcagtgtaagttttggaaagagtatcctgtgatgaatttcagcaacaacagttattctgctgttcacaagcctaacagccaggcagcaatgaagagccttgacaccaaattcctagccttaggttcagcagtcaggacagcaatctccttgaatgtctggtagacacttccccgccttagtgcttgatatgtggcagattattaacttcagaattgtcagaatgacaaacaaggggaaagcacactctgaagagtgcttgatattaggaatgccttgtttttaatgttagtcagggactttaaaaagcttatattctaactgaccattatattaaagttaacaatgctgacctaaaaacaccaatagtctcgtcagttctttaccaaaatgtctgtattcttggacagacaccaaaagcctttcatctttataaacttccagcattcctagatccaacagcagacatatttccactctttattctaccaggtccaaaataacagaaaagtagtggaaagagagatggcaatgggttggtatttacaaagcattttcctgttttatccatccattcatttattcagttaatcatcagtatttattgggcatccattatatgttagtcagtggtatggctatggagtggtaagataaaatcaagttctatgagcagatccaagtctagtggggttatagggagagggggagagagagagagagagagagagagtgtgtgtgtgtgtgtgtgtgtgtgtaaaatagtattaataggtaaccatgagccagatataatgtagaacttcatggccataaaataaaaaaaaatatattcatatacttttctaagtttgattagaagctaaagaaaacatctgagcaggaaaagaacatgatcagatttactctgtagacatatccctttggcttcactgtgaagaatgtgagaaaatacagaagtagagcaaccagttgggagttcaagacaagtgttggaacgaactgaaggtatttaagactagggtaagattgtcaagggggttaaaaatttaccaattttgaacaattttgaagttagatctaagaaaagtgaatgtggggcttgagaaaacaatccagaaaagctcttaaatttctctaaacagctggatggctggtgctacatgctgaaatcaggagaacttaagggatggcagcaactaagagttctatattaggtctagaattatgaatgccttgtagacatgcagtagaattattacattggcagttggatatacagatccgagagaggttcaggatgaagctgcaaattgaagattcatccatctaccatataggtgatatttaaatctatgagattaagtaaaatcagttatggggtgagagtagacagagaagtgaagtctaagggtttaactttggagcagttagtcagaaatgctaagtgaagaggctgattcatgaaaggagactaagtcatgagtaaaataagaggaaaatcaggatagtgtttttttgttcatattcactttggctgcaggaatcattttggggagtgtgaggtagtgttacctccaataagaagtgaccacagttcatctagtctaagatggcctttgttttccacatttacatcactgatatcagcatgcatcttgtaatactggtgtcttcagattgtgtcacaatttaattggcagagtttttaatgctggtacataaaataatagtgcattttgtaatttgtatacaaattttattggatctaattcttttggatctatttcttttagatctaattcttttagatccaatgaaatttaataagatgactatacaacacagcacaaacacaggttagagatatttctctctttctctgtttctcactgtctcttgtctctttctccattaccattaccatatttaattatttgaatacttaaggattcttgagaatttcttaagagaaaatttattttcctaatcgaaaataataagtaggcaacaaattaatgagttcctacatatgatatttgagaagaaggataaattcccatggtatattatctgtatgtttatcatcacatataatacttcataaagggaggataaatatacagatgttccttgaattacagtgggtttacatcccaataaacccattataagttgaaatattgtaaataaaaatgtatttaatacacctaaaccaccaaacacaatagcttagcctcacctactgtaaatgtgcccagaacacttagtagcctacagtcgagcaaaatcatctcatgacacagtacattgtacagtgtcagttgtttacgctcatgactgtagctgactgggagctgaggctcacaactgctgcgtagcatcttaagaatatcgtaccacatatccctagcctggggaaagatcaaaattcaaaatttgaaatacagtttctactgaataaataccacttttgcaccatcatgaaatagaacaattcaaagtcaatccattataaactggggattatctgtgttatgctctgattataaatccatcaaatgaaaacttactctgttatttatcaagcaatacatttaaactattcttataaatttcacaactaaaacatatcttgataaaatgttaatgattactttcaatttactagaaataaagaaaattatggcacatgctagaaaaaaacttttgttcatggtaattttgcaacaaaattgtatcttcaaatatttaataattgctcttataatgaaaattggccttggaagtgaatgtaaactatacagctatccaaaattgttatgtaactggaagtagtaaacaactcattattttatcaaaaagtagttagcagtatatagtcattgtacatttgtcatatacaggagttgttttgcattgtaacaagctgatattcctgcctaaattaaatattgaaaaattatcagcaaaatatgtgaagtatatggatatggagaataccaatatttgcaactcattcctgctaccagtaatttttaaatggagataaataaataggatactgctggattggggactgttttataattttcttgcagtttgttttcattaggttattaagttgttactctgtttcaaagttgaggatgaacaattaccctggtttaccattttgtaaacaagtattcatgtcagtgacactaaattgttcagctgcagtaatgagtcaaagatcaattaagcacaagacccataatggatcaaggcacaaagatttttttttcccccaatccatttgaatttagaaagagacagcctggcttaatctgtcttctgaaacgcaaggtcagcagactggaggatatcagctgccactctttttgacatctccaatcaatcaaccttgattagccatggaattggacttcagagttaagaaaattatgtttctcacctcctctactaatgcttgagatgaaagcaaaatgcatcttgattttaaattttaaacaaattgtgaagtccaatttttatgtattactcaagccttgtctgtaagacccataaattcacaaagttaaaatgtatttcaataaagagccagacagcttttttatttaaaaatggaattacatttctaaattataacataaatataactttaaattacatatctcacagaattatttttatccaaacatcacatttattgctacagagaaagtgatttctaattagatgaaataaaaaaaatagtctgcagggtatgtttccccaatgaccatgaaaacaatttgcatttcagggattagagtatatatttttattagaagaatgacaaggccaaatgaaacccagacaatctgactacaaagccaaagctaagcagaccaatggaagcaaaaccatctggaatatttggcgtcatgctcatagaatacccaaaattggaaatgggtcactttgttgaagttggtgtgtgtgtgtgtgtgtgtgtgtgtgtgtgtgtgtgtgtgtgtgtgtttgtctaacagggactctttgttttcttttctttggtgatgttttcctggtatgcccagatttgttctatgcaaaggctatgtaatttatctctgagtatgactgcatcatctccttcttctctctgccctctcatcccatttcagagatttttttctacaaccttggccttgtcctttgttttgcctaggccatgttaacgtaatccactaacatattttatttgagtaaatccattttgttttgcttaaaatattgggttatatgattcaactctccatttaacacttgtgaacaacttgtttttaccatattctccagctataaaatgtgtggtcttttggagtcagtatctgtattgagaaatttaatacgcttcatattactaaaaaaaagacacactttctttcatatttctgccaagaggtgagatctgttacctgtccacacatgtttcccatttgctacttaatactattagaggagttcctgcttcaagttttgggaaccttgcttgccatttcctatgacttctcaataggtgatttatgaaacacaaccatagtttgcatgtttacaaaatgtttatgcaggcgtttcttcatggcttctacatggcaaatgaagattcaaattttccttgtgaattggtttctagatttattgcctatgaagacctggggaaaccctagacaatcttacagttcctgctccctaggatgtctattgaaaagtgtactcctcatctccaatgttgcagacacaataaataaaataaagtggtaaaatgatgacaaagacacaagtaacctagtataagtcttgttgtggctgggaaaagaaaagataaatctttcacatccatatttttacagggtaattttcattaaaaaattacttctggctataatgctcagatgaattgactagtcaggctagtgtattataagtactaaaaaagatgaatggaaaacaatatggcattggttatcaacgagggtcaaaatacaataatctcactctggagtgaaaaagtaatccaaagatccaaatgaggatgacaagtcatagtgagaagcacagggaagtacagtcaaatctactaagcaaaagtcagcaagggtagctacagaggttgaataagttcaagagaaaggtaaaagtgttacaagttaagatgaaggtgcctgggaacactaacttcaatgacttgatgggtgcttctaactccacctgactgtagcttataagttaccttttggggatttaataacctatggcctcataaactacatgtatgactatctcacagagaagatagaggataataagagctgtccaatcattgcttgaagatatgttatcaaatgtccctttttcagattacagtcactaatgttaattattaaatcattaaacatatgaaaatttctttggcagaataaaccataggcttggacatataagcgatcttcaaaatgtttgtggaaaatgtgtattatgaaaaaagtatgtatggatttccattttttgcaccaaaataaactcctgctaacttattatgacatgtctgaatagaatatagtttgagatactaagaagaataacacatcaatttgaaaagagcccctataagagcaaccttaatatgctaaaattgaagcaagaacaaacatcaaatgtatggtgaagcttgagtggatgaatggtgaattcatggattctttacaaaaagtttatgggaacaatgccccatataaatcagcagtttatagaaacttattttaagatgggttgagatgatgttgaagatgaagcctacagtggcaaaccatccacatctatttgcaagaaaaaaatatttgtctgttctcaaattgaataggactggcaattcatggcagaaacaatagccaatatcatagacatctccattgttttagcttacacaattgtgactgaaaaattaaagctgagcaaaatttccactgaatgtgtaccaaaaccattgtacccagatcaactgtagacaagagcagagttttcaatggaaattttaaacaagtaggataaagatcctaaagtgtttctttcaagaattgtaacaggagataaaatatggctttaccagtatgatcctgaagacaaaacacaatcaaagcaatggctaccaagaggtggacatggtccagtcacagcaaaagtagcctggtcaggaacaaaggtcacagcactgtttattttgtgtgatactcaaggcattttcttgttgactttctgaaggaccaaagaatggtaacatctgcttattatgagggtgttttgagaaagttagccaaagctttagcagaaaaatgtccaggacagtctcgccagagagtctttgtccaccacagcaatgcttctgctaattcctctcagcaaacaagggtaattttgcaagagttcctacgggaaatcattaggcaaccacgtcaccattctgatttggctccttctgatttctttttggttcctgatgttaagcaatctttaaagggcatctgtctttctttagttaataatgtcaaaaagacagcattgacatagttaacttcccaggatcctcagttctttagagatgcactaaatggctggtatcatcacttataaatgtgtattactctgatggagtttatattgaaaaataaagtttacgttttatgcttatcttttattttggagtttatattgaaaaataaagtttatttttatacttatcttttacttttattttgtcatgagctttttgaagccctcttgtatatgcctgtaaaatagaaaattctatatattgttgtaaaaatgtattgcataactcttatatacgaacaggaatataccatcgaagtggggcacagaaatagaaagataaaatgcatagtacttttcaagagcttataatatatggtgggaggcagaaaaagctataaccattcaaatagttactaagttatttattgtgataactttggggatgcatgtgataagcacctactgtaggcagaataaaacatcacactagataatatcaaagaaataatgtgtgtgcaagaataatgcatggcaaaacacgttcaaagtcatgagagttgtgtctttggacagacataggaggaagaaatctcacttcattagagattaaggaaatctggtttataaaggctggatgaaatagagagaaaaccaaataagatgaacagtaggaggtataaagaagcagataagctgaataataccagatgtgtttagaggtggtagtatcttagtttaactggagcacagaatatgtgttcagaaagagaaggaggtgggtatagaattaaaagtggagaaaatcaatatttttgtgagccttcaacattctggccatgcggtatacaaatttacgtaaattacttcatttatcttcccaaccatactatcaagataggcataatcatcaccaacttaaagatgaggattttaaaagacccagagctactataacttaatttagatcacacagatgtttagtgggaaaactagaatttgaaatcatgtgtatttcgttcttttcatgacaacatattgcctcacgcaaaagtcagatgagactaaaacacaaaactatctgtttttaatcaggttcctgggtttgtgacaatttatgtaataaattttctttaatagtgatttaagaaactctaatcaaatttttttcacactattcgtctcattcatcatatgttctcatctctaataagaaagtgcaaataaaaattacttgtcttttttcctaccagaatcagaattaaaatgtagtaagttctgtttcaaagcttggaatagtgtgaggtagagatagacctataatctgtagtgttttgtcaaaatcagtggcaggcatgacgttaatcatttttcaataatatgttaattcatggaaattgcctaacagtattatattattgaaaggaaaatagcaattctacatgaatttgagctatttaccaagtttctttaccctagttttaaaaatttgcagaatttcttttgttttcaggaaactcgtttggagcccttcctcatgaagattaaataattaaagtatgagaaagtggagagcccaatgtgcgacatatgtatattattaaatgtatactaatttatttattcattcatgcatatgatttaattacattttattaatggaaacaaatcagctatgggagctaatttagatgccaaaatattgcccgtgatactcactgaatgaatttgtcacctcctcacaaaatgtaaatttgttttcagataacacattataatctaaagtggtgaaaggcaggataatttctttttaacttgccttataagaacaacaccaacagtgaatagacactaaatattcttggcaaagaaaactaattaagaccccttttcccattcaactctccaaatacatagcccattgccttaattttttattatatatatatattttgctatacataattttcatttggtgcattttatttactactgaccactctcaaaaccattgctgtgtctgagaatcaataggaatattgagactaaacaaaactctaaaatagtaaagtaattcttggagtagttgcagtaataagaacataattttggtaaaaatatgttacgtagcctgagttttctaaaatcagaaacagaagggtgtatgttgcacaggtaatttactaaggagaaacccaataggcagtagggaagcagtcctggatagggaaagcaacttggtgaagttggaagcagtactggatagaggaagcaacttggtgaggagtcagtgacagtctagccacaccctggtcccaggggatctctggagaatgaatagctccacagagtgccctgatttaaggcaaggtggcaagacttgtacagtcattgacccaggagggtgtaacccctcaagaatctccggggaaggtgatttctgtcaatctagaccagttgttattaatgtgtggtcccaagaccagcagggtcagcatcacctgagaatttgtaagacatgacacatactacatcagaaactctggaagtggggccaaccgatttgtgattgcataggctctccaggtgactctgatgtatcttgaagtttgagaaccactggcctagggcaatcttccagagaatgacaaagctgtgagctcctagcatccagtcctcacagcattaaatgctgacttaacaactctgtgaaggaagtccagatcagccaccaacagcacccactacatgttaaatgctttagttgtattatagtaaatcatccctctcttgtattaactatttgtagcttctgtaaacttgataatttaacatctgccctatgctagtgtccagaagactctttgttctggacaatccaatagtatgtctaaatcaccttgctttggcttcctacctcactcctcacccctcccttcctccttctgggagggcacttttcaaatacaaaccagctactccagagttcactctcgatcacctcatttattgtactctcacatctgctctaatcacccccacagcaagggaactggacaactagaaatacctcctttgttctagagcccactgaaattattttaaccagccaatcctaaatctatttatgctgtctcacctattctttcccaccaaaacaataataaagtcctctgccttaaagctccttcccatccctctgctgcatgaccaacctctgatgtattccccccatgacgtaacacacctcctgctttaagaaactgtgagtaataaactatcttttcaatggcaattgttttctgatctgttggacttaccgtatctcaaattttctattaattcactatattttcaaatctatctctaccacaatccactcccttgtggtgcacacaagattcatacccaggaggtatgaagagttataccagtgtgtgtgattccattacctccactggtttggagttaaaatttcaatttcgggcagttagaggaagagagattccaaagagaatataaaattatacctcatacgatttcttataatgtgaatcccccttttattttaaacaagcataatcaaagttcacacaaagatagggaaagtatttgcatttaccacataagagttggcctagagaagaaattcaactgtcctctgtgccagaatttacatagattttcctttgaagcatcacacttcagttgcaaactccctttgtgctcacatgcagaacacagttttaattttattataaagactgtaatatgtatactttttgtcaaaacaaacaattatgtgctctttgttttcacggtgtgaatggttatgccaaggctgacactttgggtgacaaataataataaatattaaacacaagtaccaatgtaaaaggagtgtaattatgtaatgaagctattttcccacaataactaacgtgacatgcatcctttggcattgatttgcattggatatttctacaaattgcccagagtcagcaacattgctttattatgtgctaatacttgttcatgaatatatgtttcaattttgagtaaagatttttttttatcaaagactttaaattcaaaagtgtgaacacagtcccagctctagtgaccttgtctttcaggtattctctggtgtgccaactgagaaaattgcaggagatacattcatcttcatcatgtgtgtttgatagcagttattgaatttttaaaattaaatagtttgcagcctattttagagtccaaaattttctgttaaattttctatcttatgagtgatttatctgtaggtccaaaacagtagaggctataaagctgtggcccaaaagattcttgctctgtgaatagattaaaaggtttttatctcactagaagaaaagctaacgctttacacagatgccaaaatccaatggtgtgcaatatgcacaagttatatcatcttcagtggtcaaagcttggctagagactgatgtcagcctcctttgtgaaatattccttgaaaaacagaggttttagctacttgaggattacaagtcactactagcataattcaaaatttaattctactcctgattttatcaggacaaggaagaataaggtttaaagtttacagggccaatatcttagcttttaacatagaggaatatttgatgagcttatcatcacctagcaagcctatcccatgctgtgatgatataaaggaagctgatattctatgtcacatagtttcatttataagacttagtttatactaggagaaaaaagattaagaaatacaattcaaaacccacagcattttaaatgtattattttcccccaattgtaaactttttagcatagaaaattgctttttatactaggagctcatgatttattgtgtcataacccccctaacctattcaatcagatataatgacaattgtggtaaaaacaaggataatggtaattacaatattaataatatagctgcaatttcataagtgtttataggtgtcaaaattgttctaaatgctttggatatacgcattatcattagaacaatctcattaggttcattttccagatgaatctgagatgagcgcctaaacctatatatgggactctggaataagcagattggattcaaatccaggctctgccactgacaaggtggataaccatgggaacattacttgatctctgacacacattaattgaactgtaaatagctgaccatttaaaagacccttaaagtgaagcctctttataatatgaatagtatttctaacatgaactgtcagctttacttctgaaatgtgttttgatttggtttcctcctacccacattcacagttgttttatgagtctgtaacttcatctatctcacctagacaaaacttattctcttcctctactaccagtggtgttttagaacaagctgtaccggctcataaaattacaattgttaaaattcaggaattctgaaatctggttattaaacaattggcaatttgaaatcagccacagtgggagtgtttacaccagagaaatctgtaaattctacaaatctgtgcttttccttctccccatcgcctgctggagatccagtttaccagcaaattaatcctactctgctagcctagtaatattcaaaagcacacatctggtcacttttttacatactgtacttctactgacttcccagttcctggaacccaaattacttaaaattacttgtaatcattttcataacttaataataggcaatcttcccagctactccaactctcatttctttcatcaaacaacaaatgtatactatgttacaataactcttgacttcttaacattccccaaatgtattatgaactctgcacatattgtcattcatagtttcatttgcctagaattgtcttcatatgatgtatattaggatatttcttccttgttcttcatgattcaattttgttttctaatctgtataacttccctaaatcctttctcacttcaggaaaaaagaaattcctccctctgctctttttaatagcacatttgtaaatgtgaaccttaaacttatcaccttaatttatatttgcctaggtgtctagctaaacagatccaggatgtgagactgtggcttattacctagagtatagtaggcgcttatcagagaaaaagttctctttaggtagttagcaggtaaggaaaactctactcaagactattgcaataggagtcaagactactgcaatagggtagacagactgaactgaacccttctaaaacaaaagataggagagcctttaagcattgaggtgatctaggggaaaagtgctggaggaccttgcggaagcagtgttggtcattgtgattaggccacctgtgtttgctaattgtattatcaaagttaggcttctaccctttcacagaaacaggtatggaggctctatctttcttaatgattatatttgaaagaaatggctcccagatccttgagaaagaaattcctgatttgtaaaacacacaagagcccagcaaagatttgcttctcaaagggacagagaaagaatttacaatttcagattttctaaagtaaatactctaaaaaagggagatcagggacctaaagtcagaaagaaaccagtttatgccaggctttggtatcaggatgatgctggcctcataaaatgagttagggaggattccctctttttccattgagtggaatagtttcagaaggaatggtaccagctcctcttgtacctctggtagaattcgtctgtgaatccgtctggtcctggactttttttggttggtaagctactaattattgcctcaatttcagagtttgttattggtctattcagacattcaacttcttcctggtttagtcttgggagggtgtatgtgtccaggaatttatccatttcttctagattttctagtttatttgcgtagaggtgtttatagtattctctgatggtagtctgtatttttgtgggatcggtggtgatatcccctttatcattttttattgcatctatttgattcttctctcttttcttctttattagtcttgctagtggtctatcaattttgttgatcttttcaaaaaacgagctcctggattcattgattttttgaagggttttttgtgtctctgtctccttgtgcttgtctgatcttagtatttcttgccttctgctagcttttgaatgtatttgcccttgcttctctagttattttaattgtgatgttagggtgtcaattttagatctttcctgctttctcttgtgggcatttagtgctataaatttccctctacacactgctttaaatgtgtcccagagactctggtatgttgtatctttgttctcattggtttcaaagaacatctttatttcggccttcatttcgttttgtacccagtatcattcaggagcaggttgttcagtttccatgtagttgagcggttttgagtgagtttctgaatcctgagttctagtttgattgcactgtggtctgagagacagtttgttataatttctgttcttttacatttgctgaggagtgtgctttatttccaactatgtggtcaattttggaataagtgtgatgtggtgctgagaagaatgtatattctgttgatttgggatggagagttctgtagatatctattaggtttgcttggtgcagagctgagttcaattcctggatattcttgttaactttctgtctcgtggatctgtctaatgttgacagtggggtgttaaagtctcccattattattgtgtgggagtctaagtctctttgtaggtctctaaggatgtgctttatgaatctggatgctcctgtattgggtgcatatatatttagggtagttagttcttcttgttgaattgatctctttaccattatgaaatgcccttctttgtctcttttgatctttattggtttaaagtctgttttatcagaaactaggattgcaacccctgcctttttttgttttccatttgcttggtagatcttcctcaatccctttattttgagcctgcgtgtgtcattgcacatgagatgggtttcctgaatacagcacactgatgggtcttgactctttatccaatttgccagtctgcgtcttttaattggagcatttagcccatttacatttaaggttcatattgttatgtgtgaatttgctcctgtcattatgatgttagctggttattttgctcgttacttgatgcagtttcttcctagtctcgatggtctttacaattcggcatgtttttgcagtggctggtaccggttgttcatttccatatttggtgcttccttcaggagctcttgtagggcaggcctgatggtgacaaaatctctcagcatttgcttgtctgtaaaggatttttttttctccctcacttatgaagctcagtttggctggatccacaataaaaaaagagaattttagatcaatatccctgatgaacatcgatgcaaaaatcctcaataaaatactggcataccgaatccagcaacacatcaaaaagcttatccaccatgattaagtgggcttcatccctgggatgcaaggctggttcaacatatgaaaatcaataaatgtaatccagcatataaacagaaccaatgacaaaaaccacatgattatctcaatagatgcagagaaggcctttgacaaaattcaacagcccttcatgctaaaaactctcaataaattagggattgatgggacgtatctcaaaataataagagctatctatggcaaacccacagccaatatcatactgaatgggcaaaaactggaagcattccctttgaaaactggcacaagacagggatgccctctctcatcactcctattcaacatagtgttggaacttctggccagggcaatcaggcaggagaaggaaataaagggtattcagttaggaaaagaggaagtcaaattgtccttgtttgcagatggcatgattgtatatctagcaaaccccatcgtctcagcccaaagtctccttaagctgataagcaacttcagcaaagtctcaggatacaaaatcaatgtgcaaaaatcacaagcattcttatacgccaataacagacaaacagagagccaagtcatgagtgaactcccattcacaattgcttcaaagagaataaaatacctaggaatcgaacttacaagggatgtgaaggacctcttcaaggagaattacaaaccactgctcaatgaaataaaagaggatacaaacaaatggaagaacattccatgctcatggataggaagaatcaatattgtgaaaatggccatactgcccaaggtaatttatagattcaatgccatccccatcaagctaccaatgactttcttcacagaattggaaaaaactactttaaagttcacatggaaccaaaaaacagcctgcattgccaagacaatcctaagccaaaagaacaaagctggagacatcatgctacctgacttcaaactatgctacaagggtacagtaaccaaaacagcatggtactggtaccaagacacagatatagaccaatggaacagaacagaggactaagaaataatgtcacacatctacaaccatctgatctttgacaaacctgacaaaaacaagaaatggggaaaggattccctacctaacaaatggtgctgggaaaactagctagccatatgtagaaagctggaactggatcccttccttacaccttatataaaaattaattcaagatggattaaagacttaaacattagacctaaaaccataaaaaccctagaagaaaacctaggcaataccattcaggacataggcatgggcatggacttcatgtctaaaacaccaaaagcaatggcaacaaaagccaaaattgacaaatgggatctaattaaattaaagagcttctgcacagcaaaataaactaccatcagagtgaacaggcaacctacagaatgggagaacatttttgcaatctactcatctgagaaagagctaatattcagagtctacaaagaactcaaacaaatttacaagaaatcaacaaacaaccccatcaacaactgggcaaaggatatgaacagacatttctcaaaagaagacatttatgcagccaaaagacacatgaaaaaatgctcatcatcactggccatcagagaaatgcaaatcaaaaccacaatgagataccatctcacaccagtcagaatggcgatcattaaaaagtcaggaaacaacaggtgctggagaggagtggagaaataggaacatttttacactgttggtgggactgtaaactagttcaaccattgtggaagtcagtgtggcgattcctcagggatctagaactagaaataccatttgacccagccatcccattactgggtatatacccaaaggattataaatcatgctgctatagagacacatgcacatgtatgtttactgcggcactattcacaatagccaagagttggaaccaacccaaatgtccaacaatgatagactgtattaagaaaatgtggcacatatacaccatggaatactatgcagccataaaaaatgatgagttcatgtcctttgtagggacatggatgaagctggaaaccattattctcagcaaactatcgcaagaacaaaaaaaccaaacaccgcatgttgttacttgtaggtgggaattgaacaatgagaacacatggacacaggaaggggaacaccataccctggggcctgttgccgggtggggggaggggggagggatagcattaggagatatatctaatgtaaatgacaagctaatgggtacagcacaccaacatggcacatgtatacatatgtaacaaacctgcacattgtgcacatgtaccctaaaacttaaagtattaaaaaaaaaaaaaaagaaaccagtttacagttaaactaaggggaactttaaggccatcttggtcatgtttgacaaatgtcttaagaattgtttgtgtttgtcaccagtgatgtgaatcccattagttatatgcattctaaaatcatttatggctaaaagcaattaatactttgacctttctatatagacatactaagcatataaatggtgactaccgattgttgttatcttgggaatatttttatagtagtctacctaaatctatgttcctacaaagctgtgtgcataaaaaaattgtattaacaaaaccatattttaaatgttgtgaaatagttgagtatttaaagaacccttaaagagaagactgtacatattttgtataataccacaaaattaaatgttttataaaaatttatttcctaatctggttccccttttaaaagtaagttatttttggtgttttggggataatctcttccttgatcgcagttctagttacacaggtgtttagtaattcactgagatgcacctttatatatcacttttctcatatatatttcaagataatcatttttctatatatctattatcctttggtaaaagaagatatacaaccagtgatatgagatttgaaattacagtttctgcattagacgcctaaggcaaattgcttaattgctctgtgtcttagttcctgcatctataatgtaatgtcatttacctaaactactagttaacataaatcaaaagggatcatatatggaaagtatactacataaaactctaagttaaacaaatgtgagttttatgaatatattaatatttataacattattgttattgttataatgtgttgacatgtttgtatttataatataatattttatttagagttccttaattgctcacatgaccctgagtggaaaatgattaatacactgtgcaatttgtttatgctaaatttatttatttttgcctttgttaataagtttttacacctggtcttaacatagagatttttgtttttgaaaaataaattgttttttccaaattttcaatgttttagataaaaactttcaaatatagaacaaagtggaaaaaaatttgcagtaatcctctgtatctaccacctacattctcccattttctattgcttttttcatataggtaatttctttacatggagtacaattcacctatgtaagtgtacagccttaagagttttgacacacaaatacatttgcataactaccaccaaaatgaagatatgtattttcattttcattttcccaaacggttatcaaatgccagttggtaatcatttccttcccctacttccagctcctagcaacctcagatatgatttcttttcccttgaaagtttttgtttctttgaaagtattagttttcctaaattgacaaacgaaaatagcatatatttatggtgatgtgatattgtatgtttgtgtgtgtgtgtgtgtatatatatatatatatatatatatatatatatatatatatatatacacacacacacaaacacacacattgtggaatggctaaatcaaggaaattaacatatccagtaccccacgtggttttttggtttgtttgttatgtttttgtggtgagatgctatagttttatgttttccagaatgttatataaatggaatctgtattagtccattttcatgctgctaataaagacatacccaagactgaggaatttacaaaagaaagtggtttattggacttacagttttacatgctggggaggcctcacaatcatgacagaaggcaaggaggagcaagtcacgtcttacatggatggcagcaggcagaaggagagctttttcatggagactctcatttttaaaatcattagatctcctgagacttactcactatcaggagaacagtatgggaaagacccgacctcatgattcaattatctcccacagggtccctcccataacaggtaggaattatgggatctacaagatgagatttgagtggggacacagagccaaaccatatcagaatcttacagtatatagctttctggatttgactttttttttaatttaatgccattcaaattcatcaatgtcatgtcatacatgtcaactatttaactaacatgtcatacatgtatttgtagttatttcttatttgctgaatattactccattattcaactgtaccccaatttgattatccattcaacagttgatggacctttggtttctctccagattctggcaattatgaatgaagctgctataaatgtttacaaacagtttttgaatggaaatcgatttcatttctcttagagaaattttctcttggaggaacattatattcctagatgtaagattgctaaatcatatgataggagtgtgtttaacttcttataatattacaaaaactgttttccaaagtggttatgttgttttgcatttctcccaatccataagaggatgctcactgcacctcatcattcccagaagttggaattgttgaatttattttcattttatagccattctattagatatgaagtgatatctcagtatagtttcaattttaatttccataataagtaatgatattgagtaattttacatgtttattagctgtctatgtcttcgctagtgtgtctgttcaaatctttttccattttttcttattgtgtgtttatgttctccttggtaaattgtaatagttctttatattttctgtacacatcttttattaatatttctttacaaatttttttattttaatatttatattcatgtttgctctaatttttattttcttcctcctgcttccattgagcttacttttctgttcaattactaattccttgagatgcagggttagattcactttgacattttccctattatcctaatataaggatgtaatgtataaattttctttcgaatcctatacctccactttacatatttttatatatttttaaaattttattcaatccaatgtatttaccaatttcccttgtgactttctctttgacccaaagttattgagaagtgtatttttattttctaagtgtttgggaaatatttccaacatcttttcattatgtactctagtttactcatttggttttcaattctttatatctgttagtttatgttaaggtagaaaatatagtctcctggtgaatgtttcatgtgtggttgaagagaatgtgtcttctgctgtttggtggactgttcaagtatgtcaagttgattgattatgttgttcaagtctcatatattcttaatgtctttgtgtctttaggagagaggtcatgaagtctctacatgtaattgcaaacttgtctgatttttctctctgttctgtcagtttcttcatatagttttgaaggaaatgtacatgtaggcataaaattattaaatctttttaaggaattgctttcattatcattgtaagttttcatttacctctgctaatattgtttgttcagagtttgttttgatagtaatatagcctatctttcttctgataactgtttgtattatatggcatttttaatcattataattttaacatatatatgtttatatattaaaagcagatttcttttaaaagtatcgaatttctggcttttgaatctaatcttccaaacttttttctattggcaatttagaatatttcacatagtttcacataacataaacctatatagttttttaatagttattaatatgattgaatttaaatctgtcatctttctagatgttcttgcttttcccatcatttttgttttattttactccttgttttgaaacacacaaaaatgattatttttatgattacacatttttccctactagcttattaggtttacttgtttagaatgttttagtttcattaacacttaaagtatacaactttaatataacagtctactttcaaacaatatgatataatttcacacatattattaaaaccttgcaacaatatactctaactcctccaagttatcctttatactgtttgtaatacatttgaattttatatgttataagcatcacaagatagtactttttgcttgatgattgtcttttaaaataagtaatgaaagaaaaaaagtattttataattactctcattttaccattactaggcacacttcttctatttgtgcagatccaaatttttatcttttgcctgaagaataatgtttcttgtagctcaattttgctggtatttttttttaacttttttctaacagcctttattttgccttcattttattttgccttcattttatttttcatgattttttgatggaaaaatagaatttgaagttgactggttgtttcttctttcagcagtttaggcctggtttgcataatttctgataaaaagtctgatgtcatgactcttggatgctctggtcttttcattattttttctcttttgtttcattttggggatttttattgatcaaaattaaagtttcctgattctttagctttgttcattcttctaataatcccactgcatgaattctctatcaatgatattgatattttatttctcgcattttctaaaagcgtttctagcttttatttctagcattttcatttgactttattctacagttttagtctctctgccaaaactccttgtttatctgttaacaaatgctgtcctctttttccaataaattctttaacatgttaatcatagttattctaaagtctttgactgctcacccttttttggtcttggtgattacttatttgttgaaaataaatcacattttatttgcttgctttacatgtttcataattttttatggaatgctggatattatgtagtgaagagtagaagctggtaaagatagagtttctgctcattgataggcacaactcttgtatcatcaggcatctagtataagctttggattaacgtagccagttgagtttggtttgagttttattttttatcatgattcaaattgcttcagtggtggtctgcctgttactttgttcttagtgcgtgtttggcaagctagagaatcctctcaacatttatgcttactctgagctttcaacagttccttcagtcctgtgctacagctaagagtctccacatcctccctcagtgttagactgatgctgtttctttctcaatgctaggcttttgttttaggcaagatagattttctctgttgtctttgtccagcttctgtcttaggcaggtcctaagaacctatacctctaaagttaggcatgtttagcatttctggcctttcttctactggcatccaaactgagtttgtatctgtggttgatcttgaacaggagctttatatctcaatttcagtggattataaatgtagcttccagggaaaaaaactggtcccacacctctcctgtagatgcattttgcttatatgtctctcttgcacaaatggattttttgcctgtgccctgatagtaaaaagttttgttcctcctcttccagctgggtaagaattttctttgtataaatggtaaatccaggaaagagtacaagtttttgatctgtcactttcaaaactgccaagcacctcagcatttctatgagctttttagatcttctgccttgtcccaatctgaggacgctgaggaagagcttgcaagtgagtgaaaactcttttttttcccctaggttccccagctgttctaaacatggcctttaagaacgtgttaaaattttagctgatttcttcttaactggtgaatggcagctaaatctttctccaatttcctgtcatagttagaagagtgggtttcccttgtatctccttggaggacattgaccttatttaatatttagttggcttgaataaactcaaagtgagtccatgactggctaaaaatatgacaaataacttagcctccaacaatatagttgatatgtgctctgttgatatttatattttttattatgtagactgacatgaccagacttcatttctgattacaaaaatcagcacagtgacgtagtttcattaagtatttaaattttaagataaacattttcagccgggcgtggtggctcacacctgtaattccagcactttgggaggccaaggtgggtggatcacctgaggtcaggagttcgagaccaacctggccaacatagtaaaaccccatctctactaaaaatacaaaaattagccaggcgtgatggtggtacctgtaatcccagctactcaggaggctgaggcaggagaatcgcttgaactcaggaggcaaagtttgcagtgagccgagatcaggccactgcactccagcctgggtgacagagtgagactctgtctcaaaacaataaaataaaaataaataaaaaataaaaacattttaaaggcatccaggtatgacaagcaaatcacttacaaggaagagaaatcaaattggcctcgagattctctatacaagcataaaatgtcctaagacaattgaaaaatgtccaataaaattatacccatccaagggctcataagcttcaacatgataattaggcacttacaaacaagaagttaaaatgtgataaaatttggcatgtatattagacgtagacctggcatgatgtagcactggattaagtgtgtgtgtgtgtgtgtgtgtgtgtgtgtgtgtgtgtgtagtggtagtaagggaaagaaaggtattaagaatgatgacagggtccttgttcttttgtcttgagaaactgagtgaataatagtactttttgctgaaataggaaagattgatggaaaatcacattatgaggtgagaggcacaaatcaaaaagttctattttagacatgtttaacttgagatgcctattaatcattcaagtgacagctgggtttatgaatttggagctcagcagaaaagttagacaagaggacatatgtttggaactcttcacccaatttatagtattttaagcaatacaactaagattaaatagaaaaacgttttagagaagtaataaaatagagcttacaaccaagaaataaaaggttcaaaaagttaagaaaaaaaaacaagaaatgtactatcacagaaaaagcaagaaaaagtcaggaatcaggtagttgtcaactgtgtgaaattcaacaaagaagcaggcagaacactagggaatttaatgcaacttcagcaaagcatagaggacaaaagcctgatcaaagagaatttgaaagaaaatgggagatgaggacaaagagatggcaagatagattacttttaaattattctgtgaaaaggtgagaaaaaaaggcaaatgctggaataaaatgtagcataaacagtggagatttttagattaaaatgcattgtttttttcttgcaagatttgagataccaaagcacattggtttaattattcagtatagcagaaaaattgttggtgtgagagagaaaggacgggtcaagaaagactgaaatatttaggaaggaaggagggtgaaaatctgggtcacaagtacaggattggcctttagtaggaccacagacacttctttgtagtgtcaggaagagaaacagagcatgtgcgttacaaattcggtaggttataggtttgtttacaggaagattaaatcattcctgtctatatcttgataagcaaatatgaggtgaagatctcatctgagagtagctaggggattggagaggttggaagagagaagaaaaatacaattgttgtccctgggaatgggaattctcacttattggggaaatgtaaaaaattgtctgaatatgttgattacccatttcagctgtgtgggtataaatggaaagataattcgtgtaacctgattgaataattttctacagcaaaattcaacttttcacatataagtgtagtatagaagaagtgttggattaaatagatttgcagttcagctaggtgaataagaaggggaaatgtcaagaaataaggattttcctaataattttgatgaaacaccagatcttgaactggaattttaattggaagatgaaactaatgattgataacagaaaagaaaatagtaaatttgtccagctgaattaatagaaaaatgaggaggaggcaggagtacagggaaatgcttaaaagtggaattttggaagtattccgttacaaattagcgtggttgtgttccaataacgttttacttaaaaataaaacaggtggcagaccagatttagaacatgggccatagcttgcagactcctatattaatgggtgacatggaactctactagtctaaagtagtgttcagaagatactgctttatagttccaagttcaggccacaggtctagactggggtaacagtttctctatcactaagacaatatgaccaagtggatgtcatgatactagccttagccgtcatgcataagatgctggagggagcttctggagaacccctcaaaaagatgtattttacaaagtgataagcagatccttgccgcagaacacaatggggacctcttgatttctgctatgaaacttctctgacactgttgtaaatgaaaccctgtagcatcctgatcagcactcatataaaaacatgcagaaagtccagagtaattaacactttcagtgccagctttgatccacagagtacaggaaataatggtcagatgtttttgtcttttatcacctgagtacatagttttaatagatattttataagacttctcagaattttctgcttgacagtactagttgctcatagtcacggccaactcagttacataggcttgtatttgtttccccttctgcattttgctttcttcatctctctactgatcattctgagattaccttccccaaaacaccacctgtatcaaatgctcatctcagaaacttatttcaagggaactcagtgcaagatgtcctattaaaactgttttaaaatgcaaaaggcaaaattgcattatattccaatcttccaagataagaacaaagaagtttttatttctgcatgcatttatttatgaagaaacataatatcccccccaaaacctaattttagatacaacaaagaatgtggaacaatgaatctccttttctttctcatagaaatgaaaacgatgtatttgaatacagatttaggagtcaaatataatcaaatgagtctgtaagctgaactggtcagcagtatttgatataattccaagtaacttaaatgatgcctctgaacctctgtataaagaaattaaactaaaaggcaatttgtttttcacagatgaaaacacaaatcagatttttaaatgagactatttctattttctctactattttgtgtggcttcttcatttctctttgtttttcatagagggtgttcagaagagaagtttagtaagttgaggtagagtattcaggaaaagaaaactaaccctgttaatttatttattttgaatcatatttggagtcatagcatgtagctttacctttattttaacttggttatgggggaaaatgaagataaatgatagtcttccctcctctgtttgcatattttgttctttatttctctaaactagagatgtgctgagtgtaacacaatatgtcactcttaaatgggttactacttctatctgtcacatttgatcataagacacaccggtttggggcatgaaacatgcaaataaaaatcagggaaataaaaacaatttccattttcacttaaaaattcacaaactgtggtgctctgagcagcatatggtagttaagaaaatatgtctttcatttgtcttgctttcacagaaaacgcaatttggagaaagagtgaatgctgaagatgttttcgtttagctgcccaagcatttgggagtgctatgaagatatcacttaattgaaagagaggctatgaagtcttgttcccctcttgtcttgagcctaatgtgaccaaagaggttagatgtgatattttaactcatcagttgacggaaacgttttgtataacgtacccaaataatcaaaatttccaaaacaaaacatggcgctacagttgccctttggttcttcattaaactgagtgccttgtaaaagctgtaaccagtgtttgacacaagagaagcctcagcaacactagaaaaaatgattaattatcaacatctgaatttcaccattagtcaaatctcagcctgccctctctgcctgtagaatcttgtctgccatgatgactcctgttagaaatcatcttacttttagtttttagttttctctctctgatttgtagacttcacctcttttgctagcaaaaagttccacaaagcacaatttttcactttttacgattagcaagccccatgaaatacaacataatttattgtgtatgagacaattctgtgcctattgattctacctgttttgagaaaaaaagaaaaaaactttaattaccaaaaaaaagccattaatgcaatcttcttaatatcataaggttactttgttcagtttcagatgattcacgtgtcacatctggtaaactaaacccagggattttttaaaaagtagttgtgaaccgtcaaaggaaaaagtagaagaaagggtgtgaagaggtaagaaaaagagaagaggtaacttggaattagaagttgctgctctgccaattagtaccttagactaatctctttaactctctgagattccatttacactgatatgagactaataatacttgtatcaccaggttgttcaaggagaatatgaaatgatatatatgaataccttctttagctacaaaacacttaacatgttatctaccatttctcagtaaaactgcagaattttaaggtagagtatatctagttggaggatagtttataaaataataataatatcttaacgatttattatgcattaacatcaactgagataacacccaagactttttttttggtatttcataactcttctatttttagaaagccaatcgatgactattttctgtattcatatttccagttgaaatatactttcttgatctgataatttttacccaataacatttagtgattttgtagcaagtcacaataaagaacaataaacactacttttcaacctgggcaattctgccttgaggtcatatttaaaattatcagtagaaagaaaagttattttgtttggatcaaagactaagacagtgacaaaatctgcatatccttcatcctctcactcttgagaatctttacttttgttgtgtatttgtctacagttgttagctcaacaatgtcacccaaggtcttgagatctggaacagctgcaactacagatcaaaagtcctcagaaagcaaaatttcttggtgatggcaaaagagaagaaaagtacttttccaaaaaaagtatttaagaagcactttggaatatatctaaactgcattgcaaacagtcttgtttagacttgtctttgacagactataccttacttagatcatcattttaattttgacttccatccagaagttgatgcctgaatttttacaggaaaaaatctcatgtttctcaactctaaggaatgaacacatctagtgctacttctctgagacagaaacagggataaggtgggggaaaaaaaagggtaaacccagaatattttggactataaagttagaaaattgtcaaagaaagagggagcatgttaaaaggatataggagccaaccaaatggacaatttaaacttcaaaataaataataatattaataggggataacccatcaactaaaataagaatcatgagtctatgctgttatacataaataaatggaaaatttgaaagcttaatgagaaatgggatatgtatatagtttcaaagtacatcctcataaaatactgattaattacaaggagaaaatgagcaactttgcagtgaagaagcctggcagacaccaccttaatgaagtgatcaaagtcaacagtataaataattaaataaactaaaatactttgccacttgacagaatgcaatgagaaaaacatagcatcccatgcacttaatgaggaacatgagccaactccaagtagaaggccgtaccacaagataaatgtacaggaatctttaaaaacttcaagctcatgaaagctaaggaaaaactgaggaactgcttcagattgaaagaaactaaagaggaatatttaaatgcaatgcatgattctgaactccatcattctgctctaaaggtcactattggtgtgattgatgaaacctgaatgatgtctgaggtttagatggcagtaatgtcccaatgtttatttcttggtattgatggttattgtaattatgtagaagaatatattgtttgtagaaaatacacactaaaatattcaagggttatagaacatcaagtgagcaagcaacatatcctcaaataccatcatggaaaataaggtttgacaatgcacttgcaacttttctgtagatttgagattgtaatatattcataagtatcagaaacaaattattacagtgcataggcattgatccacaggaaaaaaaccttgattattttaatagtatttcttaatttcatttaattaaagaaaaaatcaatgaaaatagaattatatttagtgaaacgtaaaatcccattcacacctttcctacttctcaatccactttccaagtgtaaacactagtattggccttttcctgtgaatttatatgtatgagaatagcaatgtaacgaagggttaatactatactactaggcagctagtctgcctgagttcaaatccctctgagttcagatctagtcttagcagttctgcaaatctgagaaagttacttaacttctcctcacagcaatgccttcattttggcaactgggttggtaatcacatctaatgaataaggtagttataaagattaaatggtataatacatatagaggtcctagaattatgtttgcccataataatcatgctcttatagacaggtgtgtctagttttccactaaaaatgagatcaaaatataaatatagttgtgcaattttacttttctatatgtataatatacatatagttggggaattttacaatcagtattccacattgcttttttgtcttgttttagtaaaaattattattgtaatttttcttaataaaactatatcatgaacatgtcttttcatctatgattatagaggagagctgattagaccatcatgcttagttcaaaaattccacaactctgctggttatccatttttttccgaggacccaaagtgcttttctctatatggtagctccattcagaattacctttgaagcaatcccaacagcaccaggatgtctgactgacaacctgagatcccaagttgccctctaaatgccaggagatggacagcagctgatgtgctcagcattcaggagaacaaggaaagccagcacaggtggaaaggaccagaaagatgagatcagaccagtcccaatgagatgagctgggtacctcagttggaaatgcagaaatcacccaccttctgcattgatctcactgggaactgcagaccggagctgttcctattctgccatcctgccagccagaatgggtgcagcccacagaggataagccaaagcagagtgggttgtcacctcacccaggaagcacaaggggttgaggaactccctcccctagccaagggaaggcatgagggactgtgccctgaagaagggtacactctggcccagattttacgcctttcccactatcttcgcaacttgcagactaggagatttcctcgggtgcctacgccatcagagccctaggtttcaagcacaaaactgggcagccatttggcagacaccaggctagctgcaggagtttgttttcataccctagtggcacctggaatgccagcaagacagaaccattcactctcctggaaagggggctgaagccagggagccaagtggtctagctcagctgatcccatgcccacagagcccagcaagctaagatccactggcttgaaattcttgctgccagcacaacagtctgaagtggacctgggatgctcgagcttggtcaggggaggggcgtccaccattactgaggcttgggtaggtggtttcccatcacagtgtaaacaaagccacctggaagtttgaactgggtggagaccaccgcagctttgccaagccactgtagccagactgcttctctggattcctcctctctgggcagggaatctctgaaaaaaaggcagcagacccagtaaggggcttatagataaaactcccatctccttgggacagagcacttagaggaaggggcagctgtgggcacagcttcagcagacttaaatattcttgcctgctggctctgaagagagcagcggatctcccagcacagcactggagctctgctaagggacagactgcctcctcaaatgggtttctgacccctatgcctcctgactggacgatacgtcctaataggggtcaacaggcacctcatataggagagctctggctggcatcaggtggatgcccctctgggatgaagctttcagaggaaggaacaggcagtaatttttgctgttctgcagcttctgctggtgatacccaggaaaagacggtctggagtggacctccaagcaaactccagcagacctgcagcagaggggcttaactgttagaagaaaaactaacaaacagaaaggaatagcatcaacatcaacaaaaaggatgtccatgcaaaaaccccatccaaacgtccctaacatcaaagaccaaaggtagataaatccacaaagatgaggaaaaaacagtgcaaatgctggaaaattccaaaaaccagaatgcctcttctcttccaaaggatcacaactccctgccagcaagggaacaaaactaaatgcagaatgagtttgacgaattgacagaagtatgcttcaaaaggtgggtaataacaaactcctctaagctaaaggagcatgttctaacccaatgcaatgaagctaagaaccttgaaaaaacgttagaggaattgctaactagaataaccagtttatagaagaacataaatgacctcatggagctgaaaaacacagcatgagaactttgtgaagcatatacaagtatcaatagccaaatcaatcaagcgaaagaaaggataccagagattgaagatcaacttaatgaaataaagcatgaagacaagattagagaaaaaagaatgaaaaggaatgaacaaagcctccaagaaatatgggactatgtgaaaaggccaaacctacatttgattggtgtacctgaaagtgacagggagaatggaaccaagttggaaaacattcttcagaatattatccaggagaatttccccaacctagcaagacaggccaacattcaaattcaagaaatacagagaataccacaaagatattcctcaagtagagcaaccccaagacacatatataatcatcagattcaccaagattgaaatggaggaaaaaatgttaagggcagccaaagagaaaggttgggttacccacaaaggggagcccatcagtgtaacagcggatctctctgcagaaatcctacaagccagaagacagtggggaccaatattcaacattcgtaaagaaataattttcaacccagaatttcatatccagccaaactaagctcataagcgaaggagaaataaaatcctttacagacaagcaaatgctaagagattttgttaccactaggcctgcctttcaagagctcctgaaggaagcactaaatatggaaaggaaaaaccagtaccagccactgcaaaaacataccaaattgtaaagaccatcaacattatgaagaaactgcatcaactaaagggcaaaataaccagctagcatcataataaaaggatcaaatttacacataacaatattaaccttaagtgtaaatgggctaaatgccacaattaaaagacaaagattggcaaattggataaagtcaagactcactggtgtgctgtattcaggagactcatctcacatgcaaagacacacatggtttaaaacaaagggatggaagaagatttaccaagcaaatggaaagcaaaaaaagcaggggttgcaatcttagtctcagataaaacagactttaaaccagcaaagatcgagaaagaccaagaagggcattacataatgataaagggatcaatgcaacaagaagagctaactatcctaaatatatatgcacccaaaacaggagcacccagattcataaagaaagttcttagagacctacaaagagacttagactcccacacaataatagtcagagactttaacaccccactgtcaataatagagggatcaacaagacagaaaattaacaaggacattcaggacttcaactcagctctagtccaagcagacctaatagacatctacagaactccccaccccaaatcaacagaatatacattcttctcagcaccacatagcacttattctaaaattgaccacatatttggaagtaaaacatttctcagcaaatgcaaaagaacagaaatcataacagtctctcagactacagagccatcaaattagaactcaggattaagaaaatcactcaaaactgcacaactacatggaaactgaacaacctgctcctgaatgactactgggtaaataacgaaattaaggcagaaataaataagttctttgaaaccaatgggaacaaagacacaatgtaccagaatctctgggacacagctaaaacagtatttagagggaaatgtatagtactaaatgcccacaggagaaagtgggcaagatctaaaattgactccctaacatcacaattaaaagaactagagaagcaaaagcaaacaaattcaaaagctagcagaagacaagaaataactaagatcagagcagaactaaaggagatagagacacgacaaacccttcaaaaaaatcaatgaatcaaggagctgctttttgaagattaaaaaaatagactgctagccagactaataaagaagaaaagagagaagaatcaaatagacagcataaaaaatataaaaggggatatcatcagtgatcctacagaagtgcaaactaccatcacagaatactataaacacctctatgcaaataaactagaaaatctagaagaaatggataaattcctggacacatacaccctcctaagactaaagtcgaatccctgaatagaccaataacaagttctgaaattgaggtagtaattaatagcctaccatccaaaagaagcccaagcccagatggattcacagacgaattctaatcctctgtacaaagagaaactggtacctttccttctgaaaccattccaaataatagaaacagagggactcctccctaactcattttatgaggctagcatcattctgataccaaaacctggccagagacacaacacaaaaagaaaattcaggccaatatccctgatgcaatttaatgtgaaaatcctgaagaaaatactggcaaactgaatccagcagcacatcaaaaagcttatccaatcaagtcggcttcatctctgggatgcaaggcgggttcaacatatgcaaataaatcaacataatctatcacataaatagaaacaatgacaaaaaaaatgattatctcaatagatgcagaaaaggccttctataaaattcaacactccttcatgctaaaaattttcaatacactaggcattgatggaacatatcgcaaaatataagaggtatttatgacaaatccacagccaatatcatactgaatgagcaaacactagaagcattccctttgaaaaccagcacaagacaaggatgccctctctcaccactctattcaacatagtattggaagttctggccagggatatcaggaaagaggaagaaataaagggtattcaaataggaagagaggaagtcaaattgtgtctgtttgcagatgacatgattgtatgtttagaaaaccccatcgtctcagcccaaaatctctttaagctgataaacaacttcagcaaagtctcaggatacaaaatcaatgggcaaaaatcacaagcattcctatacaccattaatagaaagccaaatcatgagtgaacttccattcacaattgctacaaaaagaataaaatacctaggaatccaacttacaagggatgtgaagggcctcttccaggagaactacaaaccactgctcaaggaaataagagagaacataaacaaatggaaaaaatattccatgctcatggattgaacgaatcaatatagtgaaaatggccatagtgaccaaagtaatttatagattcaatgctatccccatcaagctaccattgactttattcacagaattaggaaaaactacttcaaatttcatatggaaccaaaaaaagcccatatagccaagacaatcctaagcaaaaagaacagagctggaggcatcaagctacctgatttccaactatactacgaggctacagtaatcaaaacagcatggtactggtaccaaaccagatacatagaccaatggaacagaacaaaggcctcagaaataacatcacacatctacaaccatctgatctttgacaacccttacaaaaacaagcaatggggaaaggacttcctatttaataaatgctgttgggaaaactggctagccatgtgcagaaaactgaaactggaccccttctttacaccttacacaaaaattaactcaagatggaataaagacttaaagctaagacctaaaaccataaaaaccatagaagaaaacctatgcaataccattcaggacataggcatgggcaaggacttcatgactaaaacaccaaaagcaatggcaacaaaagccaaaattgacaaatgggttctaattaaactgaagatcttctgcacagcaaaagaaactattgcgggatctggccagcagcctgcaatgcactggggctctctctttgttcccaggtggatcggcaggtcgagaaataatagacacacacaagatagtgaaagctgggtccaggggggtaaccgccttctggtcacatggtgccgccaatgcactggatataccagcatttattactaagtttagtgagggcgggggcaggttggtaagggatttagggtcatttgattatgaggtgagatggtcacatggggatgaagtaattctttaacataacatctgtatgcagaagtacagtatacagagataagaatttacaatatagtgtgtgtatcagtaatttctaacagagccttaaaacagaaacacagtctttcctttacctatgattagcaagattttaatcagcagtaacagttgcagcaaaagctggttacaaacaatccatagaaacaggacttgaagctagacaaccggttagaccagcaattctcagaagggagtatgccttaaccctaaagaggcctagaagagccgtggcaagatgagggcgtttatagccttatctcatccatatggacaggtgctccccatgcattcgtttataggctttccacaagggtcacattccattcccagagctatgaacatctgcttttctgggataggaatcttggtgatgtgaaacctccctgactgcacgtccattcacaggctctctacagggggaagcacatcacgcactgttggctcattctggcagtccaacctggcattgtctttacacaatcctgcatgcaattttgtatttacaataatcaggagcatttcatcttttattccatagcaatagtttcagggggtctccctacagaaactaacatcagagtgaacaggcaacctacagaatggaagaaaatttttgcaatctatccatctgacaaagggctaatatccagaaactacaaagaacttaaacaaatttacaaaaaacaaacaaacaaccccatcgaaaagtgggcaaaggatataaacagactcttctcaaaagaagacatttatgtggccaacaaacatatgaaaaaaagctcatcagcactggtcattagagaaatgcaaatcaaaaccccaatgagataccatctcacgccagttagaatggcgatcattaaaaactcaggaaacagcagatgctggagaggatatggagaaataggaacgcttttacactgttggtgggagtgtaaattagttcaaccattgtggaagacagtgtggtgattcctcatagatctagaatcagaattaccatttgacccagcaatcccattactgggtatatacccaaaggattataaatcattctactataaagacacatacacatgtatgtttattgcagcactatttacaatagcaaagacttggaaccaatccaaatgtctatcactgatagactggataaagaaaatgttgcaaatatacaccatggaatactatgcagtcataaagaaggaaaggttcacgtccttttcagggacatggatgaagctggaaaccatcattctcagcaaactaacacaggaacagaaaaccaaacaccacatgttctcactcataagtgggagttgaacaatgagaacacatggacacagggaggggaatatcacacaccagggcctgtcggggcttgggggactaggggagagatagcattagagaaatacctaatgtagatgacgggttattgggtgcagcaaaccaccatggcgcatgtatacctatgtaacaaacctgcatgttttgcaccacatgtatcccagaacttaaagtatatagaaaaaaaaaaaaaaagatgaggtaagactgtccttacttctggaggttgatggtagcagttgagttgagaatcaagtacccaaggtgaatcagaattgaagtttaagagtgcgtgcttaagacaccagaagtcactgctgcccatggtagcttggcagagcttgtaggaacatgtgaatctcaaaggtctaggaagaaagccagcagaaatcaggacccagcaatgaaaggagcagaaatagactgagagagtgggccacagaaacaagtaaacatgaacaacaggaaagtttaccctgctggcactgttccaaatctatgcttcattttaggacattttctatgaaggcaagaatcaatttccagcttgtctgacttgagtgtggtaaaagggccatgtttggttgaacctgagataagaggcgcaagcaggtcctgataatggcaagcctagtgtgtatcatcaaagatggcacacaagctgattttaggggccacaagccacctataactgttatgaaacccagtgatttccaaatattcttgaatgcctataatatgcagcacgaaagacagaaagaaactttgttgaaatgggattctgtcaggaatttatttttaactttgttttaactactatggcatcaaaatcttttgcgtagtaaaaaattgttctttctattcaagaagcaattgattatattatagggaatctttaatgtaatgtttagtaaaaatgtaaaaattgtggatatttttattaagcacactgagaaaagaattttgcactttaagatgtatctatttgaatgaagaataatattctaataccagttacaaattgtactgaaaaatgaaagagaggaaacatttagcctgggtgacaaaggaaccagtcactttctactctgggttctgaggctttgggttttgttggagaaagggaattagtagcttagtagctgtcaccttgcacacctccagaatgcaccatttgcatagtggtgcatgtagtgatgtctcctggtgttgtgcagcaagcacagcctgcattgttaaaagtagcagccttgctacaggtctttctctttaaagcttgttctacaatgatctgcattggatttggctctttctgtaatcacattcatattcttggtcttcacttttgcagttgtttaaagctgactttaagaacagcattttcaatttatttccatagcagctttgatagcctcagcatgctcttcagaatgcttcctgcacactaggccttaagagctaactgtcttatacatgatctctgtcatgccagaattaaatttcttcagcctagtattgcttctttgctacaaagagagaatgttatcttatttccttaagcaggaaaaaccacttttcaattagagtcatagctaaaattatatcctgatgtgcaactccttgacactactaaatgaatgttggcattactctttattaatattacacacaatatttataggctatatgccattttgcaacacataggacatgctacacttatgtagtaatatcaacatgaataagacctagtctctctcctcaggttacttttagtctaataaaggagtgataaggagcacagaaaattaaaattcagggtgttccttgagggaagtgtatgtaatttcactggcttctggaaggcaagtattcctatttgtgtcctcaaccacaagcacatactttaataattatttggcaattaaacaagtgctattctagcatatgaacaaaaggttctattagcctggaatgtgacaaaagatcttactgattctttgaaatggaaatggtccaaagaggaaagaatattcaatcttgactttcgaagataaataagatactggtaggcagagaaaatagacaaaccctcctggcatagacaatagtgtgagcaaaagtatccatacaagttcattctctctccctggagctctctttcccagatgtcagtgcctctcacccctcacttcactcgggcctctcctcagatgtcatcccaccagagactcctgcctcatgacctttgttaaagtaacactttatccatcactctctttccctttgcctgttattaaatgttacttcttattactaacttaaatatgtacctaatttttctcctaatttttagtatctgtctccctgacttaaatataagctccataagacaaagaaaatactattttgtccactgtcgaagcctcagatccaagaacaatatttcacgcagagaagatatttactaggaataattttttttaatttgtaggcaatgaagtaagtagaaacagggaagtataattaattgggagccttgattattaaggatagctttaactaaggagcattcccttctctggttcagctcaatgaaaaagtgaatacttgatcaccatacactccacttgggagaaacccagggttactaccatcactccaccatagaagctctctctgccctaaccaaaaagaggcacttcgcttcttgtaagttgccaatctcttcacattggcaaattcatttatctccaagcatacttttttacttgcaaatggataggccttatgttacccgaagaaggtaccttggtatctcaggcaatgaacagggccagggagccgccaaaagtccctgtcctttgtgttaagctaccagggcaggtggaagagcaaagccaggtgggggcttaggcaaatctgcactcttgctccttacatgcaggcacaagcatcagacccaatggagactggagagcagttctctgggcactagggagactttccagaaaggagcacagctgcctttgctgcacagaagaatccacatgggaagtggtgggtagcaggtggtagtaagccctacccagctcccgtgcatttgtcaaggtaggtctcacatttgtagagttccactagcagcagcttgctgggttttaagcagcctgcactgagaactcaaaactgccccaggccacaagccttccctgctgagattgaaaccatagatttgaaagcacacccctcccctttgcccatgatgcaggagcatccagctcctgcacccatggctacagcacacttcccactcacctctcagttctggccaagggagtttgtctccactcaatattatatcacatatcctaattggaagcttccctcactctgtgaccatcacccgagttaactggtggacttctgcaaggtcctctgtgagataggaccagtaatggctttcctccatccccactggagtctgggagtgtacacaaagcacatccccatgccactccttctcatctgctccccaccactcactaaatcagctcgagtgatggcaaggattaagacattcccctgtggtctggattaccaggtctcccagagggagcgtgtgtcacagaggcagtctctctcccctcacactctggagactcacagttttctgcctggctcatagtgtaggctacagcccacctcttctttcaaagggtctgtggtttatttcagtgtgttcctgttaagttcctatgttgcctcttggaaaatagttcgcagcatgaatttctacacactattttgtcttttcaggtgggtgaggcatgctagccgatgcctccaatccagcattgaaatcatcattcctgatgcaagtcagtgtctagctgtttcaaaatgctgagaagttggctggaattctaccaaaactatatgtcaatgaggttaaaatttttatatataatatataacatatatatttataattatatttaattccttctttctaagaatgtggcaaaccgctctattttagctgttttaaaatatttttcaatatgttttttgaattaaaaaacaataccaacaatcagatattgtctaaaaatatggcaagatttaggagctgataagcagaaatttagggatcaaagctcttcatagaattcttgtgatgaatcaagtacttttgcctatatatctgattggactgcaatggaaacaaggccttgtctcactcttaaacgctcaatggacatgagccatacataggctcataagttttcagactatactaactgaagacagcactgataggttaaaagatttgtctaagtttagacatctaattagacataatgttagaaaccagaactcttgtggcttcagtaaagcaattccagcactcaagtcactcatatctaataaatatgtatgtatgtgtcagtgagtgaatggattaatgagtctaaatttttccaacaagtcagttaattcttaacatgggtttttgcagatttctcacccatacatatgcaaaaacttctttggacacaagaaatttaatctcaaaaatatgacatagatttagtggcttataaataagcctagaccatactagtaacattttgacatattgttgcttgggtacaaggcccttaagtccgtcaactagtcccagtttcttggtcaataaataaaaagaaagctttttttatctgattatttacaggaaagcccactttaatcattttaaccaaatataacccattattgcttattatccaagtagaattctcccaactattctttaaaactctaagcaggaaatagagtaaggattaggactgccagaaaacagtacttcacctttgaatacacttttacacttcttttaagatgtaagaaaatataaagaatataaacttgactaaccagcattgtaaagagaagcatcatagcatcatatatatgtatatatatatgtgtgtgtgtatatacatatatatcatatatatgtgtgtatatacacacacacacacacacatatacacatatatgtatatgtagctgggcagccgcacgtgtagtcccagctactctagaagctgaggtgggaggttgaagccagaagttccatgctgcagtgcgctatgaccatgcctgtgaatagcctctgcactccagcctaggcaacatactgagatcctatctcttacaaagggagagagagagagagagagagagagagagagagagagagagagaaaattacattcctgtccttagcctttattcacatcagtaagagcactttgcttcaactttcggacccagtgatgcttgagcacatcatttttgattatatgacttaaaatgatgattaggagaagtcaggagttaataggagataggaatcaaggaaactagatactatacatatagcaagagtcatgaaaatgacacagaatacgtttggttcccatcacctctcttttacttatttgctgaaacatcatggatcagttacttaaatttctctgacatgaagtttatccaatgtaataaagacacattcctgagaggactaaattggcaatttttgtatatttcaagaatactgtgagttttaatacagttgcatcagccatatgtgagtactgagtacttgaaaagtgaccagtctgaattaagatatgctatatttgtcagatgaatcctggatatttgaagacttagtaactaagcagcaaaatacatcatttataattttacattgactgcatgttgaaatgatattttagatatatatatatagttaaatcaaatatattaaaattcattttactttttttacttaacatcgctaccagaatatttgaaaatacaaatatttatattgcacagcattatatgaatattttgccatttcccctcctagaccaaaatcaccttgacagtaagggttctctgtcttatttatcttgtggtcccaggatctagtaaaaatcctgacacaaagaagacctccaataaatatgtgtaaaatttacaatgagtaaaaatagtaattttaatcaggagttcttaatgcagtttcctaaagaaggattaccgcccttataaatatacaaactcagaccacatttccttggtttcctatcccattactcagattttcaaataatacttgttctggtctcactgtttcccataacttatgagtcaaaggagaaattacaagtaaaattagaaaacatattgaactaaatgaaaattaaaatgcaacatattcaattttaagcagtgtctagaagaatatttatggctttacaaggggaagaaatcctaaaattaattatttaaacttccatcttaaaatacggtttgaaaaaattagagcaaattaagctaaaaataagcagaaggaatggaataataattttagaaagaacagattctactgaaataaaaataggaaaatgaatgtgccccaaagcttattttgaaagagcagaaaaattgataaactcctagacagacagttcagaaaaaaaagattctacaatgaatattaacaccaaaacaagagcccattacaaacaatttactgtgaataaattcaacataaatacaatgaacaaatccaaaactaatacaacacattagaatagaagatatcttaaataattcatgttatttaagttaactgagtctgtagtttaatactttccacaaagaaaagtctagaccaatgtggctctaatggttaattgtataaaaaaaaaagaaaatgaaataatataaattccatgcatattgttgcaacaactagaaggggagggagtattttccaatgaattttatgaagctagcattactatgataaaacattgagacaaagacattaaaattaaagtacagatcaatatctctcatgaatatagaaacaaaaatccttacgaaaattttaacaaatggaatccaaagacaaaaaaaaattaataccacctgaccaagtgtacagttcaaagatatttgacaaatgaacaattctagtagtgcaagtgtagtttaacattaaaaacaattagtgtaattcacagtactaatagatgaaaaaaacaaaaccgtacagttatttcaacagatgcagaatatgctttgtcaaaatgtaacacttactgatgataaacaacaagcacaaaacagtaactcatggaaaacaacttaacattaaacttaatgatgacaaactaaatgctttcacccaggatcaaaggaaaactaaatatatgcattttcaacacacctattcaacattttcaacatgcctactcaacatatagaaggacctagtcagtggaataatactagagaatcaatatatagcctgtggatagaaaatgaagcaaaaaaaaactatttttacttatagatgaaatgattcttacaaatccattaaaagaaactaaaatttaaaatgggaaaacaaatgaccctgaaaaaaatgcacaaatgattcgtacagacacaatacataaattgttttaaaaaaatcctgaaatacggctcagcactattagtcatcaggaaaatacgtataaaatccacaatgatatgccattatgcatccattacaacagttaaatcagaaagacgtacaatatcatgtgctggcgaatatgtgtagcagtcttataaatttctggtgggattttaagtggtacaacctcttggggaaacagcttatttcagtttctcaaaaaactaaacatatacttatcatatgactcatcaatcctatatctatgcatttactaaagagaaataaaaggcacatattcacacagcttcaacatgcatgttcatagaagctgtattcatataatcaaaaactggaaacaaatatctagcaatatgtgggcagataaatacatttttggtaatatctagataatggtttattatttaccaataaatatgaatgaagtactgataaatgcagctacatgataaatctcaaaaaaccattatactgaggaacagaaaccacatatagaagaataatttttttttttttggctcaaacaatggaagtttatttgctcgtggatctgtttatgtggaattctagaaagggcaaaactaatctataatgtcagaaagcagattggtttttgccttgtgttcagggtgtttgtaaatgtgcaggggaatgaaggcagatttcactgtaaggatcatgaataaatttttgtgtatatattttatatttcaaatataatgataatttgtcaaaactcattgaaactttcacttgagtatattttctaatttataaatcatgcctcaataaactcatctgaaaaaaataggaattggttgctagggagagggaatagatatgaaaaagttacactcatgagaaaaggcacctagggaggaacgcataggacatctgtgggagtagtggcaagttccattcaattggaacagaagacaaatgaacagaaattgttgcaacacaaattagaacactaaatagagttagaacagtgaaggtcataaacatcagaataaacatctcaaacattatttgtaaactgataagaatgcatcaatttttatttgcctttctctgtttttcctcacctttcctctcttctctctcctcctttcttatctttttttttcttttttaacatttggagtaacatcctcagacaagtagatagacaagcctccagcaaacaatgggaggaagaatgccatgattcctccttaaattgtagaagctctctggcctctgctgtgcataatctgcctacccatcaaatcacaaaatttgtttgtttatataatatcatcctttctcacagcttttatcagcagagttcttaagttctcaagggaactgtctatttgaggaactataaggattggtcaaatatgctggaatactgcaaaggctaaaaaaatgagattctttataagactatgaatccagtgaactaaatattaggcaagacaacattgttttatccagatggctaatttgcatgactccgtttaacacttgatttttttccacacacatctccttattataaagactgttataagaaacacattacctcgtttggagagaaaaataccttgcagaaatctggcagccagatttgagtcttgctattcatgtttctaaaatgaaggcgaaaagaggtttaaaggatttgggactttgaaaaggcagtagctactttggtagcctcctgtgaatggtcttttcttagattaacaagctagtgaagttttaaatacgagctttttaaaataaagtcttgcttgaaaagttcaagatcaaaattcagatagtgtctcagtatcactattatttcaaagttcaattactgtgtgtaattaagcatgtttcaaaggttttatagaaaataaaacatttaggtgatatgaaattataaaaatgtgttaatatatgatataaaaatatgatatcaatatagcaatataactgttgttacttttaatttcccatcaagcagggatccccaatgtttgccttcagtctaaacactaccaaaattgttttctatttgtacatggcactcctgataattattatctctacttaataactgttttagcacattcttgtaatatcattgtatcgcacttgtaagtgtagaataagatgtctaaaaagtagcacagtagcattatctgaagtagaggtgaagcagcatcaacatttggtcatatctcacaccctctctgaaatactcacttctgtgaacttgagcattgcatgcccatcatggttgctctctcctagacaactaaagaaaaaagaaagttagtaaggaacagaatagaaaatttaatatttgggaattatagagatccacaaaccaaaggaatttgttatttatattctgtcaatattcaggctgaagccaaagaaattgagacagatttgaattctacttcactgagtgttgcttaggaaagtcacaaactctcttaacctcagtagtatcacctatgtaaatgatgtgtcagataaatctatgagagaactttgtagtattaaaccatattacacacagctacatggtaacatcaacattaacgaaaggcatgaatatgtggagacttgaatttgagtcctgacagcagaatgtgttaattttatgaatttggttggttttctaaatttctctaagtctcagttttctaatcactaaattaatgataataatatttacttcatagaatggttgtgaagattaagtgatgatcaatttaaagtagcatgcaaagtagctgttttttcctctgaagcaattctaagtgttggacaccagcacaaataaagtgactccctcttctatagattcaaaacaaatgtagactctacaaatataaggcagaacaaaacaaaacaaaacaaaatttaaaatatatagttgcaggtagtttagcttctctagtaaccctaataactctaataattacttcttccacatgtttttgttgttgttgttttaggtcagaatgaatactctctcactaatcaacctgatgtttttcttcaaaatattccaaaataaatgctacccgagtatgcaaagggaccagtatgcaaattcaattctgtattctccgcaactactgtttttttttaagaaatagttttcagaaatttatctatgtccccgagttaatcatttctttacccatttccttctgtttcatatgctcaggaacctaatgcttttttcaatagtttaaaaataattattttctacacaaaataaacaacaattacatgaccaccaaaagaagcttttaaaaattctcttttaattaacaaattgagatctgaaaagtttataaatgattgaaaagtaaaaataagatattatcttgcttaaaaaaatgaagcagcaggctgggcacagtggctcacacctgtaatcccagaactttgggaggctgaggcaggtggatcatctgaggtcaggtgttcaagaccagcctggaaaagatggtgaaaccccatctctactaaaaatacaaaaattagccgggcatggtggcgggcacctggaatcccagctactcaagaagctgatgcaggagcatcactggaacctgggaggcggaggttgcagtaagccaagatcataccactgcactccaacctgggtgaaggagcgagactctgtctcaaaaaaaaaaaaaaaagaaaagaaaagaaaagaaaagaaacaaagaaacaaaaacaaacaaacaaaaaatgaagcagcctagaagaaaaaatgacttaataaaagaaataaatgaaatagagaaatatgagccaaataggtattataaccctaatattttcaattctatttatataatccaaatatcaacaatatgctcttgtgataaatcagattgaattatcagtgacaagtggaagctttctctgctgctaagtcacgacagaactgaagcaatttgttaactacacattttgatgaatttctaaaaactgttctattaatgtattaaccatttataaaagagattttaaggaaatatagaatttgggtaaagtgatcataaacttttgaaaaagaaactcttttattatattaatatgcttaagaatgcaataaaataactgggtcgtaggagatcatcctgggaatattattattattatttgacacagattctcaccctgttgcccaggctggggtgcaatagcacgatctcagctcactgcaacctctcccttccgggttgaagagattctcctgcctcagcctcctgcgtagctgagattaaaggcatgccaccatgcccagctaattttttgtgtctttagtagagatggggtttcaccatgttggccaagctggtctcgaactcctgacctcgtgatccacccgccttggcctcccaaagtgctgggattacaggcatgagccccgcgcctggccaggaatattattttacccaagagaagttttaatctgtcctaatatccacagatcaacagaatatgggtatcaattacttaaatgaagagcttgataagaatttccaaaaggcatgatagaaagataattgtaaagggggaaacaaagaaagattgggcttaagaatgattagtggagatccaagaggagagcactttgtttggggaatgttattcacgtctacagtaaaaattagggaatttcatttgtaaacaggatggaatctaccagtgttaatggtagttgtcatggatacagttaagcttttcaaatcatctgaaaataatcagcctatacctgtcaatggaacattaagtatagaggaccagagaagtgaagacaaaaaataaaccattggatatttagacactattcattcctagatcatcaatgaaaggttatcttaattgcatgataattcaaaattcttagtcttttaatgtaaatgtttttcagcatttgtcaaaaaaagtaagcaaaacataaattaatatatctcttttatcatatatctattgaccctattctaaaatagcaaaatatacccaagttatggttcttctttcaaaaaccatgtttttgttgttttaactgaattttatattaaaagattctacactatttttaaatcggttagttatccagttggggaaatgaggcacatcaactttttactgctccctactttctgctctttaccacacagagcatggctaagctgccataatgaaaaagacataaaagaacaaaaaaagagaagtatgtgaaaaaagaaagagaaggaaggaaggaaggaaggaaagaaggaaggaaggaaggacaggggaaggaggggacaggaggcaaggggagggaagggagaggaggggaggggtggggaggggaaggggaggggagggaaagggaggggaagattagacagaggaaataaatttatttctcccttgaaagtgacatataatccagagtaggtaggcggctctgcttagtgagatcattcaggaactcaaattccttctgtcttcaggtttcattgctccccaaagttcttttgtgcacttttaacaaactcccagatgacatcgatgctgttggttggtgcatggatacactttctgtacaggaatgtgactctggactaatagagtcgcaactagctaattaaaatctaaaattaaaatatctttaatgtcgctggccacaattcaaatactcaattctcacagatgactggtggctatcattacagaccttggagaccaagaacattttcatcagcacagaaagtgatagtaagaaggctgatcttgagtatagtgtacttgtataatttattatctttagtgaccaattattactatattttacactactgatactttctagatttggctagagttatatttcttatgtcttgctaacagaaacaaacaatgttattctcataactactttctaactctcaactatcattatatcaaaagatcttcctgaattttatgtggacagatagtcttaactctttgtttgtattcctgagaccaagatttcccttgaattgtttttctactctaatgatttcttattttgtttcagttatttatttaacaaacattttaaatgcttaccataatcatagttaatatctacaaagactttaatatacgccaagtattataagcctttcactttatttctgtcttaaaattcttacatcaaaattaaatatattattttcctcatttgacagataagaaatctaagagatctaaagagggtagatacgatttgccccccaccccaccaaaaaataaaaaacagttaatgtttgaaatgtgattcaatgacaaaacttcataatccacctatttaactactgtgatatttcctttatgccagctatcttggtacctttaccctgactatgagaagaagggaagaggaagagaaaacaaagcatctgcaagctcaataagacatgatacattatcaggggataacaaacaagctcatcaatgctacagaaataggagtgaaaactagtaaatatctctacatgtatagaaactcagaaaacatagtttaatgatgcacaaactaaagcacttgggtcactgacccagaggaatcaagggactaattatcaacttgcacatgggacagtgattgctgcaaacagaaaccatattgtcctgtagtaactaatgccaaaaaggaatcagacacaccaatatcctctcaactggagaagaggcaggcaagtaatataaaagagaaagccggggaaacagatctatttgtagaattagccctttagaaaagtagattagaagagataatcaagccatgcaaagttcacaaagtcttctctgatttggtcaagtcagaatttgagatctgaactaaaatctggtccaaaaccacggagtgtaggaagccaatgacagataaaattgggcttaaggtaacaaacttaccaccgtaaaatcctgaccagtattgagaaagtatagaaaaggattcagcacccaagtgacagagcttcagacattgttagagtatcacatctgcaaaaaataaagccaaagttctaggtaaggcttcaactacgacgacgagcaactgtagtgccaggcagagctgctgaggcagagcctcagtcctctgctccaaggtgtggggcagagggccatgcaagtttgggactctcaaggccaagcgaatgttcaagggtcacatcatagatactggacaactcagatatttggcaataaaatgtatcctatacctagctggtaaggttggaactccttatatatactccttgagtaagacagggactaattagtctgactctgtgtagagcccaagacggtctggggaaaagcaacagttggcattctacattacacaaaagttgtcctgacctctaattctgtcatctacaaaattcctctgacttacgtattacttgtcagtcactgataaactgccttaactgtctttcttgcataagctctttaaaggaaaactagtattcatccgtatattttctagtagttttttttctccttcatacccatagaaaatatattccttatatatagatcactcataccctgaagtatatctacacagatttttaaaatacttattgtgtcttcttagtaaaagtctttgtgacttaggtcatatgactttgtttcaaaatataaacaatctccatttacaacagttaatgctattccaaagatttacttaggtagttacatttagtgtatattaaattttgttttctgattcctggatttgttatatttctttacaggatattctcttaatttttgaaagctatttccaagctcttcttctctaaaaattaagaattcacacacaatggttttatttctatgggctttttttttaaaaaaaaaataaatgttgttgtgtatatgcgacacttataacatgatattatgggattcatataggtaataaaagggttgctataataaagtagattagcatatctatcagctcacatagttactttatttgtgacaagaacagctacaatctacttatttaaccacaatccctaataaatataattttattaacattagtcattttgttgtacattatacctctaaattcattcactctacatattattttgtatccattaacctgtatctccccatttccttacctccttaccccaagcccatagtaacaactgtttcattctctatatctgtatgtttgaactctcttatacacactcacacacacttcacatataatgatcacgcaatatttttcattctgtgttgtttttgtcttcatatcaaacatttataaacaggtctcaggactactaaaattcagtcccactaatatgtaatttgtatacacccactggagaaacagaaaaggtaagagactgtaactactataaagaatctcagtttaacctggatgaagggaaaaagacacatgcacaaacaactgcaatgcaagtacacaatgataaatgctgtaggaaaactataaacatttcttgtggcagcaaaaaggaaaaagtgattgattaattaggattatggtattaagaaagagaagctttgcaaaggatatgacatttgagttatgccttaaaggatagttacttcaaaaaggcagagagggaaaatgagggaagggtgagggagagaaggatatttttggcagagggaggaaagaatccaagacctaaaattgcatgttttattcaaggggcaggaaatagcattctgtgtctgaagtctggtggggtaaagagaagagcaaagctgttggaagatagtagattcatacaaaaaaaggcattgaacacccaattgaaattcccttttaatccctaggaaatggggagccatacaaacctgactcataatggggaatcagtcaagagtatgttaatatcatatttgtagattttgatctctcctttctaagattgcaaagagtgttttcaataaagcagtactgtatggcagtaaaatgagttatttgactttcaaaatagattatgtaagagataggtatgatctagtccaaagcagtggtttaaaacaaaaacaataaaaacaataaaaagcaaaacaagccagttagtggggagagggaacatttgcagattgcagagagagtactaacaaagagctaagtcatcttccttagactccatttgcatatggaagactacattttatagttttagagaatgaatcaaggaggacataataaaagaaactgggactacaggtaaaggaagaggtgtcagaaaacacaatttgtttgaacatatggtagaggctttgatttcggccacacagctagcctacaattcccaacctcctttgtagttaattgggacatgtgactgagttctatctaagcatatatagcctgagtgatgtgtgccatttccaggcctggcaaaaaaatcctcccatgcatattccttgttctttctccttctgccacagaatgcaagtgacaatgcagccctatagggaataggagatgccttagttcaaggataagatgcatgagaatgagatgtactttccttgtaatgttccttgagtgatcaataaacctctattatttttgagaaattgtattgtttttgagacaatgaggtctatttgtttctgcagtttagccaaacagatgaattgaatttaaaattcctgtaatacagagattacaatataatgtgccaaggtgataaataaataggatcataaagttcacagatgagaaaaactcaattcagaatgagaaggctgagagagcttctcagcgattgatcttaaattgaggttggaagtttaatgaaataggaaataacgggataggcattcctgagaataggaaaaagccacccagctataaataaaagatagaaggccaggatttttgtgggttttatatattaccagttggattcttagaaatagagacaacttagtaagttttactgagatacaagagtttaaattcaattactaattattttgttcaaaggtagaactatgagaggttcttttgtccataggatcaggtaggtctttgcttaaagaatagacactaaaatcataggtaatcctcacagaagcttcaatgcagctacccaccctccctagacaaaatggtgaagcaagtaaagagtctccagaaaaaaaagtagtttctcatcacacaaatcaggatggggactgtcagcagacaaacaaaagtaaacgtgttttgacaaactgtgggtgccaatggaaattggatctttcctcattttgtcagaggagtaagacaacagaccaaattcttcttctgttttctgaattactctcctttgcaaatcatataaattttaaaaccaacctattaaacttccacaaaggaagacaggtggaaattttattgagattacattaaagttataaataatttgtggagaactggcaactttatagtgttaaacctttcaaccaatatatatcataaatctctatgtttatttagtcctattttaattgttcttgttgatgtgttacatcattttttatagagtggtgtttctcacctagggacagttttgtactgatgttattgaaaaatcctgttgtagaggtggggcaaatattttattagttttatttcctaatattttgcttagttttaggcaattgtaaatagtaacattctctctataacctttcagtttatcacattaaaaaatatcgttttctaggtgttagtgaatcatagacatacaattgatttctatgtactgatcttgtatccagtgaccttccaaacttcacatagcagttataacttcttaatattttctgtattcacagttgtggcagatttgtatccttctctccaagtattaaatattttcttttttcatgtcttataatactgattaagaactccaatgtgcatgtaatctaggaaagtcaatctcataggaacagagtagcgaggtggttgccagaggctgaaggggaaagaaagggataaagaaaagggaaatgctaattaataggtacaaacttttagttagacttgaggaaaaagctttagtgatctagatctattgcactgatatttaatcaagctaataacatatccaacacctcaccaactttttttttgtggtgagaatgttgaaaatacatacttttagcaattttgaaatacacaatacattattaactgtggtcaaattcaaaaaactcagataaaccctgggagatactatgggagatgaccatccccaagacacatagtcatcagattctccaaggtcaattcaaaagaaaaaatcttaaaggcagctagaggagcaggtccctaactaagggaaccccatcaggctaacagcagatctttcagaaagaaatcttatgagctggaagagattgggggactattttcaatatcctttaaaaaagccaatttcaaccaaaagttgcatatcccatcaaactaaatttcataagtgaaggagaaatgaaatcctcttcagacaagcaaatgctaagggaattcattaccgttagacctgccttacaagagttcctcaaggcagtgctaaacttggaaatgaaagaacaataactgcatcagaaaacacacttaagcacataccccattgacaccatagagcaactatacaattgagtctacataacaaccagctaacagcatgatgacaggatcacatcctcacatatcaatattgaccctgaatgtgaggaggctaaataccccacttaaaaggcatgaagtggcaagttgaataaaaaagaaagaatcaactgtctactgtcttcaaaagacctatctcacagttaatgatacccataggctcaaagtaaagtgatgaacaaagatctatcaggcaaatggaaaacaacaaagagcagggggtagctattcttgtatatgatattcaaacagattttaagcaatgatgaaaaaggacaaagaagggcattacataataataaagtgcttaatccaacaagaacacttaactcccctaaatatatacctacccaacattggagcactgagattcataaaactggttcttagagacccattaagagacttagacaaccatacagtaatactggagaacgtcaacactgcactgacagcatcagacagatcactgcagcagcaaatgaattaagatgctctgggcttaaacttgacacttgaccaattagacataataaatatctacacaacactccaactacaaacaacagaatatacatttttatcacctatgcaaggcatataagatgccttataaggcatatacgatgaaccacatgcttggccataaagcaagtctcaacaaattcaaaaaaatcaaaattataacaaccatactcttggactacattgtgatataaatagaaatcaataccactaagatatattaaaaccgaaaaattacatggaagttagacaatctgcttctgaatgacttttgagtaaaaaaaaaattaaggcagaaattaaaaaattatttaaagctaatgaaaatgaagacaacacaccccagaatctttggcacacagctaaagtagtgttaagagaaaagttttttgttccaggcatggtggctcacacctgtaattctagcactttgggaggccaaggtgggtacagattgcctgagctcaggagtttgagaccagcctgggcaacacagtgaaaccccgtctccactgaaatacaaaaaattagcagagtttggtggcatgtgcctgtagtcccagctactcaggagactgaggcaggagaagtgcttaaaccagagaggtggaggttgcagtgagctgagactgtgccactacactctaatctgggtgacagagtaagactccatctccaaaaaaaaaaaaaaaaaaaaaaaaaagagaaaagttttgagtactaaatgcctacatcaagaatgtatacagatctcaaattaacaatctaatggcatgcctagaggaactagaaaaacaaaagcaaaccaacccaaagttagcagaagaacagaaataaccaaaatcagagttgaatggaataaaattcagatgcaaaaatccatacaaaacatcaaaaaaagttggttattctaaagattaaagaagattgatagatcactagctagattaataaaggataaaagagaagatccaaataaacataatcagaaacaacaaaggtgacattacaaccaaccccacagaaaaacagaaattcctgagaaactattatgaacacctctttgcatacaaactagacaacctagaagaaatggacaaattcatggaaacacacagcctcctaatagtgaaccaggaagaaattaaaatcttgagcagactaacagtgagttcttaaactgaatcagtaataaaaacctatcagctaaaaaaaaagctgtggaccaaatggattcaaagccaaattctaccagatgtaaaatgaagagctaataccaatcctactgaaattattcaaaaatatcaaggacaagggattccctcctaactcgttctacaaagccagcatcattctgattccaaaacttggcggagacacaacaaaaaaagaaaaattcagtccaatatctctgatgaacacagacataaaaatcctcaacaaaatacaagaatacaaaccaaatacgaatgaaatcccacagcacatcaaaaagttaattcatcatgatcagaaaacccaatttctttcaacagtatttttaaattctcattgtggagatctttcacctctgtggtaagctgtattcctaggtattttattcttttgtggctttattcctgggatgcaaggttggtttaacatatgcaaatcaagaaatgtaatttaccacataaagagaattaacaacaaaagcgacatgatcatctcaatacacacagaaaaggctttgataaaattcagtatcccttcatattaaaaaccctcagcaaattacacattgatatattgacatattgaaggaagataactcaaaataataagagccatctatgacaaacccacagccagcatcttaatgaaggggcaaaagctggaaacattccccttgagaactgaagcaagataaggatgcccactcttaccactcctattcatcatagtattggaagtcctagccagagcaatcaggcaagagaaataaacaaaggtgatcaaaataggaagagaagaagtcaaactgtctctcttcctggaaaaatatgattctatacataaaaacccatagattccaccagaaggcttctagaactgacaaacaccttcagtcgaatttcagaaaacaaaatcattgttcaaaaatcagcattatttatctacaccaataacatctaagctcagagccaagtaaaaaacataatcccatttacaatagccacaaaataataaaatacctaagaatacaccttatcaaggaagtgaaagatctctacaatgataattttaaaatactgctcaaagaaatcagagacaacacaaacaagtagaaaacattccatgctcatgaataggaagaatccacattgttgaaatggccatacttcccaaagcaatttaaagatttgttgctattcgtatcaaattagcaaagtcatttttcacagaattagaaaaaactattctgaaattcatatagatccaaaaaaatattcaaataccaaaaagcaataatacttaagcaaaaaggacaaagctggggtatcacatttctcaacttcaaactatactacaaggctacagtaaccaaaacagcatggtactggtacaaaaacagacacttagatcaatggaacaggatacagaacctagaaataaagccacacacctacagccatctgatgtttgacaaagttgacattaacacacaatgggggaaataatttcctattcaatatttagtgctgggataattggctagccatatgcagaagactgaaactggacccctttcttataccatatacaaaaagtaactcaatgtgaattaaagacttaaatgaaaaacccaaaactataaaaaccttggaagataacttaggcaataccattcaggacacaggcataagcaaggatttcattatgaagacaccaaaagaaatggcaacaaaagcaaaaactgacaagtgagacctaattaaactcaagagcttctgcacagaaaaagaaactaacagagtaaacagacaacctacagaatggaagaaaatattcagaaactatgcatccaacaaaactctaataaccagaatctataaggaacttaaatcagcaagcaaaatccaaataaccctaattttttaaatgggcaaaggacataaacagacacctctcaaaagaacacatacatgtggccaacaaatatatgaaaaatgctcattctcattaatcattagaaaaatgcaaatgaaaaccacaatgagatatcacctcacaccaatcagaacaatggttattaaaaagtcaaaaaacaagagatgctgcccaggttgtggagaaaagggaacgcttatacactgttggtgaaaatttaagttagttcagcaattgtggaaagcagtttggagattctagaagaactttaaacagagctaccattcaacccagaaatcctgccactgggtatacgcaaatgaaaacaaattgttaccaaaaaggcagatgaacttgcatgtccattacagagctattcacaataacaaagacatgcaatcaaccatgatacccatcaacaatggactaaataaagaaaatgtggctcttatacactgtggaatactacacagacataaaaaagaacaaaatcatagcaacatggaggaagctggttgccattatcctaagcaaatgaaggcaggaacagaaaaccagacaccatacattctcacttttaagtagaaaccaaacactgaatacacatggactcaaagatgggaacaacagacactggggaatgcttgacggagtagggtgggcatggcccaccctgtaacctgataggctacctatcaggtactatgctcactacattggtgattggatcattcacacaccaagcctcagtgacatgcaatttacccatgtcagaaacttgcacatgtacccccaaacataaatgaaagtggaaaaaataaattaaaaaattaaatagtaaataataaggtctcagtgtttaagacaaatatcagtagctgatgtcttcatcttattcacagtctcaactggaaagttgtcaatagtttaccattaagcatgtctataaattgcctgtgtgtgtgtaatttattaaattaagcaaattactttatattcctagtttattaagattttttccatcagtaaatgctgaactttattaaatactatttatgtatctagtaataggattacataatgttttgccttttatactttaattttattaataaatgagtacctttcctgacataaattagcagttttgccaaacaattaaaatgttacacttttatttttaaaaatttgattcaaaacctattgaaatgctttacatggaaaattgtaaactatattagaaaaagtgtgtttctaaatgtctacattgtataattctatcaagctaagaaagtttttgaggatccatagctgtactggcttcaaaaacacataaaaataaaaacatttaaaaacatgttttcagaatgctttctccataggatgagcttctcttacaaacatgtatattttttgctcattttcaaattgttagctttaactccaagatattcattttctagactgaccatccaaaatgttggtaatatactacttgagaaatctgtgggtaataagcatctcataaacttctagtgaaaaataaaaattgatattgatatcaatgttatggagggaagcttagccatatctatcaaaattaccttgtttatatcctttgactcataaattccacttctctgagaatttaaacttaaattcacttagacattttcaaatggcatgtgtaagtcatcgcagctttatttgttatagcaaaactttggagatagctttgtatcagtcaggatagtctaggttatggtgaagtaacaaacaccaccaaaatcttagtgctttaaaacagcaaagttttatttattactcatgctgcatgtttagcaatgggctttacaagggtagtgttcacagaatctaaacagccactagaaccaaaaagaaactgcctggaatagtgcaggcttcagtgacagaagagaaaagaaaacataaaatcattatataaagattaaataaagattatgactacatcaactatatttacacatctttagcaaagtaaaatatatggctaatttgggccctaatgagagtacaaattatggcataattctctttcaaggtagagatttgaatattggtaaactgtgagatctactgtagtcttccattcagacaaccaaatatttgcttccatccttctctcacatacgcattcacttcctccaaagggaaaatatccaaacatctcacccatttactgctttaagctcaaagttctaggtctcagtcatttcagaagttcaacaagtccaacaccatctgccagatgtaccaaatataaagtagaacagcccacctgctatgaacattccattcagatggacaaatttacagcaattacttgtatttagcaatgctgattcacactggccatatacagaaatgggcttctatactgggagtggagcatgttccttgattggcttctgatttgtcttcctaagactaattcccagtccatcattctccccagtccttgagtccaacccctgggtggtaattcttttttcatttttctcctaggctacaactgaataagtcacgtaacaatataacttttttttttttttttttgagatggagtcttgctctgtcacccaggctggagtgcagtggcgctatctcggctcactgcaagctccgcctccctggttcacaccattctcctgccccagcctccctagtagctgggactacaggcgcccgccaccacgccccgctaattttttgtatttttagtagagacggggtttcaccatgttagccaggatggtctcgatatcctgacctcgtgatccacccgcctcagcctcccagattgctgagattacaggcgtgagccgccgcacccagccgacaatatgactttttaatcaatgagaagctttctcagctcatttgctgcccacagagcactaaagcaaaatagtgattttaagtatcaaacagtgactgtcctttttagttcaggaaggtgtttctctttgtagtataactcaaataatttattgaactcttttctatttaatttcaatcagcattatgtacaaataaccacacttacaaattattctccagacatgcttctccgcatattcttaattgcagataccttgaactgccaagatttttgaaggaagccgtatccttagccttttctttcactaagtcttctttccaactaaacaaatgtattgcttgccacttaatctgttcagttgtgatagaaattgttatttgggccataagttttatgtggtctttgccaaacactgacatcaaacaatttttctcttaattttaccttttactgtcataaatcaagacaatttccccttgcaaacctcatatcctaacttttatgactgtttttcttcttttccttctctccataaaaccagcaattctgccctgggcttatcgctctttgtaattcattttcaagcacagtcaacagtaaacaacctatactactagtattcttttaccacacttttcaccaaccaaaaaggacattattgacttcctaagttgttgcaggtgatggttttaatactggttcttcaaagcataatataaacccccatctttacagatttaacaacacttttcttgccactcattgcccaaacaaaatgccaataacatattgttaggttctatgtttttgtagcacaaaaattctggtaccattttttatatcagtcatgattgcctagataatgctatagtaacaaacaaaaacaaactctttgtagattttagtaataaaagttaatttctcattcacaccagatgtctagcatgggtcttaaatattgtgctctatatagattccaggtcaaaaagaataaaacatctggaattgtactagttttattgtctggtgaattaaaaaaggaggaggaggagaggacaaataagaaaaatgaaagaggaggaggggaacagaagtaaggaagaatatggcaaaacatttactctcttaaaatttctaccataagtgaattttagcactatcattcatagttcattggtcaaaattagatatgtggccaggtctttttcacaaggacagagtagaatgatgctcaggaattggaaatgaatatagtgaacataacaaagtctacctaccacaaataaatgttcatccataggcaactttaattaattatgctaaatctgtataaagcagtatcaaaaagctatttaagaaaaagaatgaagatagactgggatattaataaagatctacaagtctaatgtcatttgaaataaattaagagcagtatgtataatatggttcattttgtgaaataaaaggatggggggagaaaaatacacattcttatactcttataaagtcataaaaaagtgtgtaagaataaatcagaaactaaaaagactagtaatgtatgtgcacagggaattgattaaatgaaggataagaagacaatgcagactgttcatgagatgatagttttgatttttgcattttgagccacataaacgtatttgctactcaaaagttctatttaaaatagtaagctacattttgaagaaaaagaacgtttgctttgcatttataactataactatctactagtgagtgtattcctgacagccacatcacagagaatgtcaattcatttagaacaccaggtgttggtgaaaagaaattgttgaatttatttctcactctaccgttttgtttgtttgtttcttcattatgatattcaggtaactctttaaggtaacaagagtttcagagcattctctatatcattgcatagtattttaagtattttaatattcaaggtcttgttcctataacactaatcacaattaatgatattaatgtagtattttgtgtactttgtttttgttttaaaaatgttcctctgaattatgtagggaataaacttcagatatatagctataactaaaaacttacactagaattcttttaaaattccagacaaaatagctccaatgttgattataacatttgcaaatttttaccttaaaatattttatataaaggaaacatttatggtcagtaacatttcttttctagtacatctttaacataccatgaaaaacataatttattataaaagtcactaataatacaaagtacgtgtcacacaataatatgagactgaatttgaaaatctagctgtatttttcagccatggtctagcaacactcccaaactgagtatattgctttactatattgttttaaattaatttcatgtgtttgtttctttaaatttcagaattttttgtttgtttgttttccagcactgatctttgtttatatccatattccaaattctatttctgtcatttcagccatctcaggccagtaaacaacccttgctggagaagagtggtcatttgaagaaaagaagactctgtttttttgagttgtcagagttcttgtgctggttctttctcatctttttgggctgatgtttcttcagtctttgaagttgtcctttggatggttttccaagagaacattgaaaccaaatctaaggaagctaagaatcacaataaaaagatatagcagttgaaagacaaaatagccagtatagaaaaagtgtaactgacctgaaagagttgaaaaacacactataagaatttcataatgcaatcacaagcattaactgcataatagaccaagcagaagaaagaatctcagagcttgaaggctggctttctgaaataagacactgttggtgggactgtacactagttcagccattgtggaagtcagtgtggcaattcctcagggatctagaactagaaataccatttgacccagccatcccattactgggtatatacccaaaggattataaatcatgctgctataaagacacatgcacacttatgtttattgcagcactattcacaatagcaaagacttggaaccaatccaaatgtccaacaatgatagacaggattaagaaaatgtggcacatgtacaccatggaatactatgcagccataaaaaatgatgagttcatgtcctttgtagggacatggatgaagctggaaaccatcattctcagcaaactatagcaaagacaaaaaaccaaacaccgcatgttcttactcataggtgggaattgaacaatgagtacacttggacacaggaaggggaacatcacacactggggcctgtcatgaggtaggggggaggggggagggataacattaggagatatacctaatgttaaatgaagagttaatgggtgcagcacaccaacatggcacatgtatacacatgtaacaaacctgcacattgtgcacatgcaccctaaaacttaaagtataatttaaaaaaatttaaaaaaagaataaagaataaaaaatgaaaaggaaagaaacaaaaccctcgtgaaatatggggttatgtaaagagaccaaatgcgtaactcattgttgtccctaaaggagttggggagagtgtaaacaacttggaaaacatatttcaggatattatacatgagacttcccccaacctagctagagaggaaaacagtcaaattcaggaaatgctgagaaccccagcaaaacacttcacaagaagatcaaccacgagacataatcatcagattctccaaggtagaaatgaaagaaaaaatattaaaggcagccacagagaaaggacagcccaactacaaagggaagcccatcagacaaacagaagatttctcaacagaaattctataatccagaagatattgggggcccatattcaacattcttaaagaaatgaaattccagccaagaatttcatgtcaagctgaactaagcttcataagagaaggacaaataagatccttttcagttaccaaaatccagagggaattcatgaccaccagacctgccttacaagagctcctgaaagagacactaaatatagagaggaaagaccattaccagacactacaaaaacattcttaagtacataaaccagtgacactataaagcaaccacacaaacaagcctgcaaaataaccaactaacaacatgatgacaggatcaaatccacacatatcaataccaaccttgaatgtaaatgggctaaatgcctccaaataaaaggcacagaatggccggctggataaagaagaaaaatccaatagtatgctgttttcaagagacccatctcgcatgcagtgacaacgataggttcaaaataaacgatggagaaaatctgccaagcaaatgaaaaacagaaaaaaagcaggaattgtaaaactaatttcagacaaaacagactttaaacaaagttcaaaatatacaaagaagggcattacataatgataaatggttcagttcaacaagaagaactaactatcctaaatatatatgcacccaacacaggagcacctagataaataaagcacgtttttagaaaccttcaaagagacttagacttccacacaataatgggaggcctgaacatgacttaaatccaagagctgtgttgttgaaaaaattaataacagagactgctagctagtcttaataaagaagaggaagagagcagatccaaataaacacaattagaaacaacaaagaacatattaccactgaccccacagaaatgcaaacaaccatcacagactactatgaacacctctatacacacaaactagaaaacctagaagaaaaacgttaagttcctggatgcatacaccctcccgagactgaaccaggaagaaattgaatccctgaatagatcattaatgagctccaaaattgaatcaataataaatagcttgccagccaataaaagcccaggacaagatgcattcacagcaaatttctaccagatgtttgaagaagagctgttaccattcctactgaaactattcccaaaaattcaggaggagggactctttcccaacacattccatgagaccagcattatccttatagccaaacctggcagagacacaacaaaaaaaggacacataaagccaatatccttgatgaacatttatgcaaaaaacctcaactgaatactagcaaactgaatgcatgagcatatcaaagagctaatccaccatgatcaaataggcttcatccctgggatgcaagtttggttcaacatacacaaatcaataaatgtgattcatcacaaaaacagaactaaagacaaaacccacatgattatcttaatagatgcaaaaaaggcttttgataaaataaaatatcccttcatgttaaaaaatttaaacaaactaggtattgaaggaacatacttcaaaataataaaagccatctatgacaaacctacagccaagatcatactgaatgggcaaaagttggaagcattccctttgaaaactggcacaagacaaggatgctctctctcaccaatcctattcgacagagtattagaagccctggccagagaaatcaggcaagaaaagagataaaggacattcaaatagtaaaagaggaaatcaaactatccctgtttgcagatgatatgattctgtctctagaaaatctcacagtctctgctaaaaagctccttctgcttataaacaacttcagcaaagattcaagatacaacaccaatgtacaaaaatcaacaggaagactgagagccaaatcaggaatgcagtcccattcacaattgccacaaaaagcataaaatacctaggcatacacctaaccagggaggcaaaggatctctacagtaagaattacaaaatacttctcaagaaaccagatatgacacaaacaaatggaaaaacatttcatgctcatgaatagcaaaaaatagaaattgtaaaaatggccatgctgaccaaagtaatctacagattcaatgctgttactatcaaactaccaataccattcttcacagaaccagaaaaagttctttcaaatttatatagaaccaaaaaagaacctgaatattccaggcaatcctaagtaaaaagaacaaagcaggaggcatcatgctacccaacttcaaactatactaccaaaacagctaccaaaacagcgtagtactgttacaaaaacagaaacatagaccaatggaacagaatacagagcctagaaataaggccatacatctacaactatctgatctttgacaagcttgacaaaaacaagcaatagggaaaggactccctattcaataaatggtgctgggataacacactagccctatgtggaagattgaaactgcaccccttcattacaccatacacaaaaattaactcaagatggattaaagacttaagtgtaaaacctaaaactataaaaaccctggaagaaaatataagcaataccattcaggacataggaacgggcaaagatttcatgacgaagatgccaaaagcaattgcaacaaatgcaaaaattgacaaatgggatcaaattaaacaaaagaagatcttctgcatggcaaaataaactatcaacgattgaacagaaaacttacagaatgggaaaaactttctgcaaactatgcatctaacaaaggtcaaatatccagcatctataaggaacttaaacaaatttacaagaaaaaaacaaacaactccattaaaaagtgggcaaagtgatgaacagacactcttcaaaagaagacatacatgtggccaacaggcatataaaaaagctcaacatcactgatcattagggaaatgcaaatcaaaaccaaaatgagataccatgtcataccagccagaatagtattattaaaaagttaaaaaatatcagatgctggtgaggttatggggaaaaggaaacacttatacactgttggtgggagtgtaaattggctcaaccatcatggaaagcagtatggctatttctcaaagagctgaaaacagaattcccattcaacccagtaattccattactgggtatataccctaaggcagcagtccccaaaatttttggcaccagggacctgattcatggaagacaattactccacaggcagggcggggggtggcaggagtggatggttttgggatgacacttttccacctcaaatcatcagacattagattctcataaggaggagctcacaacctagatcccttgcatgctcacaatagggttcacagtcatgagaatctaatgctgctgctgatctgacagtaggcagggctcagatagtaatgctccttctctgccacttacctcctgctgtgcagcttggtttctaccaggccatggactggtactggttcgtggcctagggtttggggactcctggcctaatgactataaatctttctatcataaagatgcatgcacatacacttctccttatgagtactatttacaataggcaagatattgaatcgacctaaatacctatcaatggtagattagataaagaaaatatggcatatatacacgatggaatactatgtagtcataaaaaaagaatgaggtcatgtcctttgcaggaacatggatgaagtcagagaccattattcttagcaaactaacacaggaatataaaaccaaataccacatgttctcatttctaagtgggagctaaatgataaaagcacatggacacgaagaagggtacaacagactttgggcctaaaaattgagaatggaggatgggaggacagagaggagcagaaaaaaataactattgagtactaggcttagtacctgggtcatgaaataatctgtaccacaaacccctgtgacatgaggttacctatataacaaacctgctttgtacctctgaacctaaaagtttaaaaagaaaaaaacaataataaccaacattttaatgtaaacattttcagtctcacactgaaagtgtttgagtgaaacaaaacattttcctttaaaacaaaaacatttaaaacatttcatttcatttaaaatatttttgtataaaaacaaaaaataatcagatttaattttgagttatttatttatttatttttatttatttttttgagatgcaaccgtgttggctaggcgggtcttgaatggcctcaagaaattctcggcctcctgattagctggggcttcaggcacgtgctaccacacccaggctcataagtaaactttctcaatagtgaaattaggccacttctcagagaatatgtatcaactatttatattgccacaaactcagaattagagttaaaagggcagaatttagtgctagaaaaatctgtaggtgttatcagagtaatgtattttaaaagttaattttctaaataaatagtgtttgcatctttcttgatagaaattcacacaatttcagtgatggtcttaaaggtacttagggcttattatattatttatccttatactacatgttctcaggttatcttaaacattttttagctcctctgctgatagcatttggtcaagtttctcactccccttgtatcattacattggctcctggtggtgttaacccactcttacttatggtttccaattaccagagacctgggaaacaaagtaaccaatcttgttactctaaatacatatatctgtgagtggatatgtgggctctgagttattaggcctcctcctttctaataaaatttttggccttttgttcatgggcttgtgtcacttatttcatgctggttttatcagacaaggattgtaatgggtattttaaccactagagaatattttctcatctcatttcagagcctaaagctgtttcctagggatttgaaattgttactgactcaactctgggtaactgctaaaaaaattaatgcatttaaaaaatattttcatactgtctgataaaatgaattgtaattatatttgtttttttctacaaaaagcaacaaatgttattttctttcaaggtcttgctaagactttgaatgattttgctttttgtgtttataatacgactattcttattattccaaatagcaaggcaagtacttacacagaaaataattatgttttacctatcccacctatgaagagaaatatttaaaagtaaaacagtgaagtcttagtaataggacagcaaagcattgactgaggctcgagatggggactttcattctcatctcacagatccttgcaacacaagcaaagttctattgactgtagtaacaaaaggagtgaatatttacttagccatttctctcatagccaggtatgttagtacttgattctcccctgcctaaattcatcattaaatgtgtatatacgaacatactttggaatcttcaggtaacttaactcagggaatagattatgtataaaataagttgatttattcaacaacatatcaacttccaaatatccaaaagtagttatctatcttactgtgagttttctctaagaaatttttacctttacacagatttagaaaattttaatttccagccctccttttataaatatttgaagcaacaagttttagttttacactaagaaacatgtatcattttcatttgcaaaggtatgctttgtaaaacaatatgttaaacaaattcctcacttggatatagtaatccccatttttgttgatcaatatctaaatgttctgatttccttcatgaatgtgagtgaaaactttatagggaatataaacatggaaactaaataaagattttcttgttcagttgtttattgtatgcatgataatcaataaaaatgactcatacaatgcatttgaaattaaagaaatgttaatacatataaaagcaacaatttcccccaatatcatataaacgtgtttttgggaaatgaaaattcattgtatgtttaacaagtggtaaatgatgagaggattttcaatatggatgagtctaatatttatagaaaattgttattttatataagcatttatttctctgcttctagaataatgtaacatttcctgaagtatatggcatttagaatttgaaaataagctcttaagaacaaagtgattattttacttatattttgggcttaaagggtaaaagctctgtttcagcccacaaaaattattgttttctatatgcttcttgggtatattattgtaattcaaaaaaagactgaaaatagaggcgtaaaatagtttctgcttacatgctgtgaaattctcaccacaagattttaaattgaacttgcttaacaggcagagagaaccgtcttctttcttcaaagacataaggacttgttcagtaagaggaaaaggtctagcagcattttcagaaaggggcacattgagtgcctctgtgattcttgctcatattggctctactcctaacatcagaacatgccaaagaagaacatgtgcatgtgacaagcaaaagtaagttaaagaacaagctaacctaatggcctggaagaagtatcttaaaatgataacatcatttgatttgcacattttgtggtctgaaagtccaagacaaccagtgcttacaatattaagtatatttcttagtctgctatatgtaaaactagatataaacttgctttcaccctgaaacaaggtttgggccttgtttaaaatttctgagtagcaaagtactactccagtagcaaagtgctttcatctaaaggatagggaaatattcgcctctattatttaagttttctataataaaaatgtattctatttagcccttgaatacagcaaaagtgttttaataagaaatatgcattttaactctaatcagacattcaaatcataagaagccttttctatatttggtagctactctggctaaagtactgtttcaaatttgtgcactttcagatgtggtaactacaagaaaaagatcaattagctcaaactgataatgcttccatgtatcaatttgacactttaggaactacttgcttagattctacaatgtgaagggatagttgttaattcatgacaggagaaaagtatgttgaagaatttagacaaatagaatgattagacaggacaatctgaatgtgaggtactatcaggggaaccagcccccagtatttcaacgtaggttctattttccctaagtgttggctggtctgagaaataaagagaaagagtacaaagagagaaattttacagctgggcctgcgggggtcacatcacatattggcaggttccatgatgcccatctaagctgcaaaaccagcaagtttttattagggatttcaaaaggggaggggtgtatgaatagggaataggtcacagggatcacatgcttcagagggcaataaaagatcacaaggcagagggcgaaattagaattactgatgaggttccatgtcctgctgggcacgcattgtcttgataaacatcttaaaaggaaacagggttcaagagcagacaaccggtctgactcgaattcaccaggctggaatttcccaatcctggtaagcctgagggcactgcaggagaccaggttgtatttcatcccttatcttcaaccacataagacagacactcccagagcagtcatcgataggcctacccctgggaatgcattccttccccagggttattccttgctaggaaaagaattcagtgatatttctcctgtttgctttctgccagaagaaaaatgtgactctattctgcccaaccccgtgggcagtcagaccttaagtttatcttcccttgttccctgaagatcgctgttgttctgttctttttcagggtgccctgatttaatattgttcaaacacacgttttacaaacaattcttagggttaatgcaatcatcacagagtcctgaggtgacatacatcctcagcttacaaaaatgacaggattaagagattaaagtaaagacaggcataggaaattataagagtgttgattggggaattgataaatgtccatgaaatcttcacaatttatgttcagagattgcagtacagacagacataagaaattataaaagtattaattttgggaactgataaatgtccatgaaaacttcacaatttatgtgtttctgccatggcttcagccggtccctccgtttggggtccctgacttcctgcaacaaggtacctctagaaagagatgaaaagtgccatcataatgcaatgctttgagctactccaagatacaaaacataaaattaacccatagaaaagtatttcaagtagattaaatcatcatgaaaacagaagacaatcttggaccttacatagaagaaatttggtttattattcattggagaaagctcatagaactctgactcagccttcacaagtgatgatgtaagaccattctgccaatgcagcctacttctccctgcgccccaatgcctctcagatcataagatgagaatgctttgcctcactgcttacaaggtacactgctcacttcccacactggagctttgctgtggcctctgatgaatgaaacctataggactcctttgacacccagcctacaggcagacagaaagctgctagctaatatttgcttgctagctggctgtgggtgctataatgttatgggtctggttgccctagagtctataacaaaatcgcagtttagaggagccagataacatcacaagaaaatgttaatgccttttggaggtaactgtaaccaataatagatgggagacgggaagaagccagaacaaattattttctcttcttctcccccagaagttacaatattttcattgtaaccagctgtgatttcttgcaaagctgtggcagctccacaatgcagcactttgcttctctgccttgctctccttttatcctcacttttgtttccataagattgcactcacccactcacatacatatttaataaaattagcacctatgtcttacctcaggaaacatgtcttacatgtctttccttctaggaaacctaaataatcaagaaagggattttcaggaaaaataccaaagagccctttcctttggaaatatttctctcaactatgtataaatgagagagataaaattgtaaaatagagcaagtaagaattatgcaaacagtaaaataaaacaaaacgtaagaatactacatcagccatgaaactcaacagttgttgcaagaattaaaatattagctaagttgctttactttggatcagagcttgacagcgtaagttgacttataatctgtggttcatttacagcctaggacagtttgatagagggagctaaaagtcactactggtagaataaaggaataggaaaattagacatacacaacattttgaaggatctatttattcttctttgatttcagtgtttctagttagcttccagttttctaacatttctccaatgtggttttctacattggcatactctttcctctttcctcttcttagatatatctaaatttcctgtatctttaacataaatttagttggcaatagggaaagcattcaatcaaaacatttacatgaatttttagtgatgatcatacatttaatcctttgggggcagttgaattgtagagacagaattgcttaatcaagagtaacaaatattaaatagtgcatgatagttgggtaatgttaacgtttctaatcatcataagtaatctcactgacatattcttctagaaaaagaagatacaatatttattcctcttgcactcttatagtgttctcaaaatatttttttaaagtcattcttagtttttattttcttatattcacaatgcttaataagattttgtagactctcatgctgaatgcatgtaatgtgtagattcaactgtgcctagtttaaaacacaagctatggtcatctctttgtgaagcttaaatatgtgtctgtcttttattccaattgagtccctggtaactcacttgtgtaacaattatcacagtttccacaccattaactacatttaactaaattaactacattttctattaagagatttgaaattatttgaggagtttttatgaaattcctagaactctacatgctgttggtaaatcctaaccaggatttacctgagacacagccttccagagggaccatcatcaccaagatgcaaaacataacatccttctgttcatctactcatcaacaccatttctcacctgccatgatttcccaataactcatccctcttgtaacttattatctgaaattagtaaaatcaagttatctcccacttcttctataaagctccatttgcacattttgtgctgattgaattcttgctgtaacccagaaacaatgtttctcttgaaattctctcaaacaaaggtattcttcctcattcttgacagaactcagagactgagttattccacatttcctaaaaaaatatgattttgctgaaattctttttttagactatgctatcatttgcctttatttgttgaagattttagccttcttcacaattggacccaaaattcttgaaaatatcaacctccacctatatcattcatccagaatttctgcctctcatttccttgacctcctcactttctacaacgggttattttacctcaactcagtcatgtcctctcatgagcaaatttagactttgtcatcagaattatcatgcaacctccataatttcagaataccactttctatatctccagttaatgtgcactagaaataataccttgctctatcaggtctaaggaaggaaacatgactctcatttctgccagccaatgattaggtaggacttactgcctctgcgttatcagtgagtaccactcaagagagccaaaactctcatttccaccaagcagtaatgagaacaacccccttaagctttaataaaggtaaagtggagaaaacacactctatatatacctaagagtaataagaaaactacccttttccctagccgagacagtggccatagacagccaactaaatggaaggactaagatccagattctcataagaaagtaccccaaaatgtccatatttaaatgaaaaatcaatcatcatctcaaggacaagaaaaatatcaaacagaatttagaaagataatcagtagatgctggctgagtgcagtggttcatgtctgtaatcccaggaatttgggaggccaaggcacgcagatcacttgtagcaaggagttcaagacaaggttgagtagcatagcaagaccatatctgtttaaaatcaataaaaaatagctagatggatagataaattaaaaaacagattccagtactaagtttacagagatgttagagttatcagacaaaggttttaaagcagccgttatacaaatacaaatgcttcaacatgcttgaattgtaaaataaaaagtctcagcaaaaaaaaaagtctaggcacaaaatagaaagcataaagaaaaaacaaagattctagaaatgaaatgaacttagaaatttaggtgatcagatttccaagcaaagtgttgaagttatagactggtttattcttgctgcttttagtgaaattcaagaagaaaattaaagaaatatttataaacataaagaaaatggcctacaaactttacaaaagatactaaaattaagacatttactgtattaagtattttctagagaaaaatatgagtgcctggcattataacctttggataataccttagatcagaaatgcacagtgttcagtcacacaaaaactcttaagtaaattaaaggctcatgcattgaccgcttttgccatattagcagaaccaaaaagtaaaagagattatttcagaaagatctgttgacaaatttcctgtttagtggagtgaattcccatgccatttatggagagacccacaaggtacgtgagaatgttatatgagtagaaacactgccagttttgtccagaaggcacagaaagcacaagtaaaagaaagctattgaactgcaacattccatagtcaagatataagctggtaagactactcaactacaaatacattctactttttatgaaaaggaatgagtgacttagagtcaaaagcccataggactgagctatgaacccaaatgatcaattcatgtgcttcagaatattattcccaggcactgacaagtcaagttttcccatctagattttgaaattgcttggaccagttgattctggttttcctttaattgtttcactcttggagtggaaatatctgtagctactaaatatatatgtctcaccattatatttttgatcagataacttaattcttgtgctttaaaaactttacagatgaagagaaattgtgcttcaggattgattataaccagagcctcacccatgcctaatttgtattacttagatgacgatacacgaaacttttgaggttctaagatttagatgagattttgggttttagttgatgctacagtgggttaagacttgggggtggtttgaatatggtgactgtactttgtaggttgtattcaggtaagtctgaggtccagattttggactgtgatagacagaatatgtcccctcccaagatgtccacattcagaacctattaatgtaatgttatttaaaaataaatacataaataaatattgcagaaagaattttgctaatcagctgacttttttttttttttttgagatggagtcttgctctgtcccccaagctggagtgcaatggagtgatctcagcttactgcaacctccatctcccaggttcaagcaattctcctgcctcagcctctcaagtagctaagattacaggcacctaccaccacacgcagctaatttttgtatttttagtagagacgtggtttcaccatgttggtcaggctggtctcgaactcctgacctcaggtgatccacctgtctcggcctcccaaagtgctgggattacaggcatgagccaccacacccagcctcagctgactttttaagatacggaagatagaaggttactatgcaaaaatcaattgttttcatacctacaagcaatgaacaactggaatttcacatttaaaaaccaatgctataatggcaccaatagaacagaatacttagcatggatctaacaaagtatgtccaatatctgttgcagaagattacaaaacactgaggaaagaaattacagatctaaataaatgatgacatgccccatgtttatgtattgaaatattcaacattgttacaattttagtacttctctatttgatctgtagattcttcagtacaaccccagtcaaaattctagcaagctattttgtagctatcaacatactgaatctaaagtttgtatgggaagacagaagacctagaatagaaaacacagctcataagaaggattgaatttagaggccttacaccatccaatatttggagacttactctaacagctgtagtaatcacaacattcattatttgggtgatgggtacactagtaacccaaactccaacattatgcaatatacccatgtaacaaacatctatctgcatgtaccccctgaatcttaaaacataaaaaacaaaacagcaaaagctgtaagaatcaaactgctgtggaactgacttaagaaaaacatatatagtccaatggaacagaatagagataccactagcagaccaacacaaatattgacaacttattttgatggaggagcaaaggcaattaaataaaggacaggctatccaaaaaactgagcacctgtatacaaaatgtgaacttagacatagatcttatacatcacacaaaattaactcaaaataaatcaaaatttcaatatctttatataaaatgaacattaaaatatattacatatatgtatataaatataaaatgcaaatatagatataaaattcaagactatcaaacttttgggagaaaatctatgtgaccttggtgaagagtttttagaaaattacataaagcatgatctgtgaaagaaagcattggtaagttgaatttgtataagttaaaaatcctgtctgtaaaaatcacttataagggacaagccagggccagacgcagtggctcacgcctgtaatcccagcacttttggaggctgaggcaggcagatcacaaggccaggagttgaagtcaatcctggccaatatggtgaaaccccgtctctactaaaaatatatatatataaaaattagctgggcatggtggtggatgccggtaatcccagctactcgggagggtgaagcaggataattgcttgaatcaggacccgggaggcagaggttgcagtgagccgagatcgtgccactgcactccagcctggattatggagtgagattgcatctcaagaaacaaaaaaacaaacaaacaaacaaacaaaaaaagagacaagcctcacgctaggagaaaatatttgcaaaatatgtagttaataatgaatttatatccaaaatatatatttaaaaaaacacaaaaagctcaaaattaataaaacattccaattaaaaaaaagataggcaaaagacagatgaccaaagaggacatagaaaagggaaataagcatgtgaaaaggtattcaacattatttgtcattagaagaatgttaattaaaaatactatgagatggcatttcttacctattagaatgaccaaaatccaaaaacctaacagtaacaattgctggtgaggattcagagcaatagcaactctcattcattgctggtagaaatgcaaaatgtttcagccacattggatgacaatttgtctatgtcttagaaaactaaacctacttacgatatgatccagcaattacactccatggtatttcacaaatgactggaaaacttacatccacacaaaaacatgcacatgaatgtttacagcagcttattcatcaccaccaaatcaagaaacaagcaagatgaccttcaactggtaaatgagtaaataaaatgtagtatatttatacaatagaatactatccagtgataaaaatacatgtgctatcaagccatgtaaagacatggataaatcttaattgcatattgcaaagtgaaataaggaaatctaactaatctacatagtatgatttcatttatatggtattttggaaaagcaaaattataaagacagtaaacagataagtagttgataaaggtccaggagtcgggtgatctggggagttaaattagtgaaacagggaattgtttagggtaattaaaccattttatatgataatttaatggcagacacactatatatttgtcaaaactattaaaacttcgcagcacaaagaatgaacattaaatatgaaaacgttttaacatttaggaagcagaggaccccaggatgaaatacagactgtaaccccaaaataatataactatggtaaaaatatataaagcaatccaactgaatgggggatgctgatctaagtaaccttgcaaatgagtggcttctataagactaaaggcaaaaagcactgtacgtaaacacagtactttagttgataaagttgttacccatgaaggtatgagttaacaattctgaaacatctacatatttgtactgggattaaacaataaaacaaatgggcaatgcataatgggagccagatttctcatgtttgaagctcaagtttacagaaaagcaagaggagaaagctggaatgatccatgtggggatgcattagaataggagacatcagtacggaatcatgttcagcttaatacagatacagatgcttatgtgtagacatgtggatatgcattggttagtatacacaaatatcctttttgctctaccagttgagaggggatagaaacaatggcaccccaagagcaagaaactcacctatcactcagacattttttttttcctaataccatactccaacaaaaggaactgggtctcggagagatgactgattctcaggcttcagcagggaacatataaattgaatgaggaacattttgtaatatcagaaagttaaaaagtgctttcaaaaaactcccacaataatgcaggtatataagaaatacccaggaaccaatttaaagccaattgccaaagctggaacaattcaagaacccaaataaagcaacattggattataagtcaaagtatgaaatatacattgatgaatccatattgatataaaaaatgaataaattcataagtggagatagttaaatatcccttgcagaagattcctacacaatttatgtagatattctactctcaaggaggtagagcatagcttttcagaccttaagtttgtgctgctcatagtgaattccttccaaagagaaaaaggggaaaaagagtaagtttacagtggagaaacctgacaaatactacctcagcctgatgagaaaggtcaatgtcaacagtcataaatcacggtgataatatctatctttgatgtgatatgatgggaatgagacttaacctccattatcttcctccctaaaacccataacccaaggctaatcatgagaaaaacattagacaaatcccaattgagagagagtctagaaaatacctaaccagtactcatcaaaactgttaaggtgacccaaacagaaaagctctgataaactgaagccagtacagcctaggagacatgacaattaaatgtaacgtgatcttctggatgacatcatatggtaacataataaggacgttaggtaaagactaaggagctctgaataaagtatggactttggtttacgataatatacaaatatcgattgggacaaatataccatactgacgtcagatactaataatagagataattgagtatggaactccattattctcttttttattataaatccaaactattcagaaattaagttcattttttaaaagttatgggccataggagcacatatttctcaaatctgtgcaatggttcacatttaacaaaaaatgttactcctcagagccagacaatctaatataatgcccacaattgtattcaattccaaacccaggattttggagcacatgtctttgtatggggcaacctgtagatgagtaagggctttccaacctggattgcatggcacaatatgcagagtagttaaaaacacaatctctgaaaacaaatcacccagtgtaaaatcctagctctattgcttacgaatcttttgactttgatattggttaaggaagggagattgctttgcagggattgccataagagataaaaaaatcacagttggttttttatgtattattttcctgtcactaaaaatttatacaaggtttagtagctttgaggcaatttacatttagtccactccaggggacttgttgactcaattcttatttctatagctcagtctgaagattatttttgttaacaacaggctttggtgatcttgccaatccaccactgtacccaactccccagtcaagaaataagcttaacatcctcagtcttggcttctaggaaaatgtaaagtggagtaacctggggtgagtagttacagtcccgcccttgcctcagagctacattactttagattactcttccaactggaaatttttagggatgttaagtggggaatatgccacagaagattgagagggatatagtacacagaaaagtaaatagattgattacttgtaaattgttgaatcaataactgcttccaacaggaagtaaggttctgaaggtccaggagtacagcaaggtaccatctctgaaactggggattcagatacccacatctgaaatttttattattcaaaacaataataaaaatgcatgtattctgaccagaagatatcagaactaaagctaagcaggcaaaaggaggagatgcccactaccattcctttgtgttattatttcaaattttattcaataaaatattgtgaaatccaagctttagatacttcattcccattcttttgggaagtaggaactgaaaagccacctgcttctatttactctgctcgagtttatactactaccatatatctgaaaataatcagtttttcacaccactccactgactctcaggaacaatatgagaactcattaggttacagctgtgaatcgcataaagtatttatgagcatagtgtcatttaaatgtaatttacagtgttattctcattcaataattttttgtgtgacctgtgttctgaaaatttccgcttgttctactttatagttaatgataaaatgtcattcaagctgcaattaaaaaaagatttaaagcaaatgttaaactaaataaactataggacttattttctgaagtgacagagaaaaaaagagcaatgaaaataactctagcatggaacaaaaaaagatataaatttgtaaaagaaataatttttcaataaaaattgtaaagcagaaatatgtgtattttcacacatagctcagagttcacataaatgtcaagaggagtgacagttgctgaaataaatgtgtttttttaatgaaaagcaaagtagtaaaacaagcaaaatagatgcataaaatgggtaaattttcagtgtattagttattgctgcctcagggcagctgtaaattactaacttgtttttaaactttttttagtattcatgaatgtattctgagtctgttcttccttcttctgctcttgtgatttgaccctttgcttatttataatcttctttgaagtacataaattaaaggataccagatatttggatggagaagattcatataaaaaataaaatgtaattgtggataatatactaactttagaagtatcatggttataagaaaatcctagtaaaacataagattttactttgtctcctcttatccaaacacttattttaacaaatataaaacgtattcttttgcttttctttttcaaaaatggacaatgccacacaccatgactatgaaaattttaaatgacagtcttagttcatctgaccataccttcttcataggtttataatgctgcagtgaaaatgtgtaatgagatacagaaaatagaaaacagctgtagattaaaatgttttttagtatggcaacgaatctttcagtagaaaagtcattttttttgtacaaatctggagacctaaacagcatattcgctagagctacagagaacagagcaaagtacctcttaatggagttaccccaaagtttatgcaccctaaagttcctatctggcgtccattcctgcaattgcaattaggaattaaagcaaatatctcaagaactgtaagaaatgtttaattcggattttaagtagaaaatcaatacctaaaaatgaactttaaataactgcccaaagtgcagattgtaagaaagtagtaagttaaagttaactccacagttaatgcatttttcataagacctataggaatcccccttcttaaggatgctgaaacttaaaatgaactcaaaaccaggcaaataacagaacaaaagatcaagaacagaactaagaataataaacatagccactttaacaatatcaagtaagaaggtttaaagttataacaatatactcagaccacagtgtggttataaacctatgttacctataatttgctatgcaatatgcttaagaaaagtgtaacatgtatatcagtaattttatcttcacttttgagttcaaaaataatcatagtcatgcacagttcatttttctgcatatattacctactgcatataggtatcgctataatggatctattatactcattacatcaatcaaaaattggcataaaatatagaaatgtatgagttaatatctgatagaaactgtaaaagaaaatcgatttttaaaatccagtagccttaccacttctccctctcactcataaatatgcatgaccaatagccatgttggaaaagcaacttttaaaattcgattttaaatacgtggaaatagaaatttttacaacaattctctctcatcgctaacaactatattaaatcaatgaccattcttctatgttgattttcccctactccactataagttctggaaggaaccaagtcttatgtgactctgactcaaaatcatttagcacagtactctagttgttacctaggtataaaataaatgtttattgagatgacaaatacaaagagcatatacatacggtttagagatcaacctcacaattattttttcacctaaaagctgcattttacaataactattaaaacagttctattgtgaaatatgacacattcaggaatgcaaataaaacaaacacttaacaaattattataaagctaacactattgtaatcaaacccaggctgaaaaacaacctgtatatcaattatctcctatcctcaaagtgtaactttactgatagctattttttaatttatacttttatcacctgagtgcaactgtaaacactagtgtgtagttttatctctttattcgcttgatacaaatgccattgtacagtattcactcatctgtatcagactttctttatttagtgtcaactattgtaaggttatccatgttattctgttaaagtaggccattattttgtttctgagtgttccaattcctgaatgttgaataatatttatttcatttacttatctattttattgttgatgggcattcatgctatctccagtgtttggcttttacgcattatgctgccatgaacgttcttgtgtacacctatatatctatatccagaaacagaacactggggcatgtagaatacataggtttactttattaaacactgctaaagttatacaaagtatcttgtgataattttgaaaaaaaatatttacttccaccagcagccccttttgctctatgttctcaccaattctttacattgtatggagttttttgtttcattgattgattgattaatgatagctatttttgtagatgacagttgaggttttcatttgtaatttccttattaggagggtgaacacttttccaaatgattattggccatttggatatcctgtttggggaaataccagtttgagtattttgtccatgattctcctgaatcatctgacttcttctttttgacttctaggagctctttataaattcagcatatgagcccttactctgttctgcatgttaccttttcactctcttaatgatatattctgatgaacaaaatttttgtttttaatacagaccattttggcaatctttgttttatgattagtgcttttttctgtattgttaaaaattttttctacccctgaggtcatattatcttcaaaagatttatgctttgtttggtcttaccttcagttgttcttttgaagagtgaaaggtagaagtcatgctttttaaattattattgtttcttatattgacgtatcatcatatactgggaagaccatcttttccttcctgctctgctgaacaatctttatcatgaattaagtgttcgtagatgtgtagagtctatttatggactctcttctttgctccagtagcctgtttgtctctatctttgtgtcataccattatacaccaaaagctgaatatttataataaatcttcatattttctatagtaacttctcttctcatcttatgcttctatattattgctttgcctattcttattagtttacacttgcatacaatattagattgattctgccaatttccacaaaaatgtttgttggaattttaattttttcattgcacctatagatcagtttgaaaatcagagacatatgtaagtattgaatctttcaatccatgaactcggtacatttctctatttacttaggtcttctataactttagcaataatgttttataacattgtagaaattaaaatttttattagcattattcctatgtatttgatgttttaaaaccatcaaaatgctatatttttgttttattttaaattatttgcttattgtatagagataattgagttttgcatattagacctataaacaactattataataactttacattaattttaacaatttatcttatattattcttgatttttctatatatacaataaatataagcaagtttatgttatcttttaaataatattttttctcttcatgtagttgttacaacttctaatagattcttgcatggaaatggtgagaacagacgtatttgtcttgatccaaatctcagagagaaaggtatcaacaattcattattaagtatgatagttactgtagagcttatgtatacatcttttatcacatttagttatcctctattccttttttgctgtttcttttctttttgcttagagcttctgttatgaatacatgttaaatttttatcaaatgctttttctgaatttatttaattcatatttttaaaatttacttgatttttgtagtgattaacatcaattaatttttaaacgtgaaattataattgtttcctggaataaatagttgcgtattagtgtggaggggcacagagttaatcaactttgcttttgaatttgagcctttcgtttatttatagttaatgtagtcttaatgattaagggtttaaatcttctattttactatgtgctttttatttattagtgttttataatttgtttaaagatttttatcattttttccctttagttagtttggaagttattcactcttaatattcctttgtaggtttttttgttggaaattacaacaaggattctcaataaaatctaattatacccgaaacttttgcattatctggataaccaaagggctttaagtaattgtatttccatttacttccctcaaaatatatatgctatatttctctatatatactgtttcgtgatgaactatgaaatcaagaccatagatgttcataaccagaatttgtttagatttaccacatagcaatctttatgttgattttcatttttttttctgccttcccatttttcatctggcaacatttccttctacatgaagaacattctctagtattttcattagggcagcacttctgttgacagatattgttagtctgtcttctgaaaattctcatgtgttattttttaaaggtatttagctagctttaagtagctggaatactaggttagtagttaattttatttattacaccatcttccagattcctttgtgtctaatatgaagtcagatgtttgttaatcttttgaaagtaacccatctttaatatgtatttaccttaaaattctctctcaatttgatttcctgtagttttactatgaggtagaaatttatttaattatattgcttgatatttattacatctgtgaaactattaatatttattatggtctaaatatgttctccaaaattcatatgttaaaacttatataccaatattatagtattaacaggtaggatttttaggaggtaagtaagaagggctccactctggtgaatgggaataatgatattaaagaggtttcacattgcattcacccattcttccccttccatcctcctgccatgtgaggacacagctttcaaagtgccatcttagtggtcaaaagcaggcctcataagacataaaacatgccaatgccttgatctttgccaatctagcccacagaacagtgagaaatcaatttatgttattaattacccagtcgcgggtaattttatagtagcaagttttcagctagtatataaatttttattgtgacccatttgccttcatttgtccttccatgactctgataaaaatacattctagatcattctaccgtatcatctagatctctaatccattaatcttcccttccaggattatttcatgtctatgtgtttccttctgttttttttttctgatttatttctagtttgtcaaatatctctttacatattttgatctcgtgttaaacccatccactgagttgagacattaatcttagatattgttgtttttcagtactaaaatttatacttggttcttttataaatcagccttgtaaatttgtattgttgctagttctcttttttaatctcatcttaatatccttgagtatacaaggcatatttattttcatttgttttccaataatttcaatatctgaagatcttgtgggtattttttctatttaacatggtatttctgctggtttaccttcagattgccttgtatcatcatgtgtctagctatcaggggaaccagcccccaatatttcaatgtaggttctttctattttccataagtgtcggacagctgagaaataaagagaaagagtacaaagagaggaattttacagctaggcctctgggggtgacatcacaaatcggtaggactgtgatgcccacctgagctgcaaaaccagcaggtttttattgaggattttaaaaggggaggggtgcaagaacagggagtaggtcacaagatcacatgcttcaaaaggcaaaaaggagaacaaagatcacatgcttctgaggccagtaaagatcacaaggcaaagggcaaagcaaagataacaaggcaaaatcaaaaactcctgataagggtctatggtcagctgtgcatgtattgtcttgataaacatcttaaacaacagaaaacagggttcaagagcagagaactggtctgacctcaaatttaccagactggggtttcttccccaccctaataagcctgagcgtactgcaggagaccagggcgtatttcagtccttatctcaactgcataagacagacactcccagagcggccgtttatagacctccccccaggaatgcattcctttcccagggtcttaattattaatattccttgctaggaaaagaattcagtgatatcttccctacttgcacgtctgtttataggctctctgcaagaagaaaaatatggctgtattctgcccaaccccacaggcagtcagaccttatggttgtcttcccttgttccctgaaaattgctgttattctgttttttcaaggtgcactgatttcatattgttcaaagacacatgttttacaatcaatttgtacagttaacacaatagtggtcctgaggtgacatacattctcagcttatgaagataacaggattaagagattaaagatttttataagaaattataaaagtattaattttgggaactgataaatgtccatattaaaatgaaatcttcacaatttatgttcctctgccgtggctccagccaatccctccattcaaggtccctgacttcctgcaacatctagctatctttgcttgtgggacagaaattttgttatattcttccagataatatttttcttttgtttctgccagatgcctggggacactagttatctaagaccctcttcatacaatttctgagacagttttttcctgaacttcaaatataactctaaactgggctataagctgtataaaagctggtagacttctagttcatttgttcaatcttttttttcccattttaaaatgccagtggttttatagcaccactttaacaggctctgactataacctttccaccatgccctaaggtgctaaaaaatactgatcggcttttcagccatctcttccaatttaacacatgacctcagaacataagcagctctgaaaatggaagacctacttttctaatctttccatatttctgacattctttagaactttaaaattgaatagttctgctgttcaattcataattacatctccgatgccttcaacctgattttgtctacttttgccagttttcttagttagagggttgttataaattcacacatctattactatagaaggtcatactttaacatttatttcttattatgtaatacctgttggttcttgaacattcagaaagtgttaaaaagcacaaagaaacaaaaacacttttttcataaaatccagaattatctactgctagcatttcacatacaaatttcctttttttcctatgtatgtgtatttgagtatccatataatcttttgtaacactggttcatataataatttatagtctgtttgttggtttactcaatattttacaaatattttttcatgttgctaagtcatcttctaaaatgtttgtgagagtcatgaatgttttattaaaaacgtatgtgattataagaattaaagttatagaaaaattataaggaaaagaaaaatcaactgagcactattaacaccagataagtatgactgtaaatatttctcaagagacagatacatatagaaatggacatgtaggttgataggcagaaataaagtttttaagaatgagataaggatttcacacattattttcagaggaattattaaattttatttgaatttcaagtcaaatgaactctgaagaagtacattcaaaattgacaaactaagtatttcttaacaagaatatatacatatatacattatacaattatatacacagagaaagatataaataaattttgatatgttattgaaggattaatttgacacttatgattgctcctctccccttaggtatatgctagatttccagttaagtggaaataattctggcacagaggtacttaagaaggaagaccagaccatgggtcttcaaataaaaactgcaatgtcagcaataaatgtcaaattgtttccccaacttattgcctggccctaaaaatagcaagcccaggtgagattcttcaggaataggtaggctctcaaatatactttatatctattttccatgctggatcaacaaagtaagactttactggatgttctgaatcactgtctttcacagaagcacgtctgagctctgagcatggagttcagcaccttccaatgctgcatagaatcacgatgaaatgttttgtctctccttggcctttacttgtcagggcttatgtcataaagtattcattttctgttttcttgttgctaatgaatttttcctctggattttactgctatttgtttattttcctagttatgagataatgctgatccaagtcacagtccccaaagcctgcttttgttggtcctcttctagttggtgtccctgccttactctaataatacatctgttctgtcttccttagaacggtcaaaatgagcatcgcaaaacattaatcagatcatctctcttctacttaaactcctccattggctcccctggacttggccctgctgcttccttcacacttttcactcctgtatttccctcattcctactgtttctctccagtatctccctcactcctactaaaacacagtggcctctgcctgtctttcaaacagcacaagcctgaagccatctcaggggctttgcatttttccttcctgttacataattcttttctttgtaattttactaggacatttttcttctcattattcatattttaactttaagttggcactgcaaagcagtcttccttacccacctcactaaagtagtagttctggacatattgtgctatttttccattttatcttttccataacacttctcaattcaggaaaatatttgtttatttccttacttatttactcacttcttttatgtgagtccagaacaaaggaggaagagtctgaaattttaccttacttgaaacttaacaggtgagcctgccatatctttctcattgctctaaggggatgagatactcctgggccaaagacagtgtacattattattcacagcaatagtgtctgtgtcagtttctggagccccaattcccacacaatgagtcaaagaggatcaggaaacacctgaacacaagtgacttatattacaggagagaaattctgagcttagggaagtcaaaacttatagactagactttaagaaaacctcctctttgctccagagaaatactctaaatacacactacatattctaaggatgtatgtgttggggctcagaaacagatgtcttaaactatggtgctttgtacgtgctaagttgaaaaaggagcctcagatttctctgacctacctcttaccctgtgctgtctctccccaggattttctgaagttccttgtctgcctgaagtccagacctgccaaagaagaaaactaccttcagtgcttcccctgagtttttcttaactgaacctatattgtaggaaggaagactaaaatctgtcaacaaaccaggacagaacttttgtcacaaatcattttccattctgtgggcccaagaggctttgccctagaccattatatgttcttcaagaccactgaattctccctagtaattatttcttgtccctcgacagaattcctcttctccctccttcctacaaactgttttgccaggattcaagcctcccctttttctgtaatcttaagatggtatataagctcctgcccttcattgggaagttggatcttcattctgaaggctttcatatacacaagttaaataaaattatatgtcttttctccaattaatatgcctcttgcaagttcccattagcccttacatgtattttacataatgtcatcttatattctaccatcatgtgtgtgttagtaattaatgtattgcctttcacctccaaatttacctttcaatatatgttctgtaataatagatggaattccttcgagtatttcccttttaaagagagtacgatgttaagctgtgtcagctgagagtgctcggctggcaggaagttcccagaggaaggagctccccttggttttccagctgcagcacagagtggggtgtcagcaaccatgggtgtgaggacatctggtagagctctgatttagctgggggcccagaatgtaagaaacttcagcaactttacaaccttagcctggagataaactttccataactctcttgaccaagaaaactgttgccctgaaggcctttcatccaaatcagcattccccttttgccatcctctctgaaggtctctgggcagactgccggcagcctggagggatcccacagagtggctattctcactgcagtccattatgcagcctgcctatgcctacggaattctcactaagcctctgttgagcacagtacagctgcctgcaacccagtgttcccacctctctggacacttctgcccctaactgctgattgcctgctcccagcctgcattctggagagttgcctcctgcttgccaagtgcagcaaaccaaaccagctccggcctaaccaaacctatgaacttctctgctatacaatgagctgaactattaggttggtgcaaaaataattgtcatttttgccattaaaagcaatggcaaaaaaacccacaattattttgcaccttcctaatactaaatgacaagttactcaagaaggtcgaaaatccttcaaaatttgtttttctttcagtactttccctctgatcaatcgatctatctatctgtcatctgtcatctatctatctctatttctatcaatcatgtatccatctatataatgtagttactttttatcagactttaattatttttatattaaatttgcccatttaacctacagtatgattttccccttgtttaacctactgtataatttttatgtcctaattggatctacaaaggttcaatgcatttaatcaattcatgttgtaaatatatatgttgtttgtaatctttcatcactattaagaatacgaaaaagaacatctctgatcatgaatatttccatgtgtctgtgattatttcctcagagaaaatacctaaaagagaaaatgctgcttcaaaagttatgtacatttttggctttttatatagtttgcagaaataccctccagaaaggatgtgataaaacatactttttgtagtgaagtatggaatgacaaattcccatcacattataataagcatggtatatttttaaaaaaaggaaaagaaaaaaatgcactaagattacccaacagcatttccctagcctacaaaaaatttaccaaaggtgaggaaaacccatattacagcacatgttggactcttagaggttattacttagagaaataaaagtagtattagatgaaaaatgatttctaagtccctcttgacttgtaaacactccacaccccagaaccctctccacttttgcttccaccagaacctcttcacacctcatttctttattcatcgaaaacctcaaaggaactcagaaggcttacagctgagccaaactatgagttttaaaagcttatcagtcaacttcatcactacttactgtgttcttggggggaaaaagtattctgaatttcgaacatattgcagaaagctaaaactaaaaagaatatttgttctaatgaagcattagacttttttatttccatgaagaggaacgtgcttaaattctgagaatgaggtacatttggtttgccacaggaactgaaaatctgaaattctaggattcttaatctggaagacatgggttttggcaggtaccaggtttaaatcaacagatgtgtctttaaagtcatagtaatagcaaactgaattgcatttgtagagacaatgaatcaaattattacaagctggtagtaaaatataaaatgaaactaactagaaaaaggcaatgagtcaagatgactatagacttggaaatcaatcaatttacaaacatcccaataaaccctagagataattaaagcttcttctcaatcattaactagtaaggccagagccacctttattaaacagggaattgaaaagaggcaaatgtctatgttccaggacacttcacagttcctacatatttgctacttattcaaacacttgtattctggaccttaactttccttccacactcagcatcatctctcaattttggcaaactctatttattccaatatattgattgctttgcataggtaaatggcgcccataagtcatgccacaattacatgtcaattaggcttaaacccgctcagtgactccttggctgcaaatgtttacagacatgatactaaatgatcacttatatgaacattaaaaaataataaatcttcaggctggttgatttggccatttgtacagctgttgacttcattttttgaaatcagataatagttttcccacattcttgccaattaaagtataaagattactggcttaatgattttaaaagatttctggtgtcttcaagagtaagatcctcctaaagtgcatggggtcattatgcctccattgtgttacttcaaaattgcacaaatgagatggaaaatttggtaacctaattccattctcattagtctcatgaatctactataaactcctggtcaaagccttggcactgacctattaatagatgtttgaaacaccaaggaaacagaatattcttttgaacttgaactccttgttgacaggaaatggaaagagtagtgggtgttttgtttgaggggtgtgtgtgtgtgtgtgtgtgtgtgtggttttgagaggttcctgcactcagcagccccaaagctgcagctgcttcagagagacttcctgcagagtgacaggctcccttctgaggaaaacaggagtgaaagctgttttggatctcagcactacagggtgctgcacatggcaccagctttcaaagtccctcttatgctcttcaatgggacaatgtcagtttagtgaaatgtgactaggtagaaaagcacagaaatatcatttgctttttgtctactactcagcacttcaagggttctgtcatactgcctttttgagaaaaaaaaataaaattgtttaatcatatattgtgagcccaaagtgttcagaattcacaagtagacaaacatatctgcagaactgggtgaacaatgcccccaaagatctccgcaacctaatccctggaatttgttaatatgcttccttgcatgacaaaaaggctgttgcaggcttgatgaaattatgggctttgagatggggagattatcctgtattatccaggtaggccaaagtaatcaaaagtgatcaaaatcagaaaaagaagatgtgactatagaaccagaggttgaagtgatgaactttgaagatgaaggaagaggctataagcaaacatatgcaggtggcctctcaaagctgataaaagctttcatgcagcctccagatgaaaatgcaggcctgccaactccctgatatcagcctctgaacatcagaactaaaggaatataatttttgttgtttaatgctactgtttctcgtaacttgttagagtagcaataggaaactgacacaagaactaatcagcatatacggagctcctaggatgaatttagttttgtgactgtttagggatttcatgatggtaaaactcaggataaagtcaaagtacttctaaaatctccaaagactcaagaagtcccacagcattctgactgccacgagcgaaaggatacctggaatagaggccaaagcagtcatccttaaaaattaaaaagtcttcagcatatggctagccagttttcccaacaccatttattaaacagggaatcctttccccattgcttgtttttgtctggtttgtcgaagatcagatggttttagatgtgtggtgttatttctgaggcctctgttatgttccattgttctatgtatctgtttttgtaccagtactatgctgtttttgttactgtagccttgtagtgtagtttgaagtcaggtagtgtgatgcctccagctttgttatttttgcttaggattgtctttgctatacggactcttttttagttccatatgaaatttaaagtagttttttccaattctgtgaagaaagccaatggtagcttgatggggatacattgaatctgtaaattactttgggcactgtggccattttcacgatactgattcttcctatccatgagaatggggttgtttttccatttgtttctgtcctcttctagttccttgagcagtggtttgcagttcttcttgaaaaggtccttcacatcccttgtaagttggattcctaggtattttattctctctgtagcaattgtgaatgggagttcgctcatgatttggctctctgcttgtctgttattggtgtataggaatgcttgtgatttttgcccattgattttgtatcctgagactttgctgaagttgtttatcagcttaaggagattttgggctgagatgatggggttttctaaatatacaatcatgtcatctgcaaactgagacaatttgacttcctgtcttcctaattgtatacctgttttctttctcttgcctgactgccatggccagaacttctaatactatgttgaataggagtggtgagagagggcatccttgtcttgtaccggttttcaaagggaatgcttccagcttttgcccattcggtatgatattggcagtgggtttatcataaatagctcttattattttgagatacgttgcaccaatgcctagtttattaagagtttttagcatgaagggctgtcgaattttgttgaaggccttttctacatctattgagataatcatgtggattttgtcattggttctgtttatgtgatggattacgtttattgatttgtgtatgctaaaccaggcttgtatcccagggatgaagctgacttgatcatggtgaataagctttctgatgtgctgctggattttggtttgccagtatattattgaggattttcgcattgatgttcatcagggatattggcctgaaattttctttttttgttgtgtctctgccaagttttggtatcaggatgatgctggcctcgtaaaatgagttagggaggattccctctttttctattgtttggtatagtttcagaaggaatgataccagcttctctttgtacctgtggtaggattcagctgtgaacccgtctggtcctggactttttttggttggtaggctattaattactgcctcaatttcacaacttgttattggtctattccgggatgagacttctgcctggtttagtcttgggagggtgtatgtgtcgaggaatttatccatttcttctagattttctagtttgtttgcatagaggtctttatagtattctctgatggtagtttatatttctgtgggattggtggtgatatccactttattatttttattgcatctattgtatcccttccttacaccttatacaaaattaactcaagatgaattaaagacttaaatgtaagacctaaaaccataaaaaccctagaagaaaacctaggcaataccattcaggacataggcatgggcaaagacttcatgactaaaacaccaaaagcaatggcaacaaaagccaaaattgataaatgggatctaattaaactaagaatcttctgcacagcaaacgaaactatcatcagattgaagaggcaacctacagaatgggagaaaatatttgcagtctatccatctgacaaaggctaatatccagaatctacaaagaactttaatttataagaaaaaacaaacaaccccatcaaaaagtgggcaaatgatatgaacagatacttctcaaaagaagacatttatgtggccaagaaacaattgaaaaaaagctcatcatcactggccattagagaaatgcaaatcaaaaccacaatgagataccatcttgtgccagttagaatggtgatcattaaaaagtcaagaagcaacagatgctggagaggatgtggagaaataggagtgcttttacacagttggtgggagtgattagttcaaccactgtggaagacagtgtggcaattcctcaaggatctagaactagaaataccatttggcccagcaatcccattgctgggtatatacccaaaggattgtaaataattctactataaagacacaggcatacatatgtttattgcatcactgttcacaatagcaaagacttggaaccaacccaaatgtccatcaatgatagactggattaagaaaatgtggcacatatacaccatggaatactatgcagccataaaaaggatgagttcatgtcctttgcaggcacatggatgaagctggaaaccatcattctcagcaagctaacacaagaacagaaaaccaaacaccacatgttctcactcataagtgggagtggaacaatgagaacacatggacatggtggtgggggacatcacacaccatggcctctcactgggggtggggctgggggagggatagcattaggagaaatacctaatgtagatgacgggttgatgggtgcagcaaaccacaatggcatgtgtatacctatgtaacaaacctgcatgttctgcacatgtgccctagaacttaaagctaaaaaaaaaattttttttaagtcattctagaatccatcccttctttaggtcatgttactacttgaaaagtctttggcccagtagattagtctttaaaacattgatatcaaaacatgttaataatttgtttccaacctatttcttcagccccatgtcctcctctagcatcctgcatgacagatgcatccctggaaaaaacataccaatgctggagccactgattagaatgacttacctggcaaatgtctgctcttccttccagaagtccagagtaagcattaactttgtaaacagcctttcctaactttccacgtcccttccttaacagcctaaatactttgctgaataaaatattattacactatcaatgttgtagtgtaatttctattatgacataatctatctttttaaaaatcttcctatccctgcttgattatggttttataaagaatgaaaagagcaaacttattaactgcctgatccttaatacttaagttttggcacttaaaaaatgaatgaatgaatgaatgaacaaatccaagagtataggttttaatgagttcaatttgtgtgcatgccaacaggttttctatggcaaaaatacctgacccctgacatgactctcatagctctgtgacaggttttccatggcaaaaatacctgatccctgacatggctctcagagctctatgtaacctgtctccaacttcttctgcctttcctctactcaattgccttgcttcccagctctgctaaccatctttcaattactcaaaataaaaattcttttttgttgttttaggaattctgcaaatgcctctgttcattattcaaatcacatcaactaaatccacttctacttctcatcacacactttgctttgatagcttcttcctatccaataagtctcacattaaattacaattttcttaaaggcctattgtgaccaaccaatctaaagtagatagctattattacactctctcacagctcatattcttttcctatgtataacaacttgtaattataagcacacgtgtttagttgttaaatttaggtctctccctcagaaatgaagttcaatgaagacagacatgtcagttttcttccccattattgtactatctacatggcaaaatttgcacacaatgtcagggctcaaaaatatttgttcaattattgactagatgaaggatacatgcatgaaagaaaatataaatgacttaatagcaaaagtttcccaagcagagatggatactttgccatactttgttgacatgaagagaatcagctatatgtagacaaattgatgaatacaaatctatcaatttgtttgtaaaaaaaaaaaaagtgtataaatcagcccattttaatcccaggttacaataatacttgctagatattatggtatacaggtaccaatttaagtagtaattatagctgagtagattaggttagtgtgtacacattccatacaaacatcaaagtctttgttcaagaaaataaaatgaagtacatttgacactagattgccctcatgtctcaacagtaaatattgtttctgatcttaaaagttgttttatgcccacagattcagaattagttattgttgtttcctactttgcacttaaatgcgttttcaagtgataatagaatttgtacaaatttcttcattcacaatttgttttgcttcattcacaattgtgttatttctttcttattataaacaactatatagtaccgtatcaacatgttaagtttcaactttctgaaagctgtgaattccatagtctcgagaacaatggctctgtctattgcaatcaccaggaaaaacagcataattttatcaggcacaactaattattttagaatgtttttagacagtgataatgttaattgtgactcgtactaagatcatctccaagttcttaaaataattgattaatctcttgttttcaagactccttaaatttctgttgttttctggggctaagagactaagaagcatatatatatatatatatatatgagaaatatatatatatgagaaatatatatatatgagaaatatatatatgagaaatatatatatgagatatatatatgagaaacatatgagaaacatatatatatgagaaacatatatatgagaaacatatatatgagaaacatatatatatgagaaacatatatatgagaaacatatatatgagaaacatatatatatgagaaacatatatatgagaagcatatatatatgcttctcttacacagtgtttaatagtagtagtgataaaacatatatatatatgtcaagagagagaaaatcataacatttgacttgttttttatagttttgttctcaatgcacattagtattcattcttacttgaggttcagaaaaacattaaggtttttgtctcttcttatccttgttccattagttatcaatataaacatccttaccatgttgtattataataaaactttatcaatattgttcatagttatctgtatccatatgttttttcccacactagcaaggattctaatttattcatcttggtataaaaaaatctctacagtgcatgttatacaaaaggccttaataatatttgctaaattgagcagactggagtaggaattgtagttattaacaaacttttgaaattagaatcctaggctaagtttataatccatttacaagattcaaaatgatggctaacaaaatcaggactagaagttacctagctgatactttgagcaaagctttttccactaaatagtatatctgaatgtcttgtgacataaattcatatgtttatatatctctaggaattagaattatccctaaaaattagaaaacgaaggaagcaaatgacttcaattcaaaataatataatatgtaggtgcataaaatattaattatcactttaaatagtagttagctttgagttactacagttgttaaaccatgggctagacagcttttcaataatgatattagagggaggactcaaacatgagacggttgggctagataatatttgaatttcattccaataggtaaagtccacgactctattttttcagacttgtacttctaatgaaaaaaagtagccctttatattttacctacataccttttatgatcaattaaaaattaattaatagaaatatatatattctaatcaagtagattgggttctaattctgttattgtttgacttggggaatttaatgacagcacagcaaaatagttaagagtgtgagatctggagttatccctgctgaatttgagtactgatcttcatttttgtatcctaggcacataacctctataagaatcaattgcctcatctgtaagtttgatatgatgccacgtgaggatgctctcaggagtaaataaaataatagctataacatgcttagcagagtgtttggcctggcatataataaagtctcaatatatgccatttatccttcccatcctggttccccagaagtaaaattgaaattgtactagatcagaaatatcacataagagtaagagtaccacccctctcacacttatacaaaacatttccaagcaactgcggcacagaatcctgaagagtcagccttgttttcaggatccttcttaacacacccttctaaacaatcaccatcagttaatcaaaattggcagagaaattaaagcctacttgtgctgtctggacttgatggcactaagattacttgtgatgttctagaacatggtagaaactataataataaaacagggtcatagtattgtagatacgatgctattatttagcttaaaaaatttaaaatatagtaaatacacacccatgcactcatccacagtacgttataaagaatagaatcctatccattgtccatgttaaaaaaaagaaacacttgcccctcttcactattctcatcttactgaagtcatggtgagagtatttctggaaagagtggctgttggtagaatgagaaagaaaaactgcaagcatatagcaccaattccaccacattcacagtatgtatatcttactatcatgtagcatcagatgcatagtgtgaatagctattttgggtcacaacaatatagcctgagaattgaatacattttttaagttaggcatgatttgattgtatttggcatagaagatttagaatgtgacaaaaagtaaattaatcttaatgtaatatatctcgcttttatcatcaacaatctttattattctaattatggaaatctgttggtgaacaatgggcacaaacagaataaaaagattggatggtttttatttaagttgcaattgctaacaactcatacacagttaacatttcaaatgaaagggcaaacagtgttcatgactaaaattaatggaaacagatgagaataatctgttctcttaatttctcttattgaagctcagctacaccttactgtcctcctgatggttggctatcaatcatttgagtcatgcatctctttcatacagatgacagtcaagcaccagatacactggatgtgggaatgtagaaaatctgatatttcaagttgaccatccagatagattatcaaagttttgtaattgcattttgtaattgtattttgtaattgtcttctgtgggtttaatctgctatttttaatagagaaaattatgagagattaaattttccatcttcctactctagcacttttaatgctacaaaaacattttagagactgtaatgattgttcaattttctgtctttaggtacaacttgttaagtacttgaatcatctgcccaaaatttataaacaacatataagaagcactttaacaaagacgtttgatgaacaagttgttttggattggtttacttttaatcacttcataggaaatcctaatgtttcccaggtgagtattagcaggattctaagaaatcataaaaagtttttcacaaaataataattcatttggatttatatttgcaaatgtgataggtttgcctacctatacaagcactaatgatgtaagggaaggtatataacaaagacctgaaatgaacatacatttcacaagttttaattatatgatcttgaagtgtttaaattgctgaatgtgtcaaaaattatgttaagaaataggggccgggcatggtggctcacacctgtaatcccgtaactttgggaggccgaggcgggtggatcatttgaggtagggagttcgagaccagcctggccaatatggtgaaaccccatctctaataaaaaaaaaaaaaaaattagccaggcatggtagcgggcacctgtaatcccagctacttgggaggcaggagaatcacttgaaccctggaggcagaggttgcagtgagcctagatttcaccactacactccagcctaggcaactgagtgacacaacatcttaaaaataaaaaaaaaaagaaaaaataaataggaacagtgggaaggaaaaatatcaagaatcaaatacttattctgaaatacaaaacaaaatttatttgcctttctccaaattttaaatgctatcctttaagaatgttccaaaatcaatcagttctcaactgtacagtagttgttaatatatcattagttaaatgggatataaaataaacaacaaatatacaaatattgttctgcaaaaatatgttgtaatttgtttttgttgtatttatttaggaataaatattttcttctagaatagctgaatgtagcctaaaatacaactttatagacattcaaactgtattaaattgccaattttgaaccttctgttctttagaaatggcaaattcgtattattacatataatattttttaacagaaaatacttttaaataaaaacctttaaattatactaaatagttgccatattggacttaaactacctaaaaatactagttttatctagttttcatagggatatttatatcagaaaggatatttaaaggaaaagaatacctttaagattttcaaaaaacagttgacaggtggagtaaattagcctggaagagtgcctggtctagagtcaacaccgcaataaaactatgaaatctattaaatacaaacaaggcattttctaaaaatataatttttaattaagaaaaattcagacagtacgtatgcgaactataaacatttcatacttgcccacaaatgttacagtccctctaaatattaattgattcacttatttctaattataacttaatacgtagtatttacataagaaagagtagagagcatttcacaagcttaaaacataatataatacctgctttttcataggcataactttcttactcagatgtatttcccaaaaaaaagtggttttaaataagacatataatcaaatctataaaagataaaatgttttcattacacttgaaacatactggataatagaacattgaatgtttctctctcacaatccatattgttccttttatacgtgaatccttttataatgcaaaagagaagaaaaaagctaaatttcagcaaatgaaaaagaaacatgcaaaataagagtaggtacagaagtttctagtctggaggtcagatccaggcatcattatgttgaaattgatgtggtcacacccccagtggtgatagaaaaacatttcacctcaggaactatttgagataaagagcaaatgaagtttacacagtgtttaatcggagtagtgataagaggtaggaagtaatgacaccctgaagtcgcagcctcagggaaatggttgacaagagtaatttacctaacactttggaacctctaaagtctctatctaataattatctccctgcctccctaaccttcatttatccactctcttttcattcattctcttcaattcttggagtgtgcttccacagtttgttccctgacttcttaatttgtctgagtccgtctcatagagtttgcccccactccatacacacacacacatgaatgccaaatttatattttctttccttttctttcttattgtgtctatagacttcttcttaagaaactatattatgaaactcaagtaaaatatttaatatttattgggcttttagaataagactttatttttattataaaattcagatgaataaaatatcacctgttttttaaaaatctctaactaaattaacttacctttgacttttattcagctaccattataaatgtagtgacaagaaataggaaaaaattctctattttaatttatacttagcaaaatatatgttggcacaattaaacctcatggcaagaatgaggacctggaaactttgtcagttttaaatccctttctatgtaatttactcacaaaattttgatttaatctttggcctcacagaaataaattaggtacaaaaaacaggtgtagctggtgttgtgttaaatcagtcaaattcatttttttctttttccactaatgatacttcccattgttcttagtacaaacgtatgacttcaaacagcatgtatcaaaagtcaatcaagcattttatacatttatattagcagcaaatcattaagaacacccagcatctaaaattagaaaagtattctggagcaaggcatttcctcccttggcactatcaaaagctcttctcagaggtaaatattttgttcacacaacagacatcagctgattgtataaccccagtaggccataaaatgaccttattaattgaaatgcattgtaaataatagcagggatttcacacagcaaaggctgtacgcgaaacaaattaaaaaaaacacaccaaatctggagaaactggttatgtgtgatggccaataatacatttatttattaatatatattatagtctattaatatacataatgcaatataattacagtatatattgtaacaatatatctcattgttctgatatgcatgcacatttgatgggtgaatgtgatcaattattgaactcagaaattagttaagactgcaagtaaaaatacttctaaaagatggaattttcctccaatctcagaacacttgggaaaagtcactttgtcatcatgacatgaacaaaacatgtcaaaataaaaagctctattttgtttatctatctaaaaaaaaatcaccctcttgcatgtacagctgtttacacatatatgcatgtctgcatgttctttgggggaagagggcctgtaccttgtttttgtcccttaaccatttatatctggatgcctgggaacccctaattcgttcacataaatctattttgttctttgtaagggctctatattagtccatgcctattgtggatgtaacataattatttagcctgccaaatattgtagtcattatgttatttctgtaattatgtgattataaacaacactgcaagaaatgttcttgtatataagtcaactcagacatatgttagtttattagtaacagtcctacatgaaaagaaagatatagctcttttcatagattttatcaaaatgtccctcaacaaaaaatatataaaaaggcatgttctgaaacctcactgacaatttttgtcaaacatttttgatgtctactaagtatttaggtaaatatattatgcctcattattttaatttaaatttttccaagtaaattgaacatcttttcacatgttgtctttttatgtctattctttgcctacttttctatgggttattaaatttttttgaattttctaattagtcctcttcatattttaaacaattgagcatttggtcttgcacacatattgaaaatacttttctataatgtgatttgtcttttaactctgttaagtattttttcaactgtattgaagcataatttaaatacaataaaataaaccagttttaagtgcaaaatttgaggttttataacacatgacataaaattatttctgtcactcagactgtcctcattcccacttcaaatcatttcttccctattcaccttcccaagcaattatagatcaaattttcataactataaattaggtttttctttaattgtatttatttatattatttttattttatttttatatacttatttctgtaacaatagattagttttgtgttctaaaatgttacacagatctgtccctaacctttacctccggactcttatggtgggaaaaaagaggctttgagacttcactgcctaacagcagtgttctggaactccatgctgtcaataaggtagtagacaaattaatttgtgagggactggcttcttcaccttatactttagcataaaaattgataaagcaagtttttaaaaattttctccaagatggcagataagaggtttttagtgtgcctcagccacttgaaaacaggaaaacggtacataaagatcaactctgggagctttaattcaaaaaggaaaacaggaatccactggaatcttgaaggacaaccaagattctggggaggaaaacattggcaaacagcctctgtgatggaatccagctgataaaagtgagtacagtacaggagggaggcagagagccttcctccgtgacttacctttccactggggatcggagaaacccaggccaagagagagcacttcgtttctcccaagccttggagctaacatagggagagccttggaggactgagaggaaaagacatggggaaaagctacagatattttcccagaccttggaccaagagcagggtgtcatttttaatctgggtgcacacaaagtcaaccattctttggcaaaaaggcagtgtggtcatgcaggtgtttttgtctcaggccagagattggggcacttgctctggattgtggtagcggcccccacagccagaattgtgaaaagcacctctacattaggcataagaattgtgctttcccctatcacaggcttagggtgggaggagtgctgccacagctacagtgggaaacagaattgaagccaaggccagtttggcaatctggaaccagtctgtgtgtgttattgctgggtgccccagcttgctcccctgagatcacagtgcagtggggctctctccacttcaaccccaggtagaatttcacccattcagaacacacgcttatctggaccactagcctgagccaccccactcttcctgggcatagatcctggtgcaatgatgtcttctttgctccatgcccaggcagatctccaagaatttggatcatacactcacatggactagtaatctgaggcaccacacgcctcctgtgcagagatcctggtgaagggggccctcttcacttcacaaccagtcagatcttcaggcattcagggcaaccactggcctggttcagcagcctgagctatgccacctttcctgagcataaaccatggtacaatgcaatgctctcttctccacactcaggcatatctctagacattcagagcacctactcacctggaccagcaacctgacccaccctgcctttcctgtgcaaagattgtggtatgtgggggatgggacactctctgctccacatccaggcacatctccaggcattttgagtaactgcttgcttggttaggcagcctgagccaccatacccttcctcaacatagatcacggtgcagcaatgccccgtccgctccacacccaggcacatctccaggcatttggagcacctgctcacccagattggtagcctgagccacttcaccctgcctgtgcagagatcctagagcagcaggcctctctgcttcatacccaggttgcactccagtcattcagagctcccacttgccttgttcagcagcctaagtcacaccacctgtcctgtaaaaagatccttgtgcagggtccctttccactccacacccagtcaaattttcaggcattcagagcatctgctcacctgaatcaacagcctacgctgccaaaccattccttgcagagactgtgaggaagcagggccctatccaacccaagcccaggcagatctccaggcagctggagcaccagttcatccgtattaccagcttgagatgccccacccttccagtacagaggctgtggtgcagcagggttctatcaactccatgcccaggcagatctccaagtacctgtagcatccactctccttgattaggagtttaggccacccctatccccagcttgttcagagaactttggtttaaggaggtttcccagctccattcctaggcacacatctgggaacttgctggtcacccactggattcttcctcagcactggtgcttatgcctgccatcaggggactggtggtcagtgcttcccaatctagcctcatccatctctcacccatctagggcttggcattgagctcagaacactgtgcactccatgtagagagcttcttttggtcagcaaggatcaagtatatatccagccatgttaactgcagccagctcttacccataagtgccatctactggctgtacgtcaaactgcacaactcaatataaaacctgtcaaaagaagcatgtagggatgtagaagcaaagccaaaacaccctactcaatattctctaaagtcacacaccctaaggaaagggggaaaggaaagaaaaaaatcagtaatattattgaaagaaaatttaaaatcctacttgcatgaaaataattataaactagaagtgctagcatttccagatgagaaggaaccagcataagaattctgacaaacatgaaaaatctgaacacactaacaccacccaactatcacactgtctctacagaaatggtccctaaacaaaatggaaactgagaaatgatagacaaagaattcaaatcatagattgcaaggaagctcaatgagatccaagacaaggtggaaatcaacaacaagaaaaaaaaaccttctaaacaatacaggaaatgaatgaataaataaatatattaaattgaaaatttcccttaaggaatttaaaaatataactgaaacctttatcaattaattggaccaaacagaagaaagaatttcagaacttgaccagtcattcatgcttacctagtcagacaaaaataaagaaaaaagaatttagaaaatgaaccatcttcaagaaatatggaattatgtaagatgacaaaacttgtgaattattggcattcctgagagagaaggagaaaaagcaaaactggaaaatatatttgaggtaataattcaattttttaaaattttgctagaggtagacatttagatacaagacatccagagaacattcttgggataatataaaaaatggacactacaccaaggcatatagtcaccagagtgctgaagggcaatgttaaacaaaaaatctaaaaggcaactataggaaaagatcacattacatacaaagttttagctatgacttctaaatttcttttcaaataatcgatatgttagtatgttcaattctttaccttctacttttaaacttaacttcctcataaagcaacctttttcgattacctgctccaccctgactcatttcaatcacctgctcctccctgactcattccgattaccctgctctgtcataaccatttttccccaccaaaccactcactgagtcactctctttaaattaaccaatcagaattagtttagcctgtgtagtctagccctagccaataggggaatgacacagcagcaggggccacgtatgtcagggataagaaccccttcccctcccttgtccaagtgtgcgctcaccattgctccatctgtaagggtgcacccttctatagaagtaccttgccttgctgagaattaaaaagaaaaatttatattcaagtgctatttattttgtggcaccgaaactttatatataacaatttgggggctcgcccacaattacatttccctctggggatggtctctggttctctctcatgaggaagtacacaccccgctccttgtggcagcctcaggggtgagaaatcagaacccacccagtgcgaggaataacctgagcactgaacaacgcagaaaaaagaaaaaaagattggccagcaacctagcttaaaggatcctgatactgctgcgatgactctgcgcacagaccaaggaaggagaagccacgggagccggtacagtatttccctggtggtcaggaccccctcggaggggggtgtggtggtgaagtactccttggttggggtggcttagaggttaaaaagcggcgagacgtctccactgggggggtttcaacctcacatgaacctccagtagtagaaaaggcaagaaatttccagtggggaaattgagcctcacctcaaaaaggcaagaaatttccagcggggaaattgagcctcaccccaaaaggtgagaaatttccagtaagggaaattgaaccttgaaccttatcccaaaccatcaagatgggaaataccccaagcaagacagggagcaagggggataaagatggtaacaaagatatccccccaggtagccccctagtctcatgctaaaacactggaaggataataaaaggactaaacagaggaaaaagcaacaaatgataaaatattactgttttatttggactcagacccatcctcaaaccctcaatattctggccaaagtttgggtcgaatgagtatgtgatgtgtaagcttctaatccgatatgttaatgataaaagtccagtgtctcaagaggaactaggctatgccctttgttggaggcaaggacctgctctccttttctcccttaaaaacaaatagggaaaaacccaatctggcacctcaaaatgaaaagtcagaggagccagctgtcatgcctaaagactccagtgcatgggatcccctagactatcttcccccactcagtgtccccaatctttcccctcagacagccactgccgcctcagatcccattccaaattccccctctactcacattatccctcctcgttataaccctgactcttaggaattactgtcccaccacctgttccctaccaacctaaagacccttctctaaaaggatcccagcctccatctggagaaccaaggtccttgtctaccaggccccctaaagagtatgggggagcagggttaaagaattccagaactaagagggaggaaggacaagataggtgctatagacgtggaagaacaggccacttcaagagaggatgtcctgaacaaagaaaggagaaagaagcccttccactcatgactttcaaggaagaatggggggtcaggggctctatctcttttatcctgagtcccaccaggagcccttgataaatttggaggtgggacctaaacatgagcttatcacctttttagtcgattcagagtttgctcgctcctgtgtttgtttccccccgtctaatgttgtctcctcctcagaggaacttagtctctggggtaaaaggggaaggagaggggagaacagcagcataagcagctggcagaggcagggaaagaccagcagagaggaaagagagagagagagaaaggaagcagagagaaagagaggaaaaacagaaacagagagaaaatgagtggcagagagagaggaagacagagacaaagagggagtcagagagaaagagagagacagagtcaaagagagaaagaaagagagagacatagaagtagtaaagagaaaacaatgtaccctattcctttaaaagccagggtaaatttaaaacctataattgataattaaaggtcttctccgtgacactataacactccaataccaccttgttgtcagtataaacgagggcatagcccgaaagcactgaggccactgacaacccgtagccttcctaatcaaaaatccttaacccggtaacccaggatggcccacatgcatttaatctgtagtggcaactactttgctagcagaagaaagtagaaaaatagcttttagaggaaacctcattgtgagcacacctcaccagttcagaactagcctaagtcaaaaaaaaaaaggaaaaaggaaaaaggtagcttaccaactcaaaaatcttaaaaatcttaaagtatcgggctattctgttagaaaaagacgatttaacactaaccactgaaaattcccttaacccagcaggtttcctaacaggggatctaaatcttaattaccatacaaagttccgaccagacctaggaggaactcccttcagtacagtaccatagatagatggttcctcccaggtgattgagggaaaaagacacgatgggtattcagtaattgatcggaaaactcttgtaagagcagagttaggaaaattgcctaataattggtctgctcaaatgtttgagctgtttgcacccagtcaagccttaaagtatttacagaaccaggaaagaaccatctataccaattctaagttaatttggactaaacaaggtcttattaataacgaaagataattgaaatcccaaacttacaaggttttcaacaaaagtaaaatttgctacaagttaacagtgtaacatatattaccctaacttctaatcttgtggccttaggcagtctagtccacagacatgaaggaagttcgccttggaaaagaatggttatcatctttggaaaaaaaaaaaaagggagaatttatgtaaaaagaatgttatatggtaaattattgtcctaaaaaattaactggttgtttaaagaaagggatgtttgcaacaagtcagaaagttgaagcgtgttgaagaattgtctgtgaaagtcgtggaaaaataaaactgtattgtaaaagggaatttatgcaagaaatgtataatttaaaagtaattaggcctcctgaatgtaaaactattaaagaaacagtttatgtgaaaggtgtataaggaaagtaaaatatacttttggtaaaaggattatacggaggcataataatgtggatttttatctacattaaaaggttaaaaaatgttctgttttgaaggtttaagcaagttttaaaatgttaattgtaaaggaaattctgtgtgtaaacatattggctaaagttaaaaaggtatcatccagtttttctgtgaattggacattaaaattaaagcacaacagatttttcttaaagcactaacttgctctttaacaaaaattataaaaggttaaaagcagtctataaaaaatcttaccttatggttagatgttaaaattaaataaatatgtctataagatttttttaaaattgagtttaacattaaaaacacactaatacaaaggtgaaatttagcttatctggtataaaaatcatacaggaagcattgttaaatataaagtggtgtttggctttctttggtctaaaaactaataaaaataggtgctaaaggaaatttctcagtaagaaggcaccaaagactataaagtccactgctgatgtccccatatttaaaacaaaagatcaatttcttagaaattatatacttggtttatcttcccctttcctttccctcaaaactaaaagtctttcagcacaggtaccacccctagaatttccagtaagccagcaccagcttgaagatcattctcatcaaagggtggaaagaaggaaaagttgagccagcctgggaaggaccctaccttttgctgctaaccactgagactgctgttcatacagcataaaggggatggactcatcacatccaagtcaagaaagcgccgccccctccagagtcgtgggccatggtcccaggggaaaaaccctaccaaactaacgctaaaaaaaaatttaactctctttcttctacgctattactctttcttctttcctcactctattgctgaccaactagttattaacataaccaagtcaattttgcctcaaactattgcatttaatgcttgccttgttataccctgtggggacctgccaagtcaaagaccgctctctacttcagaaaagcacctctgtccctcctgactctcctcagactgggcactagtgaattgggaccatttaatccagggagatttcaataaagaccccagtgtcaaccaggagtcttgctccccaatctagagcttttatgccatagttagtccaacgttctgtggaccactaaagaacaacaatggactgccccaaccagtttttgtagtttcctaaaaccatacattcattttactagagggacagccctccccgctaactgtcggctaaaccagtgtaattctatatgggttattatctcaaaccttcaaagttcttccccttttctaagccggttcccttctttaagccagttttatggtatggggactgaggtttcagggacaaaccctgttagattctttgaagtgcatttctttgatcccccaccacctgcaccttcctctaagccttcttccaaaacctcttacaatggaacaattgttcctcctccatctaacaacaagaccaagatagctattgtaaaagttaaagacttaaaacatactttggcaattaagacaggataccaagatgcaaatgcctggttggaatggatcaaatattctgtctgcatgttaaacaaaagcaattgttatgctgtgcgcatagcaggccagaggcccagattgtcccctttccactaaggtggtcctccagttgatggggcatgggctgcatggtagctcttttccaggattctacagcctggagtaataagtcatgccaagatctctctctgctatatcctgaagtccggcaccctgagggccatccagcttccatctcccaccactaagttcactttgtgtctctcatgacagggaggaaagttagtgttccttggagacctgaagggatgcagtgaacttaaggatttaaaagagcttatcaatcagcccttgttcatccccgagcagatgtgtggtggtattgtggtggacctttactggacactctgctgaataactggagcggtacttgtgctttagtccaatcggctatcccattcaccctggaattttatcaaccagaggaaggaaaaaaagacatcgtaaagtgagagaagccccttatgggtctttcgactctcacgtctatttagacacaattggagtcccacagggaataccagatcaatttaaaacccgaaatcaaatagctgcagaatttaagtaaatattttggtaggtgacaataaaaatgtagattggataagctacatctactaagccaagacatgttaaaaagtttgaaaagaaaactgtaaggaaatacaaggggaggggttgttagatatgagtcctcctgcaacataccatctcacaccattcagaatggccattattagtacatgtgctgttgaagaaagcaataacagatgctggtgaggctgtggagaaaagtgaacgcttatacactgttgatggggagtagttcagccactgttgaaagcagtttggatatttctcaaataacttaaaacagaattatcatttgactgagcaatcttattactaagtatgcatccaaaagaaagtaaagtgttctaccaaaaagacacatgtgcttgtatgttcactactgcaataatagcaaagacatggaatcagtctaggtgcccatcaatggtggattggataaagaaaatatggcacatatacaccatggaacactatgcagccacaaaaaggaaattatgtcatttagaacaatatggaggcagctataagacattatcctaagtgagttaatgcagaaagagaaagtcaaatactgcaggttgtcacttacaagtgggagctaaacatggtgtactgatggacataaacatggcaacaataggcagtggggaatactagagtggggagggaggcaaggtttgaaaaactaactgttgggtactatgcttactatatagggaatcattcacatcccaaacctctgcatcacataatatacccaggtatgaagcctgcacacatactgcctgaatctaaaataaaatttgaaattataaaaaaaataaaaaggtaaagaaaactttaaataaatacatagtatgtactcttttctatttctggcttatttcacttggccctatgttttagtgcatatctatcttgtatctgtagtgtattcttttttactcctgtggagtgttatatatgaatatacaaatgttttaatccattcatcagttaatagacattaaggttgtttcctattttgataatataaataaatgtatgtgcaagactttgtgtgagtatagtttcaatccttttgcataaatacctaagaataggattgctagctctattttaagtgtgtatttaaccttatcagaaattgtctgatatggcttggatgtgtgtcccttcatattgacatgtaatacccaatgttgcaggtggagcctagtgggaggtatttgggtcatgggggctgatcccttttgaatggcttcatgccatccttgcagtaatgagtgcgttctcactgtatgagctcacatgatacctggtcccttaacagagcctggaatctcctcctgtctcttccccctgctcttgccatgggacacacttgcttcccctttgccttatgccatgagtggaattttcctgatgcccacaccagaaggcgagcagatgctagtgccattcttcttgtaaagcctctataactgtgagccaaaataaacctcttttctttataaattacccagcctcaagtatttatttatagcaatgcgaatggactaacacagcatcaaactgattttcaaagtagctggaaactttacttttctgtcagcaatatatgagagttccatttgtctgacattcagacagtcttttaaatgttcaagttgatgtgttgtggtattttataatggttttatttaaaatggctgatgaatagtgatgttgagtatgatttaaatgcttctttgccagtaacatactatgttttatgaagaatttgttcaaaactttcactatttgtttttattgggttatctttactttattgaactttaagaactatttatacattatgaatgctagcttttcatctgatatacatgcaagcgcatatggacacgcacacttttcacccagtcgggtttgccttgttatttttccgaacattttttttaatgacccaaagttaagttctcaatgttaataacatctgattgatcaatatttttcttttataatctgtgctttttctatcaaatctaaaaattctttgcatctccaaattctcaaaattattttcatatgttttattttatatttctatagttttagattttatatttaggttcataagatctttttagatgatgttcatgtcatggtgagttattgcaagacatttacttttgtccataaggtatctaattatttcagagtcattttttgaaaacactattttgcttctttggattaccttcacatttttattaaaatgaaacttaccatataaatatgggtctacttctggaccctattcagtttcattgatctatatgtctatccttcaaaaataataagctatctagattattgtaactttataacaagccttgaattcagatagtttttaaattgatacataataatttacatatctataaggtacgtgtaatattttgttacatgtgtagaatgtgtaatgatcaaatcagggtatttggcatatccatcaccttgagtatatatcatttctatgggttgggagcaattcaagtctgcacttctagctactctgaaatttataatacatcgttgttaacatagggaaaacactccaggacattggtctaggcaacaattttatggctaaaacctaatctgctgttgaacattggaacttgggtcttccatcagactatatatttgtactcattaaccagcctttcttcatccgttacatccacccacacacttcccagccactagcatctttctactatctatgtcatgagatcaactattttagcccccacatatgagtgagaacatatgatatttgtctctgtgcctggcttattttacttaatataataacttccagttccatttatgttactgcaaatgacataattttattcttttatctggctgaattgaatttcactgtgtatatataccatatttcctttattatctatccattgatggacactgaggttgattacatggctttgctattgtgaatagtgctgcaataaagatgtgagtccaggtatccttttgacatgctgatttcttttcctttggataaacaccaaatagtgtgattgctgcatcgtatagtagttatatttttagtttcttgagaaatcgccacaatattttccacagcatctgttctaacttacctttccaccaagtgtacaaaacattccttttcttcacattctcaccagcatctgttattttctgtctttttgataacagccattttgactgacttaagaagaaatttcattgtggttttgatttccatttccctaatgatgagggatgttgagcattttttatatacctgttggccatttgtatactttgttttgaaaaatgtcttttcatgtcctttgctcactttttaatgggactatgttttttttgctgttgttcagttccttatatattctagatattagtcccttgtctgctgaatagtatacaaatattttatctcattcaacagattgtctcttcactctgttgattatttcctttgctgcacagaagacttttgtttaacattctcccatgtgtctaattttgttgttgatgatgcctgtgcttttgaggtcttagccataaaatcattgcctagaccaatgtcctggagtgttttccctatgttttcttctagtagttttattttggggtcttgcatttaagtctttcctccaacctgtgttgatttttgtatatagtgagagaatgggtccagtttcattcttctgtatatagatatccagtccttccagcaccatttattgaagagtttgttctttccctaattatgttcttggtaactttgtcaaaaatcacttggctgtaagtacatgtatttatttctggtttttctatgcagttccattagtctatgtgtctgcttttatgccaatatcattctgttttagcccatataaccttgtaatatattttgatgtcagatagtgtgatgtctccagctttgtgctttttgcccagaattgctttggctcttcaggctcccgtttggttctatataaaattttgcattattttttctatttctgtaataaatgatgatcatatattcataaagactgcatgaaatccatatcaaacaaaatattatatgatatttcatagtcgatttctttgggcagtatggtcacttaaacaatattaatttttcttatccatgagaatgtgatgttgttccatttgtctgtatactcttcaatttctttcaacagtgttttgtagttttccttctaggagtctttcaccgccctgattacatttattactagatattttattttttgttgctattagaaatggaattgccttcttcatttgtgttctcatcaagattattatgtgtatagaaatgctactcatactgtatgttgattttgtatcccgcagttttactgaattttaaaatcagatctaaggggtttttaagtggcatctttacatttttctagatacaaaataaatgtcaaaagaaccatttttctatttctgtaataaatcatgctcatatttttatagagattgcatgaaatccatatcaaacaaaatattatataatattttaatatatgataatatttcaaatagccaaatggactatttgacttctttttcaacttggctatcttttacttctttcttttgactgattgctctagatggaacttccagtactatgctaaataggagtggtgaaagtgggcatccttgtcttgttccagttcttggaggaaaagagttcagcttttcccaattcagtatgatgttaactgctgatttgacatacatggtgtttattatgttgagggatgttctttctatgcctagtttgttgagagtttttattatgaagggatgttgaattttaccaaatgcttcttctgcatattttgagatgattgtatgggttttgtcctttgttcttttgatgtgatgtatcaaatttattgatttgcatatgttgaatcattgttgcatctttggaataaattccactttatcatggtgtattatctttttgatgtgatgttggacttgatttgctagtatcttgttgagaatttttgcatctatttttgttagggatactggcctgtagatttctgggttttgttgttgttgttgcacctttggttttaggatcagggtaatgctggcctcatagaattagggagaattccctcctcctcaattttttggaatagtttgagaataattggtattagttctttgaaaatttggtagaatttggcagtgaagccaaatggacctgaaattttctctattgggagagtttttattactgattcaacctcaatattcattattggtctgtacatattttctattttctcctttcaatcttggtagtttgtatttgtccaggaatgtatccattacctctaggttttcattttgttactgtatagttttttcataatagtcttggaagatcttttgtatttttgtagtgtcagttgtactgtttcctttttcctttctgattttacttatttgggtcttctctctttttgcctgattagtctagcaagcatttttgtttatctttaaaaaaaaaacccacttttcattttgttgatcttttgtatcttgtttttagtttctatttcattttgtcctgctctgatgtttattatttctttccttctactaattttgaatttagtttgttcttgcttttctagttcactgaggtacataattaaattgtttatttaaaaatttctactttctaaatgtaggcattcatttttgtaagcttcttttttgcaatgcttttgccgtatcctgaaagttttgatacgttgtgtttgattcttatttgtttcaaaaaattctttgaattcctcatgagtttcttgtatgcaggatgtaattaggtcatttttaaaatctattcagccagtctctatcttctaagtggaaactttaatccatttacattgaaggttattattgatatgtgaaggcttattcctgtcattttatttattgatttctggttgtgttgaatatcctttgttcctttctttctttctttttgtttttcactgtggtagggtggagcttaattgggcagacctgtcctcagggaccctggtggtgcatgtcaagcaaggctggctgtggtagtcaatgggccaggtgataaccaggtctctggtggtatgtcagatggggggccacagtggctgtactgtgaccatgttactggaggaggtgaagtagctttcagtggaagcctccataggcaggaagctagggacacaaactttgctaatgctttagccccagaggctacaacccagcacagcagcagctatgagcagtgaaatttacccttgaggtacacaaaaaaatgccccattatccctttgctgtgggagcagtgctgatgctagtggctcgctctttggtcctggctctgactccaccagcagtaacaaccagcagtggtggaggctgtgggtgcaatagacttttatcatggccactcttctggaagatgtcactgccagcaactcctgactcagctttggcagcagctgccgcatcgaagactgttgtgagtggggaaaggtaatggggctgcaggaatgtgaggatgtagggactttgggacctccaaggcaggatgcagtctagacctccaaggcttggctttcaaaatggcaccttgttgtagctgcttaggactctgggggtgtgttggatccagaataagctcactctctaaagcagtaccttctcacagtctccgggcagtttccagtgatggtcttaggtcctgtaagggtcaaaggaccctcccatggctaggattgaaggagtccctaatgggaatgtgtactactggggatctctcacttattctttttccaaactggatagtctctccaggctcccaggtgaccctagctgagcaggctgcctcacttccctccccttccttgatttaggtgtttcttgtcacttctctgttgaattccagtattccatcttagaagatctattcaaagtgtggttatctacctgctattttgtttcttctttgtggaagaggcaagtacctgatgtgtccagtcagctatctggaagtcagatagtttaagtcttcctattatttttctttttcaaaattgttctggtaatctattatattttaaaatatacatttcagagttagtcagtttccacaaaaaaagaccttatacagattcaatgaaattacattgaatctataaatcaatctgagaaaagtagatatcttaacaatattgagatcataaatctataagcatgatgtgtttattgatttatttagatattctttaatttatctcatctgtattttgtagttttcctcaaacagatcttgtgtttactttcttatatttatctttaagagtttcatgtattttgaggctattacatttggtattttaaattttgcattttctagttgtatattgatagcatatagaaacagttggtaaacaaacttagttcttacagatatctgtggattctttcaggttaactgtgtacatgctcatgtagtctataaataaatattgtttactactttcttatatatatattatttcctttcatgtcatattgcattggccatgaccacaaatacaaagttgaataaagaagtaacaaccatatatttttcctgattttgagagaaatgtatttagtctttattaagtgtgatttaactctaggttttctgttttgttttgttttcttttctttttttgagacagagtctccctctgttgctcaggctggagtgcagtggtataatctcaggtccctacagccttggcctaccaagttcaagtgatcctcctgcctcagccccacgagtagctgggactacaagcatgcaccaccactctggctagtatttttgtactttttgtagagatgagttttgccatgtttcccaggctgatctctaactcctggtctcaattgatccacccacctcagccacccaaagtgctaggattacagatgtgagtcactgtgcctggtcaatgatttaattctaggtttttggtaaatttatttaattaatttgaatagacctacatcactccactaaaatccaacatctccatcatttactaaatttctataagtatatgaacttatttctgtgtcattacaaacttttattaattattactttctatttgtgtactattaacatgttttcattactctgcccttacttcatttatttatttattatttatttatttatttttacacagagtcttgctctgttgcccatgctggagtgcaatggtgcagtctcagctcaccgtaagttccgcccgctgggttcctgtcattctcctgcctcagcctcccaagtagctgggactacaggcacatgctaccacacctggctaatttttcatatttttagtagagatggggtttcactgtgttagccaggatggtcttgatctcctgacctcgtgatctccccacctcggcctcctaaagtgctgggattgcaggcgtgagccaccgcgcccggcctactttacattttaatgactgttttgaatagatattaattatatcccctaccactcccctcaatattctgactattcttattacaagctttgtaattagcttctctggttcttcagagagtgtatagttaattttattgacatgttgggattttgaaaatttatatattaatctacagactattccttattataataatgagtttaaaagtatttgttttatttgttctagtcattttttgtgtcttttaagaatatttcaaagagtttttcataggaagcttgtcaatttgctgttagacttattcttaatgtcttttatctttttaaataactttctctattaataggagtccttctgtgacaccttcctgaagtttctgcttcttaattgccctgcctttactcaattgttgatgttcatcatcaaaccattcagcatgtaagcactgagaggaactccactgaatttcttgaggttcaaaacatagttcagatggcattttcaatgtccaaattcaatgaaaccattgatatgttccttactgtaagcattctcctttgaaaatcaagattcttaaagaagcaatgagcagagttatcaggacaaaagagaaaaatgattcagataattaagtaaccctaaaggagattatttctacttccacccctatattcctgtatatgtgaattgtggccagggtagtggctttatattggtcaatatctcaaagtttatataattcttgcagggcaccacccaactgcacaggatgttgtcctagcccacactgtaactctggtttcagtaagatagtctgaattttgataagacagatacttctagatgtgagacctgtaataacaccaatgatttacataacaggaggatatgggatactgacagcttctaatgcattctgtaagtccagtagagtagtgatggcagcattgcaggatggaaagacctgtaaaatacctgcagagaacaggtgtatattcaacccatgagggaaaatccctcacctcaaaggagaaagaagtacaaagtaaccaatcttccacagggtagctggttgcctttcccctctctttgaacaaagacatattgtgggctcagttttggaatctggtattggcaagttgagctcttggtaatggaagtagccagaggatatttggtaatggaagtagccagaggaaaacaatgtttgaaggggtcaatttctgtgatagagagcagggcaggacaagcataaaaagcagatataaaagcaaccaggcaaatcactggcataggagctttcttgtgataactttcatatgtacttccactttctcccctccaatcttaccgtgttattttagtacttctagtatctccccttacacatttaaatacacatatcctgttctgatttcatcaagtttatattaatatgatgtaatccataattttaaagggtaaagcaatctgcatactaacatcatctctaaataggaaatctagagtttttttggccagttctcttcacaaagggtgatggtgttattgtttttactttttaaaatattttttttttcattttctgttctgaaaccataattgcttggcccttcagttgaataggttgaatgttcatctataccatgccctttttccactgtttctccattaatctctcacttgtctttaattggcacaggagttttcccctgaaaatcctttgaactcttattctaaggatgagatttttttttttttgctaatccatagaaaaatggtcactatttctatttgatttatgaaaactgtttttttaatgaatgttcttaatttgttgtttctattatcccttttctccttcgtaggttcctttttttgtaattcatcttgttaataaagttcttcctcacctagttaatttcagaaaattaatgtcaagtaggataaggcattaattcaggctagcaaggattctttctggttaacataaattccttatgagatggtttatgaaatgactatatttaattcaaattttagattcctttttcagaataaaacaggctactcgctgttcacaaggttatttctgaggtgcaaaattatcttcttctctctgtctatgtttttatacatcctgaattcccccatgcaaccttggctgacacactcagacagaaaaaacgtgcaagggcacttttttcttgcatctgtagtggaaacctaaatgggtttagttttttgttgttgctgttgttttgctttgttttttcaatgtttatttcttcttcagtgtcaaaattcagcaaatatattctggctccttcagaatcttctcttcctcatcaaaatggtgtcactgtgtgtttccttttcagtctcagaaacttgattttcaatgggccaaagatggttctagccaagagcccatgcaaccatttctacttcataaaacaaaaatcagttttgggtttggacctatatggtaccactctatcaactttgggcagctccatgctgctacctttttctaagatttatagtaattatgttttctgtggacaccttctctttccctttttgatattcaccgcattaagaggccctttctcctagctacaataaagtacaaaagaacaagtatcaattttactttgaaattctaatacagtaacaatacaataattaatatgcaataaaatccaattccatttagcttacaaaactttcgtagattaatgtttctgtaaactataccaactttttttttttttactatttcatctggcatgagaaaatcatcatatagttttaatccaacattctctattaacatgagtttctatgatacaaaaagacagagaaaagaaagaaaaattacgttgatcctaccattgtttcttcactagtataattacatttattcatttattatttttccatttattttaaaatgattaaaaacctagtaaactatgtaactacatgaggcttatggctcaataacctgatcatttcccagagtggggaaaaaacatgaaaataaatgcagtttaatatgtgttaaataggtatctatataaagatgcaatgggcataccaagaaggggagaattgaataagagcttttattcctttctcaactagtagataaattatttttaaaatagcactaaaaatcacaattaaaatgtatttgctgacagtctaaagctcattgtcaaagaagaaaaaatggtagagactaagctaatgctactgtaagaagatttaaactctctctgtcactgtgtaagaatctgatgaatggaagattgcaggtaacatggtataaactagggtatcagagattcagaaaaaaatgaggctgtttagatgctcctgaagaatgctgagtgggagtgcaagagatttaaaaattcagtaattttttgtaaatgccatcacatgttgttctttccagcgtaaggaatggtcccaaatgccttgacatttaaccatgtgcacatataattattttcaagcctcatccttttaaatctcatttgagatagaaaatttttccttctttctcctttttcatgcattttcctgcttatcttgatggttttccttcccaccacatacagcagcaatttttgtaaatgattctacattttaaagtcactaacatcacatgtgtaattcaaaggaatgaaaatcctcaaaattcataggaatgaaagtcctcaaagttggcccattcaatcaaattttcattccttgaaataaataagaaaaactagtatttggagtaaatcacgtgatatatgtaaatatatttgaagaatttctcgggtgaattgatagacaaacacaagttttgcgagcataactctaaatacatgagttcttcatctgggaatttccttgaatttggaaactagattatataattagttgcacacctacatccccaaaatgctttgcatacaggaacaataattttgttgactaaattttacaattacagaaataaattagtctgattctatataactgactattttaaatgcacttcaaggtatagacataagagtacagggttttattataattttcaagtaagaaattatttttaagctggtctgacttcataagagtttttttgagaaatatcactttgtcaaacataggtagtctaccaacttcagacttccatacgtcttttccttcactgacaagtttttcaaaggggtagtttataacattcatccacttctcaacttattatagtttgtctttgcctcccacattattcagaagctggtcttaatgactttaaaattgacaagcaaaagacacattgaatcatgatttgagttctgtatatgataggatactgttttcctcatcccactcattacagcttccctactttgacttcagggactctctcctttcctgatttaattccattctttctttacttccatccctggggttagtattttaacagcagtgtttctgagggtgccatcatcaccttcttttactttacccactctcactaagagatgccatccaaccctattattccaaacactacatatgggagattgcattgttttagtcagaatcctcctttttctccatatttattccatagctgcttctgggaaaagtacatttttcagtccctttgacggtaagtttggccatatcatttgttttggttaatggaatatgagcataaagacaatttgctaagtgcacaccgaagcttcaagagacatcctgtacttttgctcacccgtcttgcatcttagccatccaccatgagaacatctcttgggaagcatctagtcacaggataagatggcacatgaaatgtcactgagatcaactatagcctgatgagaagctcaacctagtccagtagagccacatcaaatccacagacctgggagcaagaaatcagtgtctgttgctgcaaaccactgagttttgggatagtttttatgtagcagtttttgaggaaaatacttgatactataccattgttaatgtatttccaaacatccttcagaattttaaacaaaaatatctaactgtcatttgaatttccccaactagatgattcataggtacctcaaattcagtgtgtacaaaaattaacttactttctctccaagtaaggtaatttttccatgttatttcctatttcagtgaagaagaattgcatctgtctattttccaagcagaaaaaaatcaaggtgctatctttttttctttctgcctcttccttggactaattgctgattgattaatcattaattcctttgacagtaacataattttatgaactaatgaatatattttcatggcattttatatatccctataagctgccttactttttcataaaacagggcagaatataaacaaataatcaaaaagaattctgttgattttttctcttcagtagctctaaattatttacccacttctccaaccacactgctactacacttgtttaggcatttatcttttcttgcaaagaatgacacatgccttctaacttcctgcaggttgcttactctccagtatattctccactcttcttccagtgtcctttttaacataaacatttgatctacttgttctcactcataggtgggaattgaacaatgagatcacatggacacaggaaggggaatatcacactctggggactgtggtggggtggggggagggggagggatagcattgggagatatacctaatgctagatgaagagttagtgggtgcagcgcaccagcatggcacatgtatacatatgtaactaacctgcacaatgtgcacatgtaccctaaaacttaaagtataataaaaaaaaagagagaaaaaaagtcctcactgtttagctactttcagaataaatgcaaccaaagaagaaaatataaactcaacttgctattcaaatatattaacacattacagctctatgaaaacagaaaactctggtttttctcatgttttttaaaaagtagtttccttctcatgaaaatgtcttgtgccctctacctctaatccagctacatagtccagctgatccctgctcatctttctcaacccaattcaggtgttatctcatctgaggacccttttgaaattgttgtatgccacttcattcgcagttaatctaagttaactgccccttgggaatttgtgtataagtctatagtgacatatatcacagtttcttacaatattaacttatgcatctgccttctgctttagatgtttcatagaaaataaggaaagcatatttctttatgtagattctcctcggcttacaatgaggttacatcccaataaactcattataggttgaaaatactgtaagataataacacatttaatacacccaacctaccaaatatcacagcttagcttagcctaccttgaacatgctgagaacacttacattagcttacagttgggcaaaatcatctaacacaaagctattttatgatacagtgttgattatctcatgtaatttattgaatactgtcctgaaaatgaaaaacagaatggttatatgcgtacttggagtacagtttctactgaatgcataccagtgtcacatcattgtaaattcaaaacatttttaggtggaaatatggtaaagtgggaactgcgtgtatctagcttccagggcagtagtcttatttgtcattatatctcaagcgcctatgcatatatagtcaaaaatatttgaaacatgaaaaaataaatgaaattttggataaataggtaatgatcaggcttaatttagcactctaagttctcaaataaaacacaaattcatcataaactgaaactttttttcatttgaaatacataaattcaaaaatagccaccctaggaagtcttcttcaacctaccaagacaaaagttgggcattccacactggcttagaactttgtacaaactttaatcatcacaccatattgctattattttgttttcatgtctgacttttccagtacactgtgaaatccctgaaccctgagtgccagttttataaagctgtgacattctaaaattgaatgcagttaaatctcaaagccaaatgctattactgtatacaacaatgatcaatgcttgttgaatcagctaattcattctttgaatagtaatagagctttattatgtgtcgtacaaaaatccccagagctgagaataaggcagaggtacaacagaacaatcacctatacacatttactataaaaacttagagtatgaaattcaaaataagaaaggatggtttactgtactctatagttagaggatgtttgaaaattatctatagaattgcaactttaacaatggcttcaagaaaccgagaataaattgtcctaaaataaaccaacagcccttgatcttctattatcatttgaagttgtgtataattgcacttaagttttatattggtctcaattcaatatggtctataacattaggatatcagcaattttcattgtaaaagaccattactaatccaactgagtttgattattgtattttatcaggttagcaggtcttttcctgagctctgcagcattgctgtttttaatatgtgtctacattttgtgtattggtcttcaaacccctcctatgaaaactatttcccttcgtggaggacctgattttatgaattgtgctttcattttttcacgttgtatagcattgtaatagtaagtaaacttaatgactgcttaaaatgtataaagtactcctggattacattctcattatatactttatattataaattttaagtattttattattttttgaagggcactgaaaatcaataaacaatttacattagtgtcttaattatttatggatttctcattaaaatttcatttcatatgcataaatattattactaatatttaatatgaaaactcttatttggatatataggggtataaataaataacattgttctacaacctgataaaactttattatatctaacacatatataatatcatacatttcacttttttctataattaaaatggcgaaagtatcatgactgccactcagaatgaaaattatgactttgttgctaacagtttgatgcataaagaattctctgagcaccagttgtggcttttgatacaattaggctacctattatgtattcttgtttttacatttgtgaatccaaaaccacttgagggaaaattcacattctcggtctgttttagaaatgaaattattcttaccttgtgtctttcttgaaattatagtcaaaaatgcttaaggaattggaaaaaatgaactcttaggtcattttaaggactcaaaaacaatgtttctaaaagaatccttctccacaccatctttcatagcatcagagtgaggcacactgcaatgactgcatcgccttttatattattgtctcctaatccaagtggcatatatgtcatgtatactgcacaagctgaaatgttattatcatacttaaccacaagttcttcaattgcatatgtctggagtgcactaaactttaatgagcttcattctgcttggccctgaccatctcttcaattaatcatcactatgtaattggctcctactttctaaagtatttaccctacctactttgaaataatctgtgaatttaatgattatagcctttaatctaccattttttcactgaggaaagattgttacattccaaacttgattgttatatgtcactagggttgacactgatacattgttaaatatacttgtcttgaagaaaggcatcatactctgtaatatatcaagatagattagaaatatttttaaaggctgttatttttcaagagacatgaaagttattgaaaggaacttgttctttttaaagacactggttgatatgaaattccttatttcctaagtggtactgaatcctgtaccaaaacttcatgataggcagacttcaaatatcttcttgaaatacataaaaatatctttgcttaaaatattatttattgctcagctttccttttaaagtattctttattcttctgttgactgacttagaacattactaatcagaaaattgctaattaattggtctagcagtcatgagtcttaaaattggaggtggtaattacttcaaaaaattctattcaagttaaaattatgccaataataccaaaactctgggtaagcatggtaagtgcttccattccttctagccagtctggaatgaattagaaagttacagggatggacttttgtataaaattgccactaacattaaaaattcaaaaaaaaaaaaaaaaaaaccccacatgtctgtggcattctggtcccggcttccaaaataaaaaattactcctgaaactctgtaaggattttaaaacatattttggaccaactcattatcaaagagtactacagctagaaaccatcattatgtatcaattaatttaaatcagttaacgtataaaaacctcatgtcccaaatgatggaattccctgcttgaagttggggaagtatggttggtacagagcaggaaccagaatccaaatctaactcctagaatttgtcggcaaaaatggtggggctgaagaacaattggttgagacaaagcaaggatcagaacaaaatcttccaattctcattccagtcattccagtgttctttccagtcatatgatgagacatcatgtagggaaagggagagaatgaaatttagcatgagtgaaaaagatcctatgggaagattttggtaaggttcagttacaaagtcatactctgtaatgtcttccagcattggcaaaaggaaaggagaggagataaaatctctgatgaaaatctgattcctgccttttttgtgtgtttcattttctctttggatacttatgtgatttctcttaatcactgaaattttttaaatttgccaaaacatatccaaatgtgagtctttttgtcttttatattttctacttcaaagagtctgagagtttgaaatgtctggcttttttcaaatagaaaaattttgatacttttttttttttatcattgcttctcctcactctcctgttttgaatattgctgacacttccaaaacttctttctcattttcagaaaaatctatgatgtcatcaactgtgagattcaactcaatttaagagatattcaaatgtaaaacgaataaagcagtagtaattatcatatggtatcgattgttaggcacatgtcactttcagcattgttaatacgtaaaaatattgcttctggaaataagtcaattctgggtttacataaatcaattttatagtcttcttttataatcccaaaccctttataattctaaattccatgaacatatttcaaggtcatcttttaaaatttatttttaaattgacaaataaaaatcaaatatatttaaagtatacaacatcatgtcatgatatatgtatacactgtggaatggctaaatcaagctatttaacatattcattaactcacatatatatcatttttttggtcagggaaaccctctaaatctattctcttaggaatttttaacttattgtcattaactataggcactgtgaggtacaatagatctcttgattttattccttccatctaactgaaattttgtgttctttgactgacatctccctgatcctcccattccccagcatctggtaaccaccattttgctctttgtttctattaattagattgttttagattccacacataactaagacgaagctgtctttctgtgttggggttatttcacgtaatataatgttcttcagattcatcaatgttcttgtaactggcaggatttcctttcctgtttttaaaaggctgaatagtattctgttgtggatatacatcacatttcctttttccatttgtctgtcaatggacacccaggttaattccatagcatggctattgtgaaaaatgctgcaacaaacaagggagtgcagttacctctttaacatactcttgtcatatcctttagatatatactcagtagttggattactggaccatacagtcctttatttttaattttttgaggaacctccaaattgtttttcataagagctgtgctgatttacatttccaccaatagtataagagtttccttttcctcatatcctttccaacatttacattttctctttttggtaatagctatcctgactggtatgaggtaatatctcattgtgattttaatttgcatttctctgatgattaatgattataagcattttttcatatacctgttgtccatttgtatatcttctttagagaaatgtccactcaagtcctttgcccatttttaattgagttgttttcttacgattgagttgtttgagttccttgtatattttagacttaacccattattagatgtgtggtttgcaaatttattctcctgtacatagattgtctctttattctgttgtttcctttgctgtgcagaagctttttatattgatgtaatcccatttgtctatctttgcttttgttgcctgtgcttttgggtttaaatccaaaaaattattgcccaaaccaatgtcatggagcttttcctctatgttttcttacagtagtctcacaggttcaggtcttaatatctaagctttacattttgagtttatttttgtatatagttatgagatggaagtctaattttattcttttcacgtacagttttcccagcaccatttattgaagagactgtcctttccccattgtgtgtttgcagcatctttgtcagaaatcaactgactatgaatgaatgaattactttttgggccttctattctagtccattggcctctacttctgttttatgccaacaccatgctgttttgatttcaaagttatcttctaaataatcaaatttaatacaatagttaatctactatcactatagactagattttatatgatatgtatttttaaatttagtaatcattgttttcatttccccaaaatctggttttcttagtatttggaacattctgatcttattttacattatttaaatactactctcattatttaatagaatatttgtaagccttcttgtttaaagttatttgatttgagtcctctaatgaccacactattgagtttcagggtaaattcctatccattgtaactcatttaatagtggtaatctctgggtctgtcagtagttgttttcacatgtcaattttgtcagtctcaaaaaaatagagaataaaatatgaaagcaacacaaacagtaaaaacaaaatataaatataaaaagattcaaacttattttcttttgatgttttgagatttcaagatctagtgtgaatgccatagtagatagataggggtttaggcaaagaaatacaggtgcaatttcagagaaatttatttttgtgagtcaaaagccaatgttgcaatgtgtcttagttattttcagcaattttcacagtctcctggatacctctgtgcaaagtctatatgacctctatgggattctttactttgaaggttctagaacttagctaaaaccctgccattcatctccgcaaacccctgccactgctccaaagtccatccttttattcacagttcactctgaattaggagatgttatagggattctagagaaattgagatgggaaaaattgaggaatttgtttacccattctgctggggctccctttcatagtatgtattctctcatctgtaacatttattgacaataagcttggaagtgtcatgtaaatgaatggaatacctctctatttattggtgttatagaacggcttcacccttagtaaatgcattcatacttttagtgggaaataaagagacttttaaaatatttatggtttcaggatatcatctcattctgtgtattcaaattccaggctatattttctaaactgaaaatgtaccatacaatttttggtataaaattcttccatgccacccaacataaagagaaaactccttgataacatggtttctatcttttcaaagtcatctctcagaatacaacaaatgctcactaaactctatttttgtatttttttatttttattttaattttattttatattttcgagaccgagtctcactctgtcacccaggctggagtgcagtggcacaatcttggctcactgcaacttccatctcctgggctcaagcaattctcctgcctcagcctcccaagtagctgggactacagtcgtgcaccaccacacctggctaatttttgtatttttagtagagaggaggtttcacgatgttggccaggctggtctcgaactcctgacctcaagtgatccagcttcctcggcctcccaaagtgctgagattaaaggcatgagccactgctccaggcttaaactctacttttaacagttcatcatagttgaacctactgtgatgaactagatctactatgatctttcatactcctgtatttggcttattcagcctgaaatatatttctccattttttttgcctaagaagtatatttctgttcatctttctagactcagctcaaatataatttactctgtgacgtctcttctggcccttctaccagatttggactcccatacgcctttttttataaaactcctttaatagtcctctaatatttttgtatgtgtatttgttccatatgtttcaattttcaccctgcataaaacgtcatatggtggtcaaacaggggggtcagaaatcctaatatttcctctatcctaatgtttccagcctattttatgaactacatagaaccctagaagtattctatgagttctgcttatggcactcctcagagctctatttttatcattatacaattaactaatacaaatactggatgctaaaaacaaaaggtgcacattttaaataacaataaacaaataaataaaacattttgaatgcaggtcttatccaaaacagtgttttccaacttgagagttatcatcaaaatatttatttgacaacctcatttcacctcttctagagtcttcttctcatttctgtgtacatccttttcccaaattccaaatcaattacttggagctcttagttcattatttagttactttattactgttattcctaactctactatgtgcctcacaccttctaagtattttatatgcattaatctatttaattggatgaaaacaatatttaaatgttggtgctactattattcacactataaaaataaggaaacagaggacaaaaggggagatattttgtccttataagtctttccagattccctcaaatcatattattataatattactctagtatttgccattattaattacagtaaaatattgtcaatgttttattattatataattctagaatttgttctaatgttgccttatattacacagtgctttatcacttagcaaacacttttacacacttgcttatctaattctcacaatgacatggtaatacaaggaacatcatatccacgtgaaggatgaaggatgaataaactgaggcctggagaggttaagacagagcaaatttgcaaatttgtatcaaagccctttttttttttttttttttgaggtggagtctcgctctgtcactcaagctggagtgcagtggcctgatctcggctcactgcaatctctgcttcttgggttcaagtgattctcctcagcctccccagtagctgggactacaggtgcctgccaaaatacctggctaatttttgtatttttagtagagatggagtttcactatgttggccaggcttgtcccaaactcctgatctcaggtaatccacctgcctcggcctcccaaagtgctggaattacaggcgtgagccaccttgcctaacccaaagtctttattttaggccagaacaccatcttatgtttaaatttggcactacagtaagctagataatggctcccaattattactactctcttgtacctggaaaagtaaatgttaccttatttggaaaaggggactttgcagttatgattaaattaaagatcctgagataaggagattatccttgatttacctggtatgttctaacaactattgcatatatccttataagagggagacagagatttttatatacacaaatgaaaaggtgatgtgaagataaagaggcagacatttaaatattgtggctttgaggattggagttatacacacccacgagccaaaaactgctggcagccccagaagctgaaagaagcaaggaacaaattatcctatagagccttcagagggagtgtggtccaaccaacattttgatttcaaccaatgaaatagattcaaacatcagatctccagaagtataataaaataaatttatgttatttacagcctctaaatgtgtgataattttttacagtgccataagaaactaatacaggcatttactgaaattaatacagatctaaactgattagcctcatgatgctaatttaatcagcagagttttatcttagtttgggctaaagtcaaaaggttaaaataaatataacaaactaaaatttctatgaatttaaaataaatctcttattttttgatttcacaagaaacaacattaacaacaggcaacttgttgctattattctgacccaatttccggctgcaccaatattcacccagtcataatgtacatgagatgcatatataattggcacctctcttttacagtgtcttgctggccttttttttttttagctttctccttctctatatgatttctatgtcattccaccattcacctcgcttgtaatttagtcctcaagcttcctaagacaattacctatacttccaaacttgcatactatgtgattcccatcttttccatacttttatatcacatgatactttaaatacttccattcccattgccttatttcttgtttgctggaatttgtatggggtcttagattttacagtttactttctttgctgagttttacttatcaaggtttcatagctattgctatgaactctttcaaatagcttatcattataaaaaattcctacatcatatttccaacagagttgtacagcataatttttctaatacagtttacatttctgaaaatgtgagagagatgcagtgcttttatttgtaacaatcatcactctgctgatggaccacattctgtgagtttgtaccagcatacttttatctaaattgagctgacacagcttctgaagtaatttttgaaggaccttaatttctcacaactctctttttacatcctttgcattcaattacttcctaagttaaagcaaggaaacatcagagtggaatctgtattagtaggaccaaatcatactctttataatgcaatgtctgggcctggccattgggatctgttggcagtagtataacagtcaagctaatgatttagtgttccagttcacttcagtttaggggattgatagctaagcagcaggaaatcatatttcagagctctctgcatatctgcaaattcaggagtggttcctgtaaagcacctgcctacattttagtcatatattcgtttatttatatcctgactagttttaaaaagaatttaagacagcttgtagatataaaatacatcaatagaggatgaaacctaaaaaaaaaagaaaaaacagattgatcattaagtcaggcacattatgggtgcaccacaagtttggcactaagatgtctaagcaggtcaaatggaagataatcgtagctcagttcagtgagctcagctgtttttcatctgaaaactagaaagaaatctctcccaaaggtcttcaagaaaaaagattctgtataagaaatggacaagtgccttacatgagacaccaaaaacttctagagggccatttactgagtttgtaaatatgtccttgatatcaaaataaagtatcaaccgataaaatgctattccaagagaagttgaaaatttggttggtataattcagctataccaccaagaatattacagttcaaacaacatatctgactcttcaccaaccctttgcctatgtttttcctgctgtttttgttagttgcaggtaattttttattatataactacctatagatattatatatgaagggtgtgtgttgatatctacacacccttcaaagcctagtccaagtattccctttaggcatgttacattgtgtataagagcattgaatatgtagtcagaaagagcttggttgactctttcatgtgaaagctatgtaagcaagttactttaccaagccttggcttccataattgtaaaataagactaaaactctatatcataaaattgtcaatagctttaaatttgataatgcaacataataaatattcaataatgatactttaacttttgttagagccttttgttagagaaattctgccaccagctatgaagaagtaaactaccacgcttgttgtaagagagtcacttgactaggacttggggttgatctttaggaactgagggcaaccagtagccagcaagaaaactgaaacctcagtgctacaactacaaagaattctgccagcaaacaggaagattagaagaggacctcaagtctcagataagattttagtcatgcacaacaccttattttcagtctggtaaggagagaaccctcctaatcagtgcccaggtttctgacacatggaaactatgacataataaatttgttttaagctgctaaatttgtagtaatttattgttatacagcagtagaaaactaatacagacatattagttaacctttatgaccttaagttatctcattgtataatagagataatggcattcatcatacagaagtgttgtgagtgtcgattataattattaattcatacatatttgtaaatagtacatactataaaatctgagatggcattgtcacttttacaactctatgatgcttaggaatttcctttgtactctggtaatttcttcatggctcttatctcccctacaatatattgtgagctagtgaaagggagagcttctaccttgggtctctttggagccgaataaagaattcttataaaattagtgataatgatagaaatcagaatatcggttacctctataggtgaaggaagatacagactgggaaggggtaccaaaaaaacttataaagtttggaaacattctgagtaatataaaaattttcaagctgtgtacttagtatattttatagattttctgtatttaacttatactttaatttttgtaaatgctgttcaggtaacagattgatggtaatcacagtattattttaatggaaaatacaatttctattatgcttgatttgcaataaactcaagcacatttgacagaaaatgaaatgggtatgtaccaagttttccagagtgaaagtgacagtagcagttgcagtatactttcaaaaatagcaagataactcattttaaaatgacatgataacatgagactcctgggagagggtttcaggacttaagcttttcaggtgacacttttcaggtaaatggcttcagaatagacctttctaaaacaaagaaaaatttttttaaaaagtaaaaccaaaattataaaagcaattcatttggtcctatttcatgacctacatattcctatatttaaagcattcaaattttaccagcatttaaaaaaaatgaaaccacatatttaaatggtcttcatgaattgtttaattctgataagaaaaatgaaagacatgatattcttggaacatcagagcaaatggtaaaaatagcaaacgggcatgtgcttacaagactctctcttgaaaccacattgaactctcattggcagtgtcagcaggttaattaagaaatctcttaggcatggcacatgttcaatacagattgacattacctgggacatggcaaatgcttgttcatcaatactcacccaactgattgacctgagttaaaattagaaaagtgccacttacttcaaggattaaatgcctgcaaaatcatcgcatggaagaatgagagacaaccatttgaggaatacaggaagataaatagcattcagtgtcagactgttgaaatggtctgttcacttcagtaagtctaaaggatgttttagaaagcagcagagtagacattttcatgacttcagtctcaggaaataaggaaagcccttcttttatctctaactttcagacttattctcagagcttcaagggatttaagacatcaccaaatccaaactcctctatttgtagggggaaaaaaaaaacagcacagagatattaaactgcaggaagaagagaggattaataagagacttgtattatagtgtattatattaaaatgaaaataatggttgtattaaggaaaatataccagcatgttaattaattttcagaattataaaataatactgttttatggaaaatcttattaaaatttttgaaaaactattttcagttcccctttgaggtaataaaatatgtctggtcactgataaatctctgattgaataaaatacagaagacaaagagtaaatgcattgtcactgtataatttgtgaccaaaagagagacagcagcaaaaaacgtaagtagagtctgagcaggtttatccatacatttaactgctcttgtcctattctctggctccctgaaaacagacattacttcttgtgccaataagaaagtcactgtacataaatgaagttagtgatagcagcagactgagaatctgcaattaagaagtcacctttggaaaggcctggagagaaatttaagtgttcatgctgcaaagtactagatcatgaaaggaaaaaaatcagatataatataaaaggcattaaactgatcctaagtgattggtcactcgttactgctgcatatatctattgtttcttcctctaggttggacatagtcaatgtcaacatcttgattgttcacaaatctacgaggcctgcataaatccacctgttggcatggttaccagaaggtgatttaatctgcgtgccactgattttaataagcaagttaactaaatagattggctgaaaattggaacaatttagccacttactacttagattgctctctctactgcttggataggccaaggagtgtcaagttttcccagagggtagttggcacagaagcagatgtcaccataagtgactttcctgacaccatggcacaagctagtagaaaagctaggatccaagcaaggtcttgggatcccttacccagggctctttctaccctgtcagttatttactcactctgtcaaattcactgccacagtgtataatttcagaatatacgtatctaacagtataaatatatgccagaggcagatcaagtataaccatttgttttttccagagcccagctcccgctctatttcataacagctcggtctaagcaacattgtcttttattttccatcacaccaccaattcccagttagagactaatttacatgaggatgcaattcccttattttcaatattaccccaaatctcagaatcctgaagaaaagtctctagttgctaccatccagtctgatacaagcatctgcattcgatgtcccaaaccttattgcccttgacttgtctgcaatttgcctgccctgtgtcatgttaccacccgagacatgctccttgataaacagtagctaataaataatctcaagcaattgtgttctcatgattttgccttactgagagccagaaaaaccaaggcagtctagctcaagctttttattatataaataaggaaattttagcccaagaattttactcttcatctaacatcctgaaaacagtagaattaagaactacaacttaagattctggacacctaacagaatgggtattttttctacctcaaatcatgtcaattaagctgtcattatgaagaactggcctaaaacacacaaatcattctgacatgatgtcagctaatatgattctttgaatcttcaagtggaaataaaattaatccacaggagtatagcacattaatgtgtaaattatgcactgttgtgaagtgtgtaatgtaataaagaactaaaacaatgttttactttctaagcactgcacatatttcaaaaaaagaatatttgatttcacacaaaattgaaaaccatttcaatttgccacaaaattgaactataatgtcgagagtgtacttgggaaaactagaatgttcacataataagttaaatctgggttatttctttgcaaaccctttttcagaaaaattattttctagctaaagaggaaataattgttttgacaagttccaccagattcattgacagataaaatttctttggtctttgttttggtctttgataaacatttaataattattgggaaagtgtttaatttcttcattaaaagtggttatctaagaaattagtagacagtgaaataacaagataaaactgtgttataaaaatagtgaagaaaatttctggatgaatgtaaaagttattgacttaatacaacattatggcaaactcatcatcttttttttcttaatctgataagctactgctattcttatttgtcacttgtaatgttattaactttgtcccagtcattcactaaaaaatttagtcttattcaagttttctgtttgctgaccatctcctatccaaagagcaaccagttcctattgcgtctacattttcaatgttttataaatgcacattgtactttcccttccctttatcacagtctcagtgcaagtataacttgtatttgcttccctctagactaagtcagtaggaatcatccggtacctggctggaagagtgatgttctgtgaacgaagtctagtctttgtcattgttctttccttaaaaaatatttatcactcccccgtgatactagggtatggctcaagttccttactattgcatttaagagtttctatgatctgagctaaagctttctttctgtccttgatggtatctcattgaggtctccatgctctaaagtaatgatatctaatgatggaaatgtttgtatctactctagccaatatggcggctactagctccgtatgtctcctgagcactcagtagacatactgagcatatgtggctgatgtaactgaggaactgaaatctggatttaatataaattgtatagaaatatgtagctagtggctactatattggatagttcagctctgaagtagtggttctcaaacgttagagtgcattagaatgacataaagggcttgtgaaaacacggattgctagactccattccagattctttgagcttaacagataaaacccatgaatttgaatttctaaaaaagttctcaaattgcgctgctggttggtctggaatgcaaattgaagaatcactttcctagacaagtttaaatccttgttgtctcttgaacaaatccaatacatggatttatatctgcataggtttctgtctgtaaagctacattattccttgctttaaatttacttacatgcctgcttcataaaataataaattacttgaaaacaaagattatgtccttgtcatatttgcaagacctaaaatgtcttatacagtcatattaacataaacatagaaaggggattttttgattgaaatataaaccagttggttttcaaaatactaaacagtaaaactgatttttttcattctaaatttaaattgtaattaagtaaagaaatcagttataaaaccatataaaacactctaaagttaactttaaaatttggattacataaatttgaggagacatttatttccattaagacacctatataataatacttcaattgcataagtaattatacttctgaagtaaaaatgtcaaatatcacagagatattagaaaaaggagttaatttcaaaaagtatgaaaagctgttaaaaaataaggcaaatctacctctctcaatggatatttcaaacatatgagaaatactttttagcaattttcaactttgtctacataactcagttctttaaaaaagtaaaactagctcacattttctgttgaaatgagactcaataccaaagagagcgaggtatcattaaaatgaagctcaaggtgatacaaacatcaggagaagaaatgtttccaagatctcgcagcagtgtgcctagttaagaccagacaattagttccttgctgtgataagccaccttcaaacctgcaattcgaaagaagccacctatagagaagtaacttctacttctttttaaattatagtaagtcaccaaattatttttcttcaagccatcaaagaagtttgctcagaacatttttcaaacaaattcactctacagtattagaaactcaaaaatgagtgactgtttcattaaccgaatcacagttttcccattttcacactaatagaggccattacatagacactaaggaatgtggttaatgaataaacactcaaaatcatagcacagggaagagccttgatggcatcatctggcctaaactgaacattatctgttgctaggtaaccaaagataataaaaaggtgtctgaagcaggccagcaaatgaaaaccagcctcagccaatctttaatgtcagtcctgctgccaccagtaccattaagtttgtaggaggtccaaaatcaaaatgcagcagcaaacttgaagaggcgaagtttctcttaccccatgatctaatgtccacctttctataccaataaaaggtgaggctgacaataaattctctaagaaaaaaaaaatccatgctccttgaactctgagaaagtaatttctaatattttatgacagccattctaatgttcattcagcaaatatctaaaagctttaaataaattcggtaagtgttctaggcagatggcttgttttgattgatagtatttttgttttgttttgctttctgttgtttttgttactttgatttttgttaatgtaatttattttcccttttttcacaccataatcccagcactttgggaggccaatacaggatgattgtttggacccaggagttcaggaccagcctgggtgaccagcccatctctacaaataataataataaattagctgggtatggtgctgtgcaggtatggtaccagctactcaggagtctgaggtgaaaggatggcttgaccccaggaggtggaggctgcagtgagccatgatcatgccactgcactccagcctgggtgacagagcgagaccctgtcttaaaataaaataaaataaaataaaatctctttaggaataaaatatctacctgagcaaatcaacaacctaaacgggttgctaattttaatgttgaagtttctgggatcttaaatatgtgtgacatggaagccttatgagccatttcttccacttgttcactcctttaatcaattggtacttcattagaggctatataggaattcaaatggtagaaaatgttaagtaccttgctttactatctcagagctatttccagtcctccatggctccctgggtaaaaaccaggagttctgttaattctagtttttacttcctttctacttatattctactgcctgtagcgtccatagcataagcctcttgcagaattgctaatagaaagacccacacatacttccgattgccagttcaatttgctcaggcagagtcttctcatcaccaagaaacatcaggttttatagtgggcagcattggtgggaggcaattcagtatttcaggaatagggatgtataacatttttcatgctcatcaaagaagtaataagttaaaaattcagaaacagttctatcaatattaaacatttgtgtgtctaccttagctggtttggcaattacttttctttctgtttgcaatctccttccctatcttctcatgattaatgtctgtatgtcttttaagaccaaacttaggtaacgttttctgcaaaagcctacctatgaacattagactggatttatgtgaccagtctctcacttagattgtaaagtccttcaatagagattgctcattattcctcttgggatcataggtatctaggaatattctcatcacataagagatgttcaaataatgtcagatgaactgcaatgaactggactttcaatctaagtaggtgatcctacctcttatcttactgagaagcatgaaaaagaaaaatgtcccccctgcttcaatgatacatatctgttgcatcacactcttttgcaaagccttgttctatagcctatacttattctatccttttcttctctccgagagaaacaagtctgtcctcttttccaaaaataatacctatgctccttgggaactcgttctataaatgaattgcatagcttttttctaaaaaagcctcactcttctcctgacccatttcattggcctacaaacacattcagtttacttagcctaaaatcttcttgagagaccttattatgcccttaaattataattctcttttttcatttcactcacacatttttccaaataaatctcctgatcagtaaacaatcaaaattatttgtcagtaaatgaggatagaaagacgggacatacagagaagctgatttgtaactataaaagaataggtgtgctggtagaaggcaataaaatattctatttatataaagactagcatggcactaaagctccactttctcatcaaaccatcactcattgaatatttgatttgttgcaactcagtaggcactaactctatatgagaatttaccaaaaatacccaaattctgactttttgtgggaatcttaatttcatgttagaaatcttaattttgaagacatatggtatatgtaaacttcctctgaaaatacttttctgctatgttaaaaagttttgataattttaatttgttgttgttattgtttggtttggtttgatttgctttagtttggtttgttgtgtggagttcactttatgttaaaataggcatgatttaattgaagggttagtgaagatggatggtgaatggtagggatggagaaggggaagaagattcaaactttctctatacaaacaatattgagacatatctgtcactaggaaatgcttattgctacaggagcagttaccaaacaaataaattcttgtgtcatcaagcaattaaattcaagttgaaagaaattacatttatatttgacattttaactctctctttgtgaactgagagattacttaaattacctcctaagacctcactgtgttagattattcaatccaaacttatgtatggcaacctgtgtcctcacctttggttaacatcttaccacacggactaatagtcttggtcatgtgacttgctttggctaatagaatataacaaacaaatataatgcagagatattttaaaatgctctaccttggttgttgtgttcttgctgttcttggaatgaatttccatgtgaacaagacttggctagcctaaaggagtgagcagttgagttaaagctttagatcaatcagctcccacatgattataaatatatgaaggcacccaggcaaaaccagaactcttcagctaagtgcagcccaaatcactagccaataactgagtactttcgtctgaaatttttatcttataataattgtcactttggggtaatcacagcattctgtctgagacaaattaattgtgctaatgcactggtagtaaacacaatgtttagtagtaatatattagctgtgcatacttaaagcaatgaaggattaaatttcataaagtgcaagtacttataatatattgatttatcctggaagttcttcaataacattgaatttataaataagacaaattctagaatacaaatatgatcctctatagtaaccattctttatttttaagtgtggatatcatatattccattacctctaccctgttgcataaatatttaatatataaaaatacagcattatttaatttgccatatttttctcattgtcagcttttaaatgcatactgtttaaatgcctaatattcttgactatttgaggctgcatgcaatatttgtagtaagtaaatgcaaactaatggttgacaaaaatcacaatttcttaatccagataatctttggatatgcataaaacaatgaaaacctagaattatttatgggctataaagtactgtaagctacaacatactgtaaagattcttacagtactttataaatcccatctgccttaaagaacatctatttaatattcaggtttcttcatctggtagtttactgtatatattacatatttattcatttataaaatataatatttatctaaaatagagttcatgtctaaagattttagtttacacaatgactacaaagctgcatgaactaggacatgtatttgccctaaatttaaagttctacatactgtcaagctctacctggctaagtcattattgttcttctgccaaaaacaaaggtgagatatgccaacataaatgcgaagatactgcaacatattcagttagtatcatctcttgaacagcaaataatttttgcaaaaaaaaaaaaaaacccagaaacttttacgaagctggcataagggttgttaaaatactatttatatatacagaaggcagatttcatcagatcttcaagttattaaaacatcttcatgcagaataatttgatcttgtttgtttttattatgtttgtgttaatgtgttttatgttttctctgctcttcagacggttgtgtgagatgaagttgtgacaactggataggcatggagctgagtgccaaaagacaaaataaaacaaatagagccaagacaagaagcgcagatgaattccaggagttggaatatggccaagaatcaaaatgtatgttagtattagggtttatataatcagcaattagggtttatataatcagcaatgtatgttagtattagggtttatataatcagcaatatcatgggaaacaatgagccacagtcaaataacatcctagaatcaattacaaagaaaaaaaagaactttgagggtttttgaaatttttgctgagtgactaataggttctgaatagtatgttcatacttagcctagattatgtcatttaatccttaccacactcttgtgaggtaggtattgttgttttcactttatcaatgaggaaagaggcacagataaattatgtgacttgcctaaagatcactaactttaaatggttgaaacatgataaaatcccggtcatgtaagagttgaaagcctgtcctttaaatttggtgttgtggtgagacaagaggagcctaattgctgagctaaacttttgcctctgccccagaattattttattagcattcccgatatgttaatgtgtttttgcatttttataaaggaatacctgagactgggtaatttgtaaagaaagatattttattggctcatgattccgcaggtacaagcatggcattggcatttgctcagcttctggtgaggcctcagggagcttatactcatggcaaaaagtgaagcaggagcaggcatatcatatggcaaaacaaaaagcaagagagcaagaaagagaggagggaggttctaaactctttaacaataagaacttgctgcaactcccatggggaaggcaccaaaccattcatgagaaatccgtccccatgacccaaacatctcccgttaggcccacctcaaatattgagtgtcacatttcacaatgagatttgaaggggacaaacatccaaaccatatcacccagtctcactagcactttattaatgactcagtctttaaaatggccactgccactatccctggcactggtttgtaaattaaaaatagagtggtggcttctctgtctaatgtaactctctagtaagcttgaattattttaatctatctatctatctatctatctatctatctatctatctatctatctatctatcatctatctatccatccatctatctatctatccatctatcatccatctatctgccaacacaaaaagaacaaatcatgaaataaatgtttatttatttgcaatgctttggctaacaccacccctcagagtgtagtgaccagcagtccaggaataccttggtcgtcccagcgcagtggactccaaaccttggggagccagagaacaaagttggggctggatacaagtttcccattgctaaagctttcagtccaggagttgggaactgagcactggccccctaaaatccagaaatgaagccagtctactgaatctaccttagaccacaatcaaaccctcaaggtcatcaaataggataaaagaaaaaaaatccaaagtatagaaacctcaaagattgaagaaacatcagcccacatagctgggaaagaaccagcacaagaactctgaaaactcaaaagccagagtgtcttcttttctccaaacaaccacaccacctctccagcaagggttcaaaaatgggctgagatagctaaagtgccagaaacagaatttagaatatgaatagaaataaagaccactgagttgaaggagtacattgaaactcaatgcaagaaagctaagaatcacaataaaacaatacaggagcttatagacaaaatagccagtatagaaaaaaaattgtaacttacctgatataggtgaaaaaacacactacaagaatttcataaggaaatcacaagtagtaatagcagaatagacgaagcagaggaaagaatctcaaagctggaacactgggtttcagaaataagacagacaagaataacaaaaaaagaatgaaaaggaatgaacaaaacctcgaagaaataggagattatataaagtgaccaaatctatgactcattggtgtccttgaaaaacacaaagagggtataagcaacttggaaaacatatttcacaatattatccatgagaccttccccagcctagctagagaggccaacattcaaattcagaaaatgcggagaaccccagtaagttacttcacaaaaagaacatccacaagagaaataattttcagattctccaaggtctaaacgaaagaaaaatgttaaatgaagctggaagaagaatcaagtcacctacaaaggaaaacccatcagactaacagccaacttctcggcagaaatcctacaagctagaagagattcagagccaatattcaacattcttaaagaaaagaaattccaacccagaatttcatatctggccaaactaaacttcaaaaatgaaggagaaataagactcttttaagccaagcaaatgctgagggaatttgttaccaccagacctgccttacaagcacttataaagaaagcaccaatatggaaagaaaagaccattaacagcactacaaaaacactcttgttgttgttgatgttgttgttgtttttgttttattacactttaggttctaggatacatgtgcagaacatgcagttttgttacataggtatacacgtgccatggtggtttgctgcacccatcaactcgtcatctacattaggtatttctcctaatgctatccctttcctaaacccctagcctccgacagatcctggtgtgtgatgttcccctccctgtgtccatgtgtactcattgttcaactgccgtttatgagtgagaacaagcggtgtttggatttctgttcctgtgttagtttgctgagaattatggtttccagcttcactgatgtacctgcaaagcatatgaactcattttttcttatggctgcatagtattccatgttgtatatgtgccacattttctttaaccagtctatcactgatgggcatttgagttggttccaagtctttgctattgtgctgcaataaacatacatgtacatgagtctttatagtagcatgatttataatcctttaggtatatacccagtaatgggattgctgggtcaaatgataattctagttccagatccttgaggaattgccacactgtcttccacaatggttgaactaatttacattcccaccaacagtgtaaaagtgttcctaattctccacatcctctccagtatctgttgtttcctgactttttaataatctccattctaactggcttgagatggtgtcttactgtagttttcatttgtgtttctctaatgacccgtgactatgagcttttttacatatgtttgttggtcgcatcgatgtcttctttggaaaagtatctgttcatatccttcacccactttttgatggggacgtttattttttttcttgtaaatgtgtttaagttccttgtagattctggatattagccctttgtcagatggatagattgcaaaaattttctcccattctgtaggttgcctattcactctgatgacagtttatattgctgtgcagaagttccttagtttaaatagatcccatttatcaattttggcttttgttgccattgcttttggtgttttagtcatgaagtctttgccatgcctctgtcctgaatggtattgcccaggttttcttttagggtttttatggttttaggtcttacatttaagtctttgatccatcttgagtttatttttgtataagatgtaaggaaggggtccagtttcagttttctgtatgtggctagccagttttctcaacaccatttattaaatagggaatcctttccccattgcttgtttttgtcaggtttgtcaaaaatcagatggttgtagatgtgtggtgttatttctgaggcctctgttctgttccattggtctatatgtctgttttggtaccagtacaatgctgttttggttactgcagccttgtagtatagtttgaagtcaggtagcatgatgcctccagctttattccttttgcttaggattgtcttggctgtacaggctcttttttggttccatatgaaatttaaagtagctttttccaattccatgaagaaagtcaatggtagcttgatggggatagcattgaatctataaattattttgggcaatatggccattttcacaatactctttcttcctatccatgagcatggaatatttttctatttttttgtgtcctctattatttccttgagcagtggtttgtaattctccttgaagaggtccttcacatcccttgtaagttggattcctaggtattttattctctttgtagtaattgtgaatgggagttcacccatgatttggctctctgtttgttgattattggtgtataggaatgcttgtgattttttgcacattgattttgtatcctgagactttgctgaagttgcttatcagcttaatgagattttgggctgagacgatggggttttctaaatatacaatcatggcatctgcaaacagacacaatttgacttcctctttgaataccctttatttctttctcttgcctgattgccctggccagaacttgcaatactatgttgaataggagtggtgagagagggcaaccttgtcttgggctggttttcaaagggaatgcttccagcttttgcccattcagtatgatattggctgtgggtttgtcataaatagctcttattattttcagatatgttccatcaatgcctagtttattgagtttttagcaggaagggttgttgaattttgttgaaggccttttctgcatctattgagataatcatgtgttttttgtcattggttctgtttatgtgatggattacgtttattgatgtgcatgtgttgaaacaggcttgcatcccaggggtgaaggtgacttgatagtggtggataagctttttgatgtgctgctgaattcagttttccagtattttattgaggattttgcactgatgttcatcagggatattggcctgaaattttcttttttgttgtgtctctgccaggttttggtatcaggatgatgctggcctcataaaatgagttagggaggagaccctctttttctactgtttggaatacttttagaaggaatggtaccagctcctctttgtacctctggtagaattcagctgtgactctgcctggtcctggactttttttggttggtaggttattcattactgcctcaattttagaacttgttattggtcattcagggatttgacttcttcttgatttagtcttgggagggtgtatgtgtccaggaatttatcagtttcttctaggttttctagtttatttgcatagaggtgtttatagtattttctgatagttgttcgtatttctgtgggataaggggtgatatcccctttatcattttttattgtgtctatttgattcttctctctcttctttattagtctggctagtggcctattttgttaatattttcaaaaaaccagctcctggattcattgaattttttgaagggtttctcgtgtctctatctctttcagttctcctctgatgttagttatttcttgtcttttgctagcttttgaatttgtttgttcttgcttctttagttcttttaattgtgatgttagggtctcaattttagatctttcccactttctcctgtgggtatttagtgctataaatatccctctaaacactgcttaagctgtgtcccatagattctggtatgttgtatctttgttctcatcggtttcaaagaacttatttatttgtgccttaatttcattatttacccagtagtcattcaggagcaggttgttcagtttccatgtagttgtgcagttttgagtgaaattcttaatcctgaattctaatttgattgcactgtggtacaacagactgttttttatgattcccattcttttgcatttgctgaggagtgttttacttccaattatgtagtcaactttataataagtgtgatatgatgctgagaagaatgtatattctgttgatttggggtggggagttctgtagatgtctattaggtctacttgatccagagctgagttcaagtcctgaatacccttgttaattttctttcttgttgatttgtctaatattgacagtggggtgttacaatctcccacttttattgtgtgggagtccaagtctgtttgtaggtccctaagaacttgctttatgaatctgggtgctcctgtattgggtgcatatatatttaggatagttagctcttcttgctgcactgatccctttactattatgtaatgcccttctttgtctcttttgatctttgttggtttaaactctgttttattagagactaggattgcaacccctgctttttttgctttccttttgcttggtaaatattcctccatccctttattttgagcctatgtgtgtctttgtacatgagatgggtctcctgaatatagcccactgatgggtcttgactctttatccaatttgccagtctgtatcttttaattgggaatatttagcccatttacatttaaggttaatattgttatgtatgaatttgatcctgtcattacgatgctagctggttattttgcccaatagttgatgcagtttcttcagagttttgaaggtctttacaatttggtatgtttttgcagtggctggtaccagttttttctttccatatttagtgcttccttcaggacctcttgtaggacaggcctggtggtgacaaaatctctcagcatttgcttgtctgtaaaggattttatttctccctcatttatgaagcttagtctggctggatatgaaattctgggttgaaaattctttcccttaagaatgttgaggctgggcatagtggctcatgcctgtaatcctaccactttgggagttcgaggcaggcagatcacaaggtcaggagattgagaccatcccagctaacacggtgaaaacccatctctactgaaaatacaaaaattagttgggcatggtggcatgtgcctgtagtcccagctactcaagaggtggaggcagaagaatcacttgaaccagggaggtagaggttgcagcaagtcaagatcacgccactgcactccagcctgggcgacagaatgagattccatctcaataattaaaaaaagaaaaggttgaataatcgcccccactctcttctggcttgtagagttccttcagagagatccactgttagtctgacggacttccctttgtgggtaacctgacctttctttctggctgcccttaacattttttccttcattttatccttggtgaatctgaagattatatgtcttggggttgctcttcttgaggagtatctttgtgatgttctctgtatttcccaaatttgaatgttggcctgtcttgctaggttggggaagttctcctggataatatcctgaaaacacttcaaacttggttccattctccccatcatttccaggtaaaccaatcaaaggtaggtttggtcatttcacatagtcccatatttcttggaggctttgttcatttcttttcactcttttttctccaatcttgacttcacactttatttcattaagtttgtcttcaatctctgatatcctttctttagcttgattgattcagcaggggctcatagataaaactcccatctccctgggacagagcacctgggggaaggggtggctgtgggcacagctgcagcagacttaaacatttctgactcctggctctgaaaaaagcagggaatctcccagcacaacactcgagctctggtaagggacagactgcctcctcaagtgggtccctgacccctgtgcctcctgactgggagacacctcctagcaggggtcgacagataccacatacaggagagctctggctggcatctggtgagtgcccctatgggatgaagcttccagagaaaggaacaggcagcaatctttgctgttctacagcctccactggtgatacccaggcaaacaggatctggatggacctccagcaaactccagcagacctgcagcagagaggcctgttagaaggaaaactaacaaacagacaggaatagcatcaacatcaacagaaaggatgtccacacagaaaccccatccagaggtcaccaacatcaaagaccaaaggtagataaatccacaaagatgaggaaaacccagcacaatgcagctgaaaactccaaaaccagaatgcttctccttcaaaggatcacagctcctcaccagcaaggaaacaaaactggatggagaattaatttgacaaattgacagaagtaggcttcagaaggtgggtaataacgaactcctccaagctaaaggggcatgttctaacacaatgcaatgaggctaagaaccttgagaaaaggttagaggaattgctaactagaataaccagttcagagaagaacataaatacctgatggagctgaaaaacacagcacgagaacttcgtgaagcatacacaagtatcaaaaacactcttaagtacagaccatgatactatgaagcaaccacattaccaattttgcataataaccagctaacatcatgatgacagcatcaaatacatacatataaacactaaccttgaatgtaaatgggctaaatgccccaagtaaaaggaacagaatggcaagctggataaagaaccaaacccatgggtatgctatcttcaagagacctgtctctcatgcaatgacacccacaggttcaaaataaagggatggagaaaaatctaccacgcaaacaaacaaacaaaaaataaccaaaaacaaacaaaaaacagaaaaatgctgggattgccatcctaagttcagataaaacagattttaaacaaagattttaaaaagacaaagaagaacattatataatggtaaagagtgcaattgcacaaaaagacctaatcattctaaatacatatgcacccaatgtaggagcacccagattcataaagcaggttcctagagatcttcaaagagacttagactcacacacaataatggtgggagacagcaacacctcactgacagtattagatagaccattgaggcacaaaattaacaaagatatttaggacctgaattcaacactagatcaaatggacctgatagacctctaaagaactctccactcaaaaacaacagaatatacatccttctcatcaccacatggcacttagtctaaaattgatcatataatcggaagtaaaacacttctcagcaaatgcaaaagaactgaaatgaaaacaactgctctctcagaccacagtacaatcaaattagaaatcaagactaaaaaattcacttcaaaccatacaattatatggaaatgggataacatgctcctgaataacatttgggaaaataatgaaattaaggcagaaatcaagaagttctttgaaaccatagagaataaaggcataatgtatcagaatatctgggacacagctaaggcaatgttaagagggaaatttatagcactaaatgcccacatcaaaaagttagaaagatctcaatttaacaacctaacatcacaactaaaagaactagagaaacaagagcaaaacaacctgaagatgataaataaccaaataaccaaaatcggagctgagctgaaggagactgagacatgaaaaaccaatgaaaagatcaacaagctcaggaacttcttttgaaaaaaattaataaaatagactgctagctagattactaaagaagaaaaaagagaagatccaaataaacacaattagaaatgacaaaggggatacaccactgaccccacagaaatacaaataaccagccaagaacattatgaacatctctaagcacataaactagaaaatctagaagaaatgtataaattcctggacacatacaccctcacaaggctgagccaagaagaaattcaatgcctgaacagaccaataatgagctttgaagttgaatcaataataaatagcctaccaacaagaaaagcccaggaccagagagatttacagccaaattctaccagatgtacaaagaagagctagtcccattcctattacaactattcagaaaaattgaggaggaagggttctgccctaatgtattccatgaggccaacattatcctgataccaaaacctggcagagacacaacaatacaagaaaacttcaggccaatatccctgatgaacagtgatggaaaaatcctcagcaaaatactgacaaactgaatccagtagcacatcaaaaacttatacaccatgattagctaggcttcatctctgggaggcaaggttagttcagtgtatgcaaatcaacaaatgtgattcactgcatgtaaagaactaaagacaaaaaccacattatgatctcaatagattcagaaaatgctgttgataaaattcaaaccccttcgtgctaaaaactgtcaataacctacgtaatgaaggaatatacctcaaaataacaagagccatgtatgacaaacccacagacaacatcatatttaatgggcaaaagctggaagcactcccttaaaaattggcacaaagacaagaatgccctttttcaacattcttattcaacatagtattggaagtcctggacagagcaatcaggtaagagaatgaagaaaacgcattcaaataggaagagagaaagtcaaactatccctgtttgcagatgacatcatcctgtatctagaaaatctcacagtcttaacaaaaaagctccttaggctgatgaataacttccacaaagtctcaggatggagaatcaatatacaaaaatcactagcattcctatacaccaaaaagagacaaggtgagagccaaatcagaaaggcaatcccattcataattgccacacaaagaaaaacatacctaggatacagctaaccagggaggtgaaagatctctacaaggagaacaacagagcactgctcaaaaagaatcagagatgatacaaacaaatgaaaaaacatgccatgcttatgaataggaaaaatcaatgtcattaaaatggccctactgcccaaagcaatttatagattcagtgatatttctattaaactactaatgacattcttcatagaactagaaaaaaaactattttaaaattcatgtggaaccaaaaagagcctgaatagccaaagcaatcctaagcaaaaagaacaaagcaggaggtatcatactactaaaccttaaactatactatgggactacagaaaccaaaagagcagggtacttgtacaaaaacaacacacagaccaatggaacagaataaagcagaaacaagaccacacacctacaaccatctgatcctcaacaaacctgacaaaaataagcaatgggggaacaattccctattcaataaatggtgctgggataattggctagccataggcagaagattaaaactggacctcttccttacaccatatataaaaattaactcaagatggatgaaagacttaaatgtgaaacccaaatctataaaaagcctggaagacaacctagtcagtaccatctggacataggaacaggcaaatatttcatgacaaagatgcctaaagcaattgcaacaaatgcaaaaaattcaacaaattgggtctagttaaacaaaagagcttctttatggcaaaagaaattatcaacaaagtggacaacctacagaatggaaaacaatttgcaaactattcatctaacaaaggtctaatatttagcattataaggaatttaaattcacaagaaaaaaaccattcaaaattaaacaaaggacatgaacagacttttttcagtagaagacatacatgtggccaacaagcatatcaaaaaacctcaatagcactgatcattagaaaaatgcaaatcaaaaccacaatgagataccatctcacaccagtcagaatgactgctacaaaaatatcaaaaaaataacagatgttggcaaggttgcaaagaaaagacaatgcttatacactgttggggggggggtggtgtaaatttgttcatccattgtagaaaacagtgtagtgattcctcaaagacctaaaaacagaaataccattcagcccagcaacctcattactgggatatacccacagaaatataaattgttctatcataaagctacacgcacatgtaggttcactgtaacactattcacaatagaaaagacatggagtcaacctaaatgcccatcagtggtagacgggacaaagaaaatgtagtacatatataccatggaatactacgcagctgtaaaaaaaatgagatcatctcctttgctggaacatggttggagctggaggcaattatcctaaactaatatacaaacagaaaaccaaatactgcaggttctcaattataagtggtagctaaatgatgagaacacatggacacataaaggggaacaacacatactgggggctattagagggtgaaggatgggaggagggagaggatcaggaaaaacaactgatgggtactaggcttaatacctgggtgacaaaatactctgttaaacaaacccccatgacataagtttaccaatataactacctgcatatgtacccttgaacttaaagttaaaaaaaagatatgacacaatctattccttgtaagaagttaatgatatatacaaatggcttaagaatatgtagttctctaagaggaatcaaatattctaaaatctatatcccagtatatatgaaccaaatattttttcatattagtaatagcaggaccatttaataaccaggtttacacatgttagaagcagagctaagccatgactgaggaaacatggtgaaatacaattttggggcttagcataaagcctcaatacagcaatggttcaataaacattcactattttagtgttttatttggccgctaattagtaaagatcccaaggaaagaagtatttcccaatggagggtgtattagtctgttctcatgctgctaataaaaacatatccaaggctgggtaatttataaagaaaagaagtttaatggattcacagttccacatggctgaggaagcctcacaatcatggcagaatgcaaaggagaagcaaaggcatgtcttacatggcagcagtcaagagggcttcagcaggggagctcccatttataaaaccatcagatctcataagacttattcactaccatgagagcagtatgagggaaactgcccccatgattcaattatctccacctggccccactcatgacacatggggattattacaattcaaggtgagatttgggtggggacacagccaaaccatatcagaggggaactttacacctcttatgtgaaagaaaaatattaggcatcccttttttgttttcagaagagatcaagagaagagcaatctaactaagccatggcaagtatttactataaaagagtgatgaatataatgtgatgcagaaaataaagataaagtgtttctatgagaatccaaaaagaagcagttatttcaggatggaaatattaatttattttatcttagttatatcttagttcagtgttcatttctgagtatattttaagatcagccctagaagactgatccatttaattaggaaggtccttaagttacatggactgcagtactgttggtttcagatcctactgaatggaagcaacaccccaagactcctgacattagttccaaagaaggctatcacctacaaagtactatatgatttagtgccctatgggttatcttggtctgcttgaatacttggaaccttacattccagttattcctttgcaggatactcctacacagaacccagatgctgtactgtgagaagcccaagccatatagaaaggctgtgtgtaggcaatccagtaggtagtcttagcttaacccatcctttgagtcatcacagggcagctgccagacatgagtgaagaagactacagattacgatagcccggaactattttaatcttcccagcagaagccccaaatattactctatattcacagtgtcctgtctaaattcccagccatcaaattcataagcataataaattgctgtggctttatgccacaaagtgtgggtggtttgcaacacagcaatagacagatagccagaataccaaggatgtcaaagtggcttgtaaagggacatcctattactatatgaaaactaaaatactgcaaaagccctaggcaggcatacactttcattgtggcattattgataacaaggaatagatacatttgtaagattaaatgaggcagaaatgatgtatacattaataaaacagaaaactatgcagccattaaaatagcataaaatgaagacagcaatcaggaacatgtgtatgttcttaggttaagctaaaatagaaacaccaaataatgtacaattaggtgtgcatttgttaaaacatatataatatttatgaagagtactaaaagtctgtgcaaaagaaaacttctgctaacattaagtattaaaaatttgaatgatgttgtaccagatttttaaaatattttatagagttatgttttctataaaagtgtatataatatacaggtagttccacatttcataaagagtttggtaattaattcttccaaactgggtggggccacagcagaaaaaaaatgaagaaatgtttgctcttttggattctgaagggcagtattgcgtctaccagatatgaaagagagagagggttatttcagcatagttctgcaacatacacacagattccttcagtggttggatttgggtcactgacagaatcttgagtcaaggtcagaaactgactgtcatatcatgcaaacacagaacatctatgtattcttccattttaaatccctccagtgtctcgcattttctatgataataggcacatcctctattgaaggaagtctacattctgtggaaaaatttatgagttctgtgatttaatgagtttgtcttttctagtaatgtttacaaagctgaagttcctgctttgtttcctgctgggagaaaacagcttttcatttttaccattgtctgcaagttctgcttgtatctgtcagtttaaaaatatttaataatctttttcagaatttatattgaactaaatttaaatatcagagtttatgaggctgagaccatatagtccatttctcagaggctagaagctgctgacactaacagagttttgcaagtaaataccagcagtctgattcaacttcaaatttgccaggaaaacatttcagttagagtcttctgttagctctttgaatatcatcgtctggcaagacctggagataaacccttgagacacaaacatgggataggatagtccctgaagtaggtccagattatgtctgatcctaatctgtgccaaaaccaaacaactgctcctgccttcttaactccttaaggtctgacctaatggtgccagatggaaaagaatgccagttttgagagagggtagcaggttcaaacagggacattgtacacatgtataacagagcagccatgagaaactgcacatgactggttgttcctttcccatggtgccctgagagtttatgagctaaaacaggcacttagaattgaattattaggtaataaactctatctaagatttcatagtgtcatgtgccatacttaactttataaaaattagggattttattttcattacaacctctttgttcatattcaagagttaatttcttcattttgttatagtaccaaagccttgaaggtcatcaaaaagaagttaagatcaaaagtgaaaacaaattaaggaacagaaatattaaaaataattgttataaaccaaaaacgatattattttacgccaattgcattgccaatcaaataacatctctagggtgacatcatattctcttcattttgtctattaaatttcatatataaagtccactttcataaaaactctagaagaaaacctagacatcaccattcaggacataggcatgggcaaggacttcatgtctaaaacaccaaaagcaatggcaacaaaagccaaaattgacaaatgggatctaactaaactaaagagcttctgcacagcaaaagaaactaccatcgagtgaacaggcaacctacaaaatgggagaaaatttttgcaacctacttatctgacaaagggctaatatccagaatctacaatgaactcaaacaaatttacaagaaaaaaacaaacaaccccatcaaaaagtgggcaaagaatatgaacagacacttttcaaaagaagacattcatgcagccaacagacacatgaaaatatcctcatcatcactggtcatcagagaaatgcaaatcaaaaccacagtaggataccatctcacaccagttggaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttggcccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggggcacagatgaaattggaaatcatcattctcaggaaactatcacaaggacaaaaaaccaaacaccacatgttctcactcgtagatgggaattgaacaatgagaacacatggacacaggaaggggaacatcacactctggggactgtcgtggggtggggggaggggggagatatagcattaggagatatacctaatgctaaatgacaagttaatgggtgcagtaccccagcatggcacatgtatacatatgtaacaaacctgcacattgtgcacatgtaccctaaaacttaaagtataataataataaaaaataaataaataaatagaaacaagttgaaaatgaaaaaaaagtccacttaatttgcagcatcttatccaaaatatttaatgtataaacacaagtatgaaaatctcatatatgtgtgttaagtgtaagtagttgtgactaagctttacaattaaactttacacacttgaataatattcacctttttctttcaattccagaatttctttatgaaattcaaagagtcttaaaggaaaaaaggagaaatacatgactttttttcttatttcccccttaaagcatttacaagcaatgctgtttccttatcattatctataatcagtaaattttaaaaattaaactgtttctatgataacttcaataacctaattagttataaaaccaacagtaatgtaaaggatttgttatataaaaggctcataattctatgggtgcaaattatattgaaaaaacgtaatcatttggcaccttttcctcatcactttttggcagttgggagggaaaatcttgtaccatactgttagcctgctctgactgatctgagcagtaatgacctattaccgtgctaatctttccctttatttctcaatctgatagtttaggaacacaactcgaactgagtcctgctctagctatgtcaaagaaataaaaacaccagattcaagttaaattagcttgtaattgcttctggtttggaaatgacaatagcctgtggcctttgattagctttagataatttataaaactcttttatatgaattactctattttctccttatatcctttgagtgataggttttccataatagccaaaagctcaggagagttaacttctcagaatcaaataatttaaaagcagttgagccgatggaatagattttatagaatgcaattgccctttgtatgttaaacaccatggttattatggtgacctctgcctctaacgctgaaacaatgaatcctaaaaacaaggttttccagttccatggatgacataattctcatcttgccctaaaagctgacacttaagttaaaaaacagtaacaatgtatttaaaagggattaaaattagtgactgtcaagaaatctaacaacattataatacaaatttcaccaaagttaaaaaaaatctaaaactcagactaagagttaatataactttattttctttattttcatggacagaggaaaatccataagaagttatgataaaatgctgactttggcttacttgtaaaaatcaataaaaacatttaattgtcaagagtaggggatattttgatgatataagcttccttacttccacagatttaaatgtgcaagacttttaggacaaaatgacatttcattatgacatagttcccttacactccaacagtatgctgaatgccatgctatataaacattgaatgctaatgaaggttacaaacaacgcctttaaaggaaaatctcatttccagaaaagggagatatttcttatttaaataaaggctttctatatgaggcttgttagccctgatttaaatagtaattagctgtttgcaattagtccactgatgagtttatcaacctgagtattttccttattttcatttagtaataatgtcataatagcacatgcatgcaaaaggagtaaaagaagatattgcttacattattaaacaattcagatgaagagtagtggtttagtcttgatgagttgagaactgctctgggtcagaaaaaagatacaggtgcaagttatattgaaaaaacgtaatcatttggcaccttttcctcaatcattttttggcagttgggagggaaaatcatgtaccatactgtttgcctgctctgactgatctgagcagtgatgacctattacagtgctaatctttctctttatttctcaatctgataccaccaatagttgaccattaaagttgttcctttgtttcatgaactaccagatgttttacaagttttcctgtatttgagatatggcatgttccagacatgtggtatgaaaaactggaagtactggagcaagaatcaataacagagtcagactcaaattttctatcagtggccttggcttgagaaaacatccacagggagtttctgtgataatagcaagagcaaaagagctccttgaagctgcataaagttaggtttctctcttaccccagctggtttctatggccagaggcagagataactatttgatatttagattcaaaccttttctgatacccccatttctgtgataggccagaaggaagttaaacaactgcattaattatttaaagacgggccccagatattctcacttgtatcaatgccactgcttccaaagagctctgcagccattattgagaaacttagctgggctatttttttttcttaataacacatctggaagatgttgaaggcatagttaaatagcttagataaatctcaagttcgttcctgatattaattgctcaatgagcagcagattctgaataggtatgcacatcctatataacataatcaagtgctgtgtggagtacaaaactttttctcttatcacaatgactgcttatttcctcaactgggagctacatgagtttaaaacccttaaaggttttgtagtgtgctcatcactacctaataattagtgttttattaggtctgtgcaggttgcaatttgcaaaaacccactaaattagcttgtagaaaaagaaagaaaatatttttagaatgcaaaattgtcttataaatccaaagaatccagaagccgaagaatccagatttagtcagacctcgaaaagaaactgtaaccaggaacacaaatcccaacagcaccttcctgtctctcatgtctgcctttccttaagactgcgtcaaaattctagctcatagaataccacttttccttactacacgtccatgtgatagacagaacaaagctgactatatctttggggtttatagctcctctgttgaaaagaccagctatacttcattatgattccatgtgcctgcaaggaaattctgactgcccatacttagtttagttactcaaccctaagtaaaccaagaatggagtgaggttatttaattgtaactatttgtggggtatggttcctaacatggtagtagagcaactgggaaaataataataataatgataatatcaaaggttacttgacaaatgctcttagcctttaaaagaaaaaatatagaccatgatttctaattacaaattaatcagttgggtcatatagtaccactgaagaagtggttgaagctctgtgttacgtgacttttaataccttctttagaaatggttgagttaccttatttttaaaaattacacagttaataaaatcaaaatgataaggagactgtgcttcactgttcatttattcaaacattgatatttcctggaggtcacaaaataactaagtattattacaaagaataagaggaaaacctgaatttagctagagctggacactgtagttaccaggaaaggcctttttgagaaaataacattcaagctaagatctgagaattaattgaatgaagagtagaggcaagagaaacacaaacaaagggaatattaaatgtaaaattcaacaaactagaacaaacaatagtaaaagctgttaacattaaatctaagttaaaacagtcaaccagagagcacactgaagtacataactgaggaggaaatatgatatattaccctgtgccaaatggttgtttaatttttaattacattaaattaccacaaatatttaattagacacaggtggtaacatagcatcccttttttgttctcacttctgaaatagtatactgtgagttttttgtctgcaatctatatggatatatacatattcatggagcgctagtgagtgtagatggaacagcctgaaagaaagctttccaagaataaaaacattccgatattgataaacaactgccagattcacagtttccagtcctgtgcacagaccagctgtgctgttagttataacttctggcatgagtataaatcttagcttcatttcatccccagagattcactacttgtccaggcaagttcaacaatacatgttttgaattacaggaagatggcaatggtggcagagtttttgaatctccctaaatcccctccaaaagagagaaagggactagaattttaaaaccaaagcccacagacaatattaacaagagaaaagggtgaaagtgtagccataaccccacaaccccaaatatgagcaggtgtagacaaaccgtgattattaaaggacctgggtgatatctgtagcaatgcgggaaaaaccagaggccaaagaccccaactaacaggtagtgctcagtaaagaatacagtgagtcaggctgagaacctcagtggatattccagctcaagagtaattgtaaagtgaagacgcttaagatttactctattagcaaatttcaagtatatatacaggattgttaactatagtcagctcgtggtaatcacttcactgtgtgtatgtatatcaaatggtcatgctgtataaatatatacaacttttatttgtcaattatacttcaataaaactggagtaaaacttaaatgttttcagaaataaaagaacaattacaaggggtccctttgaatatctaaaggggctggagccatcacaatgccttgagtattcaaaactgaccacctgaaaattccctttggattgtaccctcacattaaagagagtcaccttgaaacagaattcaaattaagcatgactttaaaagtgtgcatgaagagaagagaaagttcagaaaaagtagcgaagggacatagagtctggagatcttacaaagaggttgtatttctaaatatatattttctgaacaggtggctccaacacctagcataattcccagcagatattgaaattgctataaaaacaaaaatcctttataagaatgacaattatgatgcctttttttcatactgaatgcattttaggtcagtcccttaatttctgcccataaaagaaattatctattcaaatagctgaacatttttaaacttataaaatatctcttttataagatagaattttgatgctaaaataattgagtatagcatagaaaacatcacatcacagctttcttatttcctttgtattcagaactgaacctgtgtttgtgggaagttttaactaattaattagctgaacataataaaaatattactctaaaactgataaagaacacagtctaccaaaaaatatgcattaaataccccatgtctgtgcatgcaacctaaaggatattccaaacaaagtattctaaaatgatatttcatacaaaattcatactggaaatggctcatttaactcattctaaaaacagcctaatttggactaatttggagaggcccagtatcctctagatcttcaggcaggtttcaacaatccctcatacatggtttaaattaataagtgcaaagttgcagacacccttctgacatacaattattttatcctacacttagtatttaaagaagtagtggctgaacggggagcagaaaatttaatttcttgagttgctgtggctttattggactaaaggtagcagtgattgtactaaatagattttttaaaaagctcttttctgagtaccattctcatagtggccatgctattacattcatacaattttagtgcaatgcttggattgtaatagcctttggacacctgtgcattgtagtgcaagatgtaacacattattatttgtgacaccccctcaaatgccaatttactaaactacagattgctttctaggcccaataaatctttacaaacctatctaaagtggatgtactatactcttttctcccttcctccattcgttttgtgcagtaaattatatgaagtggttattatatcatggtttttattaatctgaaattattgttcatatttaatgacatttgaggaaaaagtaaggatatattcattaatccagttgtcatagtaattatattctcagaaatgtattattattgtaatcattatcacttcttatttgggcagcagttcacacatttcacatataacagtgtggttttgtatttgtttaatcctctcaaaatctctgtgagatacagagagcaaacggtatctatatttcataaaagaacagtgactaaaaattttcatgatttacccacagtcacgctgacagtaaatagcagaatctgaatttgaatttattcttgctgattgcaagatcggtgcttttttcactgttcctaactgcctcaaaaaaaaaaagagccatatagattattagataagttcttcagtgtgcatatttcaatttagctgtggtttactttgcctctgtggaaagcataaaatggaagaatggttaagaggttatttgcaataatccaggagagaaacaatggtgagttgaatgagagtaatagagttggaggccatgtctacaaatgttttcaaaataaaactaacaagatttgctgatatgggaataaaaaacagaatgatatcatgattttttatctaagcaattagaagaatgcgattactgtttgtttagatgggggacagtgggagatatgtgttttagatatcaagtttcaggagcttaggttttgagcttgttaaatttgagagatctgttagacatccgagtgggtacactgagtagatggagaagtgggtaagtttgaagtttgaattatatgttgggctggagatatgcctagcgattcataaatgtatagatattgtttatatttatacataagtgtacagatattgtttttaaaaaactggatgaagactgtgaagacaacatggtttcttaaaatccaaatgaagagtatatttcaaaaacgtaaaagtttttaaattttttttaattttaaaatgaaagcattaatttttttaagttgtagcaatcatcggtgttaaagaatgcttatacacggagtaaaattaaggccaagaattgattattgtctcttgcagtagagttctttatgtgtttaacaagagctattgttgtgtgtctctgtgtgtgtgtgtgtgtgtgtgtgtgtgagagagacagagtttcgctctttcgcctaggctggagtgcaaaggtgcgatctcagctcactgcaacatccactttccagtttcaagcgattttcctgcctcagcctcccaagtagctgggccttccaccacacctggctatttttttattattattatttttagtagagatggggtttcaccatgatagccaggctggtcttgaactcctgacctcgtgatcctcctgcctcggcctcccaaataacaatagctattttgattgagtggtaggtgccaaaaactggagtgatttccagagagaaaaagaaatggaatcagtgattacagaattttttaaaagaattatttaaagtatttctttaaaattttctgtaattcttttttgttttgctgtaaagaggaaggagaaacagggtagaaactggaggagaataagggtcaagaaagtttttatttgcttcttttttaaggcaaaatgacagcacgattgtatactgatggataatccagtggagcaggaaaaactgatgctacaagggagaaaaaagaattgttaaagcaaagtctttgaagaggcaaaaagggatgggattcactgtaaagtagaggttcgtatgatataaaaacatgaactgtttctcaacagtaatggaagaggagacaaagaatctggtctgatataggcaggctgacatgcttagtggtaagatcatatggaaatttccttttaatgacttcaattttataaatgaactagaaagcaaaaatgttatctaagagagggcatgccagaactatactatttcatttacaatagtttcacagtgtgttcctccaatatttttatattttccacagtgcttttgttctatttgctagccacagttcttagccattttttttttttttttttttttttttttttgagacggagtctcgttctgtcgccaggcaggagtgcaatggtgtgatctcggatcactgcaacctccgcctcccaggttcaagctattctcctgcctcagcctcctgagcagctgggaccttaggcacctgccactgcacccagctaatttttgtattcttagtagagacggggtttcactatgttggccaggatggtctcaatctcttgaccccatgatctgccctccctggcctcccaaagtgctgggattacaggtgtgagccatagtgcccagcccatatattattcttttaaatggcctacagtatcagcctttcagattcaaacaaaggaaaaatagaattttgactgaaattaaatgtatgaatttgaacataatcagcagcttaacaatatcatgtctttctagaaaactgacctgtctctccacttattccaggcttcttttatgtcctctaataaaggtttatatttttctattttcagttttgttcgcatgttgtcaaattcaattctcaatattttatatttttgcttttattttggaatgtgagctatccttctcttatctcatcctatagcatttaagactagactggatattacttatacaaaggaaggtaattcaatttctgccaactggtattcttgtgactttatccccacaaatttctctctctgcagctgaaaaacacaaactcaataacctctgtaattaaaaaaaattaaatataaaaatatttacattattcctattgtactgactagacaattgagtctcaaagacgataatttatccaacataattgtgtgaataatgacaaaaaaacacccagttttgggaaaattacaaatgcaatttctagcagacactgcttggttatctagtgttttgaaataaacaactccaaaacttcgtggcttgaaataagcattatttatcttattacagttgtttgggttgataatttagacagagcttagctgggatggcttgtctttgctccatgttatgctgacttgactcactcatctagttgcagttaactggcagggcagctggagcctggctggtcccagatggccacacactttgtggctggtagttgcctggcactcataaggtgccttcattttcctccacctagcctatccagcagactatcttgggcatcctgggcttcaagaagaaaaccgcgatgtaccagcacaagcctctgcttgtgttcatatgtgcagatgacccattagacaaatcaagtcacatgaccaaacccatagtgattatagaaagaacctataatgagaaacctgattcatttggagttactaatataatttgttctagcccttagcagaatatttctacattttctagaaccacagtataaaatttcaactggtcagagtttaggaagcatgcatagtaagcctagtgaggtaatttgtggggattcttactttcagttttgaggtataattagtacacaaaaaacttaaaaagcaagaaaaaagaatgcaacttttataggtgattaaatatgtttattacctgggttatatttagttgttttagtttaaaatctttactctcatatccctaattttcctcctatcaatctgctacagatgtctgacatttcagcattagatagcaaatcatttgtgttaagaatttattccttataaaacaacatacatatttaggaaatagactcaacataaatttatcagaaaatttcccatgggactgctagccctcagtacctacatttggaataaataaggatttgtgctctatttaagggaaagaatgggagatcataattttcggggtaagattgctgctctgagataattcttgactgaatatcacctttagaagtccctgaaaagtcaccaggatacaagggaagggagcaaactttgaagacttactttatgtttcagtgagtctcagagtttaagtttcaaagtagacaatccttcagcaactttacctttgattcatgtaattcctatgaacttgtctcctatgcatttgctatcaaaaatagcttaataaaatttttctcgccaaaagtgtttctccttgccgcatttggattttcaattcatggcagtttttaatggtgagaaatacattctaaagaacggacatttctaacactggtatttagattttgtgtactcacagaaaatttctgttttcatttcctcatttctacaaaaagaaaataagattatttctatccaatttcaggtaaaaggtataatgatgaagcttatattattctaaaactgcctcaagcttcttgaaatagtgacattgcataaccatactattctacctttagtcctacatggtaatatgaaataatgacccaacagcaagaaccaaatagcagattataaattagggtcagtctaaccctctaacattaagacttatcatttatttcaattaccattagtttaacacccattatatatatattaatatgtttcagtctctatgattatattttattttcttagtattgatgcagatatagtcaatacttccagagggaaacacttatagtcaatatattaggtctaaaatgagaggagcaagatggtggaacagaaagcttcgctgatcgtctaccctgcaaggacaccaagttaacaactatctacacagaaaataataccttcataagaaccaaaaatcagtttaccactcacaggacctggttttaccttcaaatgattgaaagaagcacaggatatttaagaaaaaaaaaaaaagtcctgaataaccgataccacccctctttgaccccctacctgcctcctccacatctgtggcttggtgcggagagcatctctgggcactgtgggagagagaacacagcaattatgagtcattgaattcagtgctgtcctgttagaacagaaaggaaaactggatcaaactcagctgacccctgcccatggagacaacatttaatcgagagagcactagccacagagtccaaacttgagtgcctacaaaccttaccatcaagggctacagcattctgtgtctctgagtaaacttgaaaggcaatctttggccataatgactgaaaattttaggtgagtcctagtgctacactaggcctagagacagtggactttgggtccatggggggacatgacatatttagacaccagctgtagcagccaagggagtgcttgtatcaccatgctgataaccccagactgcacagattaaggcttcaaaagagaccccttccttttgcttagggagaggagaggagggggaagagtggggaggactctgtcttgcatttaggataccagctcagccacagcatgataaggaatggtcaaagtaatgaggctcccgttccaggccctagttttcagatgacatttctagacacatcttgggccagaagggaacccactgccttggaagaacagacccagtcctggcagcatacatcacctgctaaccaaagaacccttgggtcatgaatagccagcagtgatacccagatactacactgagagccttaggtgagcctctgagactagctgacttaaggtgagactcagcacataaacagctatggtagctatggggcaaaactgcttctgcttgagaaaagcagagagaaaagtgaagacgactttgtgttaacaccttaggtactagcatggtcacagggaatagagcaccaagtgggttcttgggttccctgattccaggacttgacacttagatggcattgctgaaccagccctaggtcagaggggtgcccaatgccctgaagagtaagtctcaggccaggcagcagaattcatgagaagcttacttaagagaccttgggccttatgtgagcattggtggtagtactcctcatggcctggggtggcagtggctatgcggtgaggcttttttccaaaaacctctttgcttttggaaggaggaggcaagagtggtaaggattgcatcttgtggtttgagtgacagctcagctgtagtaaaacagaacaccaagtggacttctaaggttttttatatctagttcctgactcccatatggcacttctgagcccacccagggccttcggaaccacactgctctaaaaaaaaggacacaggcctggctggctttgacatctgctgattgtagagccccaggaccttgagtgaatgtaggcagtagccagggagtagttacggcaggccttgggcaagacctagcactgtgctggcttaagatctgaccagcgcagccatagtggtagtggccacaggggtgcttatgtcacttcatccctaggtttaggtgactcagaacagaagagagagagagagagagagagagagagagagagactgactctgtatgtttaggaaaaagtaaggaaagagaataagagtctctacctggtaatccagagaattctcccagatcttgcccaaaaccatgaaggcagtacctctactagtctgcaagaatcaccgagatattgggtttggggtgctcctaaagcagatacagctaagatcacaacacctaagtcctttcaaacatctgtaaagctttcccaagaaggatggctacgaacaagcccagccagtgaagactacaataaatacctaactcttcaatgcccagatactgatgaacatctactagcatcaacaccacccaggaaaacatgacctcagaaaatgaactaaataaggccccagaaacgaatcctgaagaaacagagacatgtgacctttcagacagagaactcaaaatggctgtgttgagaaaactcaaagaaattcaggagaaggaattcagaattatgtcagataaatttaacagagattgaaataataaaagaatcaggcagaaattcttgagctgaaaaatgcaatgagcatactgaagaatgcatcagagtcctttaataaaagaatgaatcaagcagaagaatgaattagtgaacttgaaggcaggctatttaaaaaaacacattcagaggagacaaaacaaaaaagaataaaaaacaatgaagcatgcctatgagatctagaaaacagcctcaaaagggccaatccaagagttattggccttaaagagaaggtagagaaagagataggagtagaaactttattcaaagggataataacagaaaacttcctaaacctagagaaagatatcagtatccaagtacaacaaggttatagaacaccaagcagatttaatacaaagaagacattctcaagacatttaataatcaaactcccgcagtgcaaggataaagaaaggattctaaaagcagtaagataaaagaaataaatagcatacaatggagcaccaatgcatctagcagcagatttttcagtggaaaccttacagaccaggagagagtggcatgacatatttaaaatgctgaaggaaaaaaagcctgccctagaatagtatatctagcaaaactatccttcaaacatagagaaataaaaaaaaagctgagggattttatcaataccagacttgtcctataagaaatgctaaagacagtacttcaaccagaaagaaaggaacataaatgagcaataaataatcacctgaagatacaaaatttactggtaatagtaagtacagagaaaaacacagaatattataacactgtaactgtggtatataaactacctttatcctaagtagaaagatgaaatgatgaaccaataaaaaataagtataacaacttttcaagacatagtacaataaaatataaactgcagaaggtttaaaagggagggacaaagttaatgcatggagtttttttagttttctttttgtttgtttttttaagcaaatagtgttaagctgccatcaggttaaaataacggattataagacactatttgcaagtcttatggtaacctcaaactaagaaacataccatggatacataaaaaataaaaatcaaaagctaaatcatatcaccagataaaatcaccttcactagaggaagacaggaaggaaaaaaggaagaaagacaagaccgttaaactaccagaaaacaaataacaaaatggcaggcgttaagttcttacttattcctagaataacattcaataataatattcaataataacattgaatgaaaattaaattcttcaaccaaattacatagactggatgaatggatggaaaaacaagacccattgatctgttgcctacaagaaacacactttgcctctaaagacacacacagactgaaaataaagggatggaaaaaagatattccctgccaatggaagctaataaagatcaggagtcattatacttatatgagacaaaatagatttcaagacaaaaactataagaagagacaaaaggtcactatataataaacgggatcaattcagtaagaggatataatattttaaatatacatttatgcaacactagagcacccagatatatgaaggaagtatcataagaactaaacagttaggccccaatacaataatagctagaaacttcaacactctacttttagcatctgacaaatcttctagatagaaaatcaaaaaagaaagatcagatttaatctgcactatagactaaatggatctaatacatatttacagaacatttcatccaagaacttaagaatacatattctttttttcagcacttggatcattctcaaggatagatcatattttagttcataaaataagtcttaaaacattcaaaaataaaataatatcaagcatcttttctgaccacagtaaaataaaattagcaattaataaaaagagaaattctggaatctatacaaatgcatgaaaattaaacagtatgttcctgaatgaccaatgtgtcaatgaagaaatcaagaaggaaattgaaaaaattatcaaaacagataataatggaaacacaacatagaaaaacctatggaatagagtgaaagcagcactaagagggatgtttatggctgtaaatgcctgcatcaaaaaagagaaaaaaatttcaaacaaataacttaatgacacatcttaaaaattagaaaagcaatagaaaactactcaaaattagtagaaggaaaaataagaatcagagtagaaataaaataatttgaaatgaggaagacaatacaaacgtcaacaaaacaaaaggttggctttttgtaaagataaaattgacaaatctttagccagactgatgaagaaaaaaaagggagaggacccaaataaataaaaccagagttgaaaaaggaaacattaccaccgatactgcagaaattcaaaaaatcattagtggctaatatgagcaactatatgccaataaattgggaaatctagaagaaatggacaaagtcctagatatatacaacctatcaagattgaaccaggtagaaatccaaaacctgaacagaccactaacaagtaatgagattgaagtcataataaaaagtctcccagtaaagaaaagcctgggacctgatggctttgttgctgaattctaccaaacatttaaagacaaattaacactaatcctaatccaatgttctgaaaaaccgaggaggagagcgtacttccagactcatcctatgaggtcagtattaccctgatgccaaaaaccagacaaaggcacatcaaaaaaagaaaattacaggccaacatttctcatgaggaaacatgctcaacaaaatactagcaaaccaaattcaaaaatacattaaaaagatgattcatcattaccaagtaggatttatcccagggatgtaaggacagttcaacatatgtaaatcaatctatttgctacatcgtatcaacagaatgaaggacaacaatgatatgatcatttcaattgatgctgaaaaagcgtttgataaaattcaacatctcttcctgaaaaaagcccccaaaaaaactggctatggaaggaacatacctcaacataataaaagccatatatgacacacctacagcaagtatcatattaagtgtggaaaaatagaagccctttcctcttagatcagaaacattgcagggatgcctaccatcaccactgttattcaacatagtactagaagtcctagttagagcaatcagacaagagaaagaaataaagggcatgtgagttggaaaggaagaagtcaaattatccttatttgcagatgatatcatcttatatttggaaaaacctaaagactccacaggaaaactattcaaactgataaataaatttagtaaagttgcaggatacaaaatcaacgtgcaaaaatcagtagtatttctatataccaacagtgaacaatgtgaaaaacaaacaattaagtaatccaatttacaatagccatacataaaattaaaaacctaggaattaacttaaacaaagaagtgaaatatatctataataaaaaccataagcaccaatgaaagaaatcgaagagaacaaaaaaaaatggagaaagtattttatgttcctggattgaaagaatccatatttttaaaatgttcatattacccaaaacaatgtacagattcaatgcaatccctaccaaaatgtcaatgacattcttcacatttttcacatagaaaaacaatcccaagaagacccagaatagccaaaactattctaagcaaaaatagcaaaactggaggaatcacatcacctgacttcaaattatactacagagacatagtaaccaaaacagaatggtactggcataaaaacagacacatagacaaatggaacagaatagagaacccagaaacaaatccacacacatacagtgaattcattttgacaaaggagccaaaaatatatactggggaaacgatggtcttttcagtaaatgatgctgctaaaggtagatctccatatgcaaaagaatgaaactagatctctatctaccaccatatacaaaaatcaaataaaaatggattaaagacttatatataagacctcaaactatgaatctactacagaaaagtattgagaaaaatctccaggatattggtctgggcaaagctttcttgagcaataccccacaaacacaagcaaacaaagcaaaaatggacaagtgggatcacatcaagttaaaaagttctgcacagcaaaggatacaaccaacaaagtgaagagacaacccacagaatgagagataatatttgcaaactattcatctgacaaggattaataaccataacatataaagagctcaaatgactccataagaaaaagtcaaaaaatgggccaaaggtttgaatacatatttctcaaaagacatacaaatggaaagggtgctcaacatcattggttatcagagaaatgcaaatcaagactacagcaaggtgtcatctcaccccaattaaaaggcttttatccaaaagacaagcaataacaaattctggcaaggatatggagaaaagggaaaccttgtacactcttggtgggaatgtaaattagtgtaaacactagggagaacagtttggaggcaggttccacaaaaaagctaaaaactgagctaccatatgatctagcaatcccactactgggtatatattcaaaacaaaggaaatcagtatatctgccctcttatgttggtttcagcactgtttacaatagctaagatttggaagcaacctaagtgtccatcaacagatgtacggataaatgaaatacggtatatatacacattgtaccatatgtaccatatgcatatatgtaccatatggtacaataatagtactccatatggaatactactccactaaagaagactctagattgggagaaatgtaggggtgatgccttcaaagtgaaacttggtctcacccttcttatgctatttttatttagttttttggtccacagttccactattatggtagtattagtactaccataatagtactccatatggagtaccattcagccataaaaaagggtaagattcagttatttgcaacaacatgaaagaacagaggatctttatgttaagtgaaataagccaggcacagacagacaaacattgcgtgttctcacttatttgtgggatctaaaaatcaaaacaattgaaatcatggacatagagagtagaaggatggttaccagaagccgggaagtgtagtaggaggctgggatcaggggaagatggggatagttaatgggtaaaaaatactagaaacatgtatgaaacctactatctagtagcacaattggatgactatagtcaataataactaattgcatatcataaaataaagagtgtaattggattgtttgtaactcaaaggataaatgcttgagggtatagatatcccattctctattatgtgcttatttcacattgcatgcctatagaaacacttctcatttatcacataaacatatacacctactatgtacccacaaatttttttttaaatttctaaaaaaaaaaaaaaaatattaggtcttacaattacccattagtaaaaataaaggctagaaaactaaacaaatatttatttatttgtatttcctttgataagcattagtaaatggatttagctatattctgtagggaagagagagaaacaaatatttggaaagcagccaaattattgatacagtatcaatttttttatgtgtctttcttccttctttccttcttccttccttccattcttctgttctttttaaattgtgatgcatttactaagttgggtaaaggaaggcagtgggaaattaattatttcattaagtcagaaaagcagtcatttcaatgcccaaaagcaattagtgaaagttgccagaactggaagaccatcttccttggtctgattgactttaaaagccagtatgggatggcaaaggtcaattaccagagtagtgaggaaagaaataattaaagataggtaggcaagagaaagtaccaaggaaagctggctgaactgagctatgcccaagatggaaacttttaggtaagcatgtgaaatgggaaacagttggaaagctagatgggtacatggtattgcagggtttgggggaagactagtgaggatttaggcctgattgtccggctttagttgttttaatggatgtgcctgctgatgagcccaagcctccagataataattccagccagaaggaagctgaagagctgtaagaaaacattgcacgacccatgatcttgggttcacctgagacagattttggagaaagaagggagcacagaaagagtatgttactttcaaaactacaacaattcgaaagctatttttttaattgccaagaaaaaaataggctaccagctgtttcttcccgtaggaattgacacaagccaactctcaggagtgattttccaaagaaaagaactggcccagcctaatcagaagtttatcaaatattcaactttactttttaaaatatgttttagtgctacagatgggccaaataaaacaaaacaaaaaccctgcaattattccttacagtattaccctattaacagcttgattattttaagatctaatcttgagttcttagaggcagcagttaatactgtttggagcaaaagttagaattaacaaaaaatgagtttacatagaaaaagatagtatattcaagtctctgaaaacccccaaataatctatagaaaacacatttataggatatatttgcatcatcttttctaatgaagtgtcccataatagaggttgaatggttggcaggactgtcctaatggtgctttcatacaggagggacttgtaagtagtccttgtgaaagtcccttcagtacaagtctaaagtgcaggcattcttagtaacccagacagatctgtctctgtgatgtagtcctttgaacttactttgcacaagaccaatctatgcacttcagaccataataccttattgagcattcattaattcagaacagcagacatcacattattccaatgattaagtactaacactcccttgcattgcttcccttgtctcatatccatacccatttcaaagtaattaagaattcagacttggaattgtgactctcccagtgagactcccagctctgttactagcagtttggtcataagcaagtttcttagtctctctgtgatcaagctccttcatttgtacaatgggactaataatggcttccacttaagcatattgtaagaattaaatgagctaatgcatataaagcacccaaacggtgtctggcagagagtaacgatagagaactttgagctctcattagaaaaatagtaggaacccatgctgttttttcaacagaaggttgtttggtaagtataaaatagaagatccagggcagaaggtggtgggggtgatggtggtcagtggtggtgttagtgatggcactacacttaattttggaaagttaaattaataagtttgcttttattttcaaaatatagggtcttccttagtgaagcagtactcactaaataatctggcaaatcttcaccttctgaatcgaaattttctaggctatccacttttctctctgaatcattctttctttagatgtgttaatatcactgattacatgtaactcaagtgtgatttccttaggtcttagagacattatgtatagatcaaattaatccaacttttagttttagaagtacttttatagcctgcatcatatcctgtaagacatcagatgggatgctacagaaaaccctggtgatgtcctgctccctttcatctcttctcgtgtgtaggcaactcctggtactttggatgaattccaccttaagggctcttattgctcttatacttatgcctaaacgcttaaaataattatgtattaaagttactgttggaactctgccattaagtatgtcgttgtgtccaatcagagtaatcataggcaaaaccctatttgtcacctgcaaccttctaaatctcccttttagccatgtctttctcactctcctaaatacctatccaaacaacaagacatcagcccatttttgtgggctgaaaggatttgtatgggcagaaaggattttagatgctaatgatttaaaacatttttctccaaacattaacaggatgtatccggccattaaaaaaatcaaccacacatcctcaatctatgtgtttttacatactaatgatatacatatactattatgtatgtatatatatcatttactttaaaaatgaacagtagaccctagacaattaaaagaatgaaataaccagatgttaacagaagtcttaacattttaattatacatgccaatgaatcatattgcacatcccccaaggtgaacatgccccaatttagagagcattgcttaaagaatatggtacacaccatactgaaactcctaattttaaaagctaaaaagaattgaagatggaatttgatataaatcatggtaggggatgatgaggcactgcctcattactgtccaaaggagtagaagtctagtttcccccatttgacctctgttgacactcctcattactgctaggtgagtgtaggagtccagctccccacaaagactccaatgactccttgctggatggaaaagatagcaatgtcttgttattgctccctgcatggcttccattgacaccacctgggtgggggttggtctcattattgctgtgtggtggtaaaagacctgactcttcactgggccttctcttctacaaccccagtggcaagacagtgggatgcctcattattatcagatgggataaaagtctgtttcactactcagcattatctgacaccagcctgggggaagacaggagcacctcattacagcagggtaacagttgaagtctaggattctcacttagcctttgcagacatggttggggatgaaattatgttttattttttttcctgtggtgcttgttattatctaaaattgttctgtcttgcttgtctacccctttcttggtcctttgacttgaaagcaaaaatttttgttcacgctatttgtgtctgcacgtggtggcatttaccaattgcctgcatcttcaactccaagtctgagttatctggaccaacagaaaatccctgggaatttaccaccatgctggttcttgagttccaaagttgagagtggtttgccttcttcctgtcacctttcggagccttcttagattatttcattatataatggtgagcgttttacttgtacttgaggaaaaaaagtacagctcttcatatttccaaaattagtaatagaatttgttttctgtaagatatttaacttccttgagtatcagtagcctcattaacacaatgaaaatattacatctatcttgcagagtggttgaaataattgcagaaaacttttaaaaatattatcctgccatgttatataattgcaaaggaaaaatgtgtaaaagatgtccctaacaatgctagttttgtgaatcaacatagtgttatttctgtgaaatactgtgtttgcctttctggactgccactctagccccccccccaaaaaaagtgttaattgcttgaatgaatcaggtagtattaaagaaaaaaggtggcagcctggagcatggtatattctagctatgacggaaagaaaggaagaaaaacaaagaaaggaggtattcttcaaaggaaacagtgtgcagatctttgtggtatttctgtattactgccagcaatggtgcccagaggtacaagcagcatagctcatatgcaaagctgagttggccactcccagaagcacggtggaaagttcagactagcttgagtccctagaaggccaacctccatgcccagacttagaccccaccctaaggctctgtccagatagggagatacacatcacagtgcctttcagcaaatgcaaaggtgagagttacatcacccagatgttcaaaaagcatcctggctctgcctcaaagcccattccaactctctacccaagcagggaggcaaacctcaatcatgcatttctaccaagcctagcagctgggtttggccattccaagcagcaattccatctaatcttgcaacccaacctgcagccctgccaaaattacagaactcaaatagtggtgctggccatctagggaatatatcctgtgccccagctcaccagacgtgatttcaacacccagtcagtgggtccagtgaacagcagagcccagccagcagccccatccaaccccagagcaaaggcagccttccagagagctagagaacctaacagcaagcactacctgcctagtgttattaccagctgacccatccagaataactgtctcaacttcatagtaaaggtctttccctgcaaaagaacacctgtgaaggatggaggacgtggctatctccccaaatgtgcagttacaaatgtaaggtgtcatggattacaaataatcaaaattatgagacctccaaaatatgctaatgaagttccaacaatgtagacttatgaaatgcctaataaagaattcagaatagttctctttaggaagttcaatgaactacaaaaacatacagatagaaaagtaaataaaatttgcaaaacaataaacaaaacaagaagtttggcaaagtaatataaatggtattctaaaagccaaataaaaatcctagacatgaagaacataatgactgaataaattaattaaaaagacagtgttgacagcaagctcaatcaagtagaacaaagaatcagtgagatgaaagacaggatatttgaaattatccagtcagagaagaaaaaaagaaaaaaaatgaagaaaatctgaagaaattatggaacaccatcaaggcacttaacatttatataagaaaaacagccagaaagtatgtttataaagagataatagccgaaaatttcccaaatctgggaaaaggtgccaacatccagatacatgaagtacagagatattcaatcaaattcaaccaaaaaggagttcaccaagacacataataatcaaactgtaaaaaactcaaagacaaacaaaaatatctgcaatcagcaagagataagaaacatatgacatgcaagcgtgtcccaatacagttagcagatttctcaaaagaaaccctgcaggccaggagtcagtggaaatctaaaacaattaaacaaagtagcaaaaagcagaatagtggtcatcagaggctgggagatggagagaatagggaggtgttggtcaaaggatacacagttacagttagaaggaataaatgataagtatttcaggtgatgaatatgttaattaacttgattcagtcattccatgctctctctatatatcatatcatcactgtttaccacataattatatacaattataatttttcaacaaataattattttaaaacataaattttatttatttaaaaaattttattggctgggtgtggtggctcacgcctgtaatcccagcactttgggaggccaaggtgggaggatcatgaggtcagaagatcgaaccatcttggctaacacggtgaaaccctgtctctactaaaaatacaaaaaattagccgggcgtggtggcgggtgcctgtaatcccagcgactcaggaggctgaggcaggagaatggcatgaacccaggaggcagagcttgcagtgagctgagatagcaccactgcagtccggcctgggcgaaagagtgagactccatctcaaaaaaaaaaaaaaaaaaaaattattttaaaactctatttatttaaaaaataaataaataaaagagataactactaaaagagcaaaagagcattggtgaaacgggataatattaacaatacagggtttctgtaaagactaaataaattaagaaatgttaacatatgatttaaactaaattttagataaatgctgtgtgattatatttaatactagcagtagtaatattttaaaatatttgtaaaacacattattaggccttccttttataactttagagctggttacaccccaaaacaaaagagtttctcagtttggtttctcagttacctcagtctggtttctaaaagtaatttataaatcatttaaatctttaatgtaatctcaagaaaatgttaaaaaatagaatcacattcataacgtgaaaaacaaaaaaatactttaaaattctccttcccatctttcacatacttcagcagtctctggaatctcctgttcattccccaacacttgttatatatttatttatttttctacacaaataatactatagtttaattgtattcttctccaattcccttcaggagagactttataaggtaaaggagaggcagtatgttctcttctgctcatttagtattgcctcttgcatcatgcacctcacccaaatcccacagttttttcattgctggcgttatgaagcaagatatattgcaaatttcatctcacaatgaggcaaaaatcctactacagttgaacagacttttagagagggaaaaggtagatgttggtgtagtgtaacgtatataagcacaaactagaacatgataagctgagtacaaattttggctttactactttttagctttgtgtcttgggcaatttacataaatgtattttttctaagcaacgtcttctgtaaaataaggggaataatagagtcgttaaaagattaaatgaattagtataaataaatacctcaatacctgtcagagaaagtgctaataaatatatatattataatgtttattaaatcgttgattcctttaaatcacattgacctagttgtgcactttttcttcatttgccctgaccaagtaaatcaaacacatcaaagactgtgtatgaaaaacttgttttttttcctatgaacttatgcatacattgtattgaaggcaatacagtatatagtagtaattgtgtgcgatatcttatgtgatagaatagccactgaaaaataaaaaaaaataaggccgtcacaggataactggccaagaagaagttgggctatcagtaagggaagatgagagcttgtcctgatgcctcccctactcctccgcattggaaaagggtaaacactgctatcgcccatagtactggtgatcaaggttaccagatatgatttaagggcatttctgtacaacaaaaaataaaattgtattttcttatcaatgtgatagtgtgagataataatttaatttcaatccatttattaattgtctatagagtcagaaataacctccatcacaaaaagccattctcaacaaaggcagcaggcagaaattgctcacagttgttctcagtgatgctcagattactcaagtgaattactggaaacaatggatactgacaagaaaaggaaaatgactggagagaatagaagttgatagcactgaaataaaaaccttccaatggggcaggtgtatgtggaagtgcatgtctttgcatatttccccaaggagaggagtaaagaatggctttggctgtgagatgcattttaaaactgtaaaataagaggatcatgtatcaaatcaaattgtgttggcctggaaacatattacatttttgcatgattttgctttccctaccattattttcatatgtattaatttactttaatattcctcctataacatttatccccttaatagatatatgatgatgaagatagatgataggcagagagagaggagagagaaactagttttcaaattgtttgttggtgctgactcaaaagcacaaacatccaaactcctcatcacttaaaatctgtagcaaatcctggaaataactgtgaatattttctctcataatcataatttctgaaatcttttgtaatttacattgtgtcacattattctaggaccattcattcatgacatctattgtctaaccactcaacatttccataagtccatttgttattgtcagggcacaaatgaaagccttgtattggcacaagaaacacccatgccaagagaatgttgttacctctgttcccagcgcatggctactagataggactacttaagcacagaacactgaaatagcaaatataaaatgccattgtaaaatgagctctatttatgtgtgcatatagaagggagagaataacatgttgttagaaagatgaatgagatgaaagaataaaattaaattagtaattcaatttagtaaatactaattagtaaataagtaattacttatttacttattagtaaattagtaaataagtaaataaggaattagtaaataaggaagcaagacatttaaaaaataattttaaattaaatccttggcttacaagaaaatataagttgtttttaatcacaggaaaatacctgtatttgagaatactttttgacccagatttttattacattctgacaaggcaagctcaaatgtttaaaacatactgttacttctcatagctgactgatgcatgaaccacatcaggttacagaaaacgagtttcactatttggagcagatgtatctctctcaccctagtttccaggttgctgtcattttctaaattaccacattatgccctagatttaaatgtgttatgaaaaatctgccataagtataaaatgtaagctaatttttgcaattataaatgttatttcattagttgagatacattattggacaggaaaattattgtactgtctttttgttttctagagcacaattcacttagcaatttaggaaataatctcctttagaatagaatccattatggtaaatagttgacatcatttcaataagagaaagtaatgctaccaaagatgtatagattttctatattgactaagaaaaagtactctaaccaatgtcttgttatgtaacaactacattacttctgctcaattgtttgaaatgaaaatgtcactctgggatcccagcatactttaagaataagcagctctgcatctcagatcagctgcacacttaaaaatgcgctctccaagaatagcctgcagtctatgccaattgcaactaaacagacctggacatgtcactgttactgatgtgacacctgcctcagtgcccctgtttctgcattccttcacagcacttgcatccaggaagattcaagtccttctctcattctgatttattttgctgcaggattaataacaacaaacacatatggaatacttatttttatgacaggcactatctaaatgctttgtatatgtgaactcacataatcctcacttaatccctttgaggtaaaaactattattattctcatattacaattacagatgagaaaaccaaggcacagaaaactaaatgcattgctgaaagtcactcagccaaggagaaatggagccaatatttgaagttaggcagccgctgttcagagtccactctcctaagcattactctctgctgctttagacatagcatggccagagaaaacatgggacattcagttaactatcagtaaaatataaaccaccagggataggttacttttagcataaatatgttccaaatattacatagtgaatacctataccaaaaaaattttatttgaaattcaaatgtaactgagtgccctgtattttatttgctgaatctggcaaccccaggaagactgtcacttaccctgacttttctgaataatgttccttattccacatggtctacacaaccttcactagtggcttggcaattaccaaggctatctcctaatccatcaccctaggttgctttagctgcctgcaaaaatagcaacactttagagtaagttctcaatattgtagatcagtggttggcaaactttctctgaaaagagccagatagcaaatattttaggctttgtgggtcatacaatctctgttgcaactattaaactctgccaatgtagcaggaaattcatagacaatatatgaccaaatgagtgtggctttcttccaataaaactttatttacaaaaataggcagcaggctagatttggcccatgagcactaatttgctgattcctgctatagactcttctggcagattctgtgaggtgagttccctgtctgagaacaatcaacccaacctaaagacaccataggaacataagatctctctgcaagtcatcttctgtttagtgaaagaagtcttcagtgagaaattgctcttcagtatcttccaaaacagggcctcttcttttcaccatctgtggtagtttatcctcaatgatggccaccaagaatttttttcttgtatctgcatactattccttccttcaagaaatggagcctatttcccttcccctagattgtgtgctgaccctgtaattttcatcaaccaatgaaataaagcagaagtggcactgtatcagttcaaggcatagccattcagaggcttaacagcctctactttcactccgtgagagccctgagctaccatgacttctgcaagagatgctaagatgccatattgtcttaaaaagtacagcaaactcaacatttcctgtatgggctgaaatgtgttcccctgacttcaaacttatatgttgaagccctaaccctcagtaccccagaacttgactgtgtttggaggtaagggctttaaatatgtgatgaagttaaaatgaggctattagggtgagcactaatccaatctaactggtgtcccaataagaagagaaaatgtcaacacgcaaagaaacaccaggggctctcatgcaaagagaaaaggctatgtgaggacacagtgaaaagatggctatctgtatgccaaggagagaggcaagaaactaaacttgctggtattttgttcttggactttcagcctccagaactgtgagaaaataaatttatgttgtttaggccatctagtctgtgctattttgttatggcattccagcaaactaacacatatgccaaaccttcccaactacaacagtacaacttaatttggaatctgcttctcctttaatactatttagagcagtagtacataggactctggccttatattttgcttctatctgttgtccatttaaaatccagccactataatatacttgtagcatacacaaataaaaattccatatagattaataatctaaatgtgaaaatctaaagttttaagcttttagaagagataataacacataaattttatcatctcagcagagggaagaattcctaaaataactcactaataacacaagcattaatgaaaataatacatacaattgactatatcaaaataaaatatttgtgtgaaaaaatttaccataaacaaaatgaaaaaaagtcatatacttgaagaaaatatcagtaacacatataattgataaaggaacaatatgtggataatattaaaaactcatacaaataagaaataagattaaaaatccgattgaaaaataagcaaatctaataaattagaaatttagaatagtggaaatttaaatgtataataaaataaaactcatcccactagtaattcaggtattacagtattaaccacgtggtatactatttcaactaattagattaatgaataaacaaacaaaaataaagtgagacaaatccaggtactggtaaggatatagtttagcagaaatacacaatacactgttaaggagaaaataagatgtcaataaatacagtgaattttaaaatatgcatattctatgacccagcaactatactcttgacttaacaatagattatcaatttaattataaattgaaatgcctaaggagttttctatttatttcatctttaatacgagtacttaaaccctaccccaaaaacaaatgaataagaatctctgagggtgaggctcaagcaataatggaggtattgcaatctgcagccagtgtagagaaacacgtcctagaaaaaattccacatggatacacaaagtgacagctataatgatactcattgcaatatggtctgtcataggcaagaattgaaaacagaccaaatgtactttgccaggaagatggattaataacttggcatagtcacatatggaatataagagagtagttagaattaacaagttagattttcataatacaacaactaaataaacctaaaaacacagttttaaataaaagtacattattcagaactatatatctaagagtattagaaatttaaaatatgtaattagtacaatctattacttgcagctacctaacatacggggaaattttcaaaactttttgggagtgataaatactaaaaagtcatatagtataacactaattaattctgaagaaagagaggagggaaacattggggagaatgaatatcaagggagctttttgttttactatgtatttaagatgtcacttaaagtcaatactaaaaagaagcacatgtgtcaaattgttgagatttgattaaactgggtagtggtacatttgaaatatttcaaaagactgaaggaggaggtgaagaatggaagatggaataagacactttgaaagatgctaatctttggaaattgggccaaggataaatggtacttgaatcacaaaaattgaacataaagtcatttaattttattttttcatcatctatattgtttaaaaattttgtattttatctggagctcatcctgcatggagaatcacagtagaacttcaaactacatgccctaagaatgaactttttgggatctttcatactataacaccaagctccctaacaccagtgcctatgataactataaactacctaaactgagctcagtaaatttgcatgtctgtgtgtgtgtgtgtttgaaataatagtttgcaattaacatgtctagtaaaatcaaaattgtttgttcataggtgctttagcctatgccttctacctttaggtcacatttttggtgaaaagtcattcattgttttttaacatcataataaacttccccattcgtggtctttgttactcttgttattttgcatcttatggtctttatgttccatctgccttcccatcagaaatgttgatgcctcaataaaacctatttgcttcctagttggctggtgcttcttcgtttgcaacctagttggctggtgcctcttgttttgtaatattttaggttgatcatatttttgttactgaactttttttttttgagtcaaggtctctctttgtgcccaggctggagtgcagtggtgccatcttagctcactgcagcctcaaacccctgagctcaagtgatcctcccacctcggcctcccagatagctgagactataaccatgcaccaccacgacagctattttttaaaattttgtagagacaaggtctcactatgttgccctggctggtcttgaattcctgggttcacacaatcgtcccacctcagccttccaaagtactgagattacaggtgtgagccacagcacctggcctgtgactgatcttttgacattgtattgtaatcactgtttgcatcattggctcccagactaaattgtgaatcccctgagagcaagaaccatggttgcttcttgcgcaggatgccttcatctgctgctcgcagatacccaggagccaagatgaattttcttctttggccaacctgaatattcagaagtgtcttgtgaatgccccctcaagtcagctcccacctacttttcattagtttattcacttttttagggcaacttatattttgtccacttctccttgctttttctttcataggcatttttgtgacctttcctttgtcttattccaaaatgttaactctagttcctacgataagctctctgagttctgaaactccatagaacttgctcataatctcagatcatgcgttcattatagcagttatgtctttatatactcatgtttgatctctctttctagaggacagaatcctcccctttcccccgcatatcctcaatgatccagcatttctcaaagtgccaccctgaccacgtgcatcgaaataacctgagggtatttttcataaaacatatttatagcatcctttccagaatctccaggtccagaatctcaactttgcatattaacaagtaatctaggagatggctataaaacacaattagcatacaggataaaaggaaataactaaccttttaaaactatttatttttgttccaagggttttctacattttagcagatttaatgaaaaaggtattactatcctgaatttatagatgagaaattgagaattagaaagtgtgaaacatagtctttggaggatggccagggtttaaatctctaattaattactcaacagctatgtgaattagggtcaagttaccaacatttctgtgcttcagtttcttctttcaaagtaggaataaaaatggcagctatcttgtgcaagtgttaggagggctaaatgagatgagaaagctgtgagaaaaatgccgaacacatgatagtcctcagcaaatcttagcttgtgagactactgaatcccacactaagcgatagtggaattggggtttatcttggaccaggactcggaaacttattttaaaggactagagagtaaatatgttaggctttgcaggttacatagtctgtcttaagtactcaacttcaatcctgtatcaggaaagcagccattgacaaaatgtaaaaaaaagaaaaaaaaagaaagaaagaaaatccgtgtggatatatccccataaacttcatttatggtgagaaatttatgcattgatgtactcttcttaggagttactagccccttaaagccatgagtttgtaattatccttctttttataatcatgcaatttattacctatttcctgctaggtattacaaaattctgagctagccacaggcactttgcttaatcaaatattcataaactaaaaaaaactttatttatggacactaaaatttgaatttcatataacattcacatcattaaatgttgccatgattttttaaatcattaaataatacaaaaaaagtattcttagctcccaggccattcaaaaacaagtagttggccatatttggacagaagactatagtctgcagaacccctaccttcacatatcagatttgaaagcttttgatacctcatagttgcctactaaaccttgaatgcaatggctattcagttatttaattggttaatacaagatgatttccaaggtttctgctcagtatctgaatgccagaaagaaattattaaagtggaatcccttatcacttcttggttttgtatcctttgaaactacttaaattctatctcaacttttaatttgttaatcccctcgtcttcctacctgcatcagccccttttcctgttatgctcaaatccacatccaaaaatcaagatgatgatgcattataattacctttataactttgtcaatcactttttctcgccttcaattaatccacaaaagagaacttttagagactaagtctggcattgtctaatcggactggagatttgcttcttttaggcatattgattgtacagcttgccccactttttgagatatccttccattaaattctagtcaagacattaaaagcaggatctgctggcaacaattactggtgaaaccagcataatataataaaaagcttatatgtaggatgaataagtataaagatccaatgtataacataaagactaaagttgataaagttgtattttattagggattgttgttaatcaagtagattttagctgctcttgtcaccttaaaaagtaactgtgaaataatagatatgatagtctgcttcattactataaccattttgccatctatatgtatcctataacatcatgttgtaagcctcaaacgtatacaataaaatttatgttttcaaaaaagtcttatgaattaatttagtactatgtaacccatactggggaatggacagacagagggatagaacattaacaagacatatggttgccagaacatcatttggctattgttagtccatttaaataatatttggataattctaggttaattattaaatacagatgtgattgagacacttaaatgtaacagtacacaaaagattacaattagttctgaggcagaaaaaaaatgcagcgacaccttaacaagtcagatatgacacacattttaaaaataaacttcagaactagaccttggggcactcttgacgtccccacagccctgcgcccctcgtcccttttcatgtctcctggaggtcggcaagctgcagttgcagcaatctcatttaaatttaggtagttgaattttttagaattaagttttatatgttttgagcaataaattgtcttaagatatatattttaggttacttccaagatggccaaataggaacagctccagtctacagctcccagtaagattgacgcagaagatgggtgatttctgcatttccaactgaggtacttggttcatctcattgggactggttggacagtgggtgcagcccatggagggtgagccaaagcagggaggggtgttgcctcacccggaaagtgcaaggggtagggggatttccctttcctagccaagggaagccatgagtgacttacctggaggaacggtacactcctgcccaaatactgcacttttcccatggtcttcgcaaccagcagaccagatttcctcccatgcctggcttggcaggtcccatgcccacagagccttgctcactgctatgtcagcagtctgagatcaacctgggaagctggagcttggcagggggaggggcatctgccattgctgaggttgagtaggcagttctatgctcacagtgtaaacaaagccacagggaagcccaaactgggtggagcccactgcagctcagcaaggcctactgcctctctagattccacctctgggggcagggcatatctgaacaaaaggcagcagacagcttctgcagacttaaacatccctgcctgacagctctgaagagaacagtggttctcccagcacagcgttcgagctccaataatggacagactgcctcctccagtgggtccctgacccctgtgtagcctgactgggagacacttcccagtaggggccaacagacacctcatacaggcaggtgcccctcttggacaaagcttccagaggaagggtcaggcaacattatttgctattctgcagcctccgctggtgatacccaggcaaacagggtctggagtggacctccagcaaactccaacagacctgcagctgaggggcctgtgtgttagaaggaaaactaacaaacagaaaggaacaccatcaacatcaacaaaaaggacatccacaccaagaccccatccgtaggtcaccaacatcgaagaccaaaggtagataaaaccacaaagatggggagaaaccagagcagaaagactgaaaattccaaaaaccagaacacctgttctcctccaaaggaacacaactcctcaccagcaagggaaaaaaactggagaatgagtttgatgagttgacagaagtaggcttcaaaaggtcagtaataacaaacttctccgagctaaaggagcatgttctaacccatggcaagcaagctaaaaacctggaaaaaaggttagatgaatggctaactagaataaccagtgtggagaagtgtttaaatgacctgatggagctgaaaaccagttcgagaactttgtgaagcatacacaagcttcaatagctgactcaatcaagtggaagaaaggatatcagtgattgaagatcaaattaatgaaataaagtgagaagacaagattagagaaaaaagagtgaaaataactagacattttttaagttgaatgtcagcttttcctcttattttagagaaaagatgagggtacacttttccatgaacaatctgaatctctgcttctctgggagcattgtgctgtcatttcagcagtgccattaccaacccattaataggtcttttgattaaacttctgtccctgaaaattcccagtgcatcatccaaaaatcaaaagccaggatgattttatacctctgaaatatcttgattttgttagcacagaatatttaaaaatggcctctgcctgtctcattagacatagccttaaatgagtagcttttatatgataatcataatgaatactaaaacctcagcaaggaattataaatacacctatgtctttttcttcacattttcatccaatgtaatagaaggattaccaagaaaaacactgaaatcaacatttaaaaatttccttttcacggcattccttctgtagtctaaaaatcactgggctaggactcaaggcctaaattcaaatcattgttccatctcctgttgggccctcatttactatgtttttatggggtgaccaactttaagtgttattattgatatcctagaatattttgtgataccttcattaagcacctcatcttaacatatggagtaataattcctctactcattttccctagtcatgttacttacctatgaataatcttctgtactcccctgactttctgtccttctgtctaattaaagagcaggtaaaggaagtgttcctgaatgatactaggcagaaaggatgccggactcaacatttaggctgatagatgtaaaaaaaaaaattagaggtggagtttgttattctcagtcctgactgaatgccatctgggtcaagatggaagaacagaaacaataaataggccaataaatattccaaatcctaacgtcctctgcagaactttttcctgaattaactttattttgaccaaaagtgtcttatcctctagacacatggccacagctcctcaattcatcctgctcaattaaccaagcatctgcctacaataagcacaatacagatgacatttacttcaataccttgaattatagttgaatcaaccataatctctgaatcttcaggggcaaaaattatgtttgtttcatctttgcattcatgtcatattcattgacatatcattgatcatcaaaaacattttgttggctgaatgaataaacatatcagctcacccattcagaccaataaaaactatttgactgactaattcatgatttgactgaactgccttgctggcttgattatttttccctaaacaagtcagacagagtgttttgatctggtgtgcgtatttagacaaagactcagaagatctgagctagtctctggcccattctaaggagtactggatcatgcctaacactgtgtctacttctctcaaattcatattccttaccattattacaaagttaataacgggaatacaaaacagatcattacatttcctgcaggcataataaaggtgcctattttcatgcctgtaggcaggtaactaattactatttcatttttcttctgagttcttcaaaatataccataggctttactttattggtttttggtttccttgttacagacaaaatgtttcagtagcatggatggaatgaaatttgcccaaggacaggcattagaactcaggtgtcctggttttcaattcaatgtttcttcctacttaaaaaaaaaaaaataggaaaaatctgctttttctacaaccagagatgcctgaaataaaacagtggattttttaaaattttatttgaacaattgtgctaagctgagaaattattatacgtggaggctcatgattcctttaaatttcaaaatgatttcaggtttctcaatatttataaaactggcattattattctcctcttgctttttaaataacaggccaaacaaaacataagattatctctctccatcgacagattatatgaccctttctaggaaacataaatccataataatcaattaatgctaatattgtaactttgcatagagctttgtttgttataagtaatacaaaagtattaaacataagggtatagtcaccatggtttatttatacatatggcaaaagagaaccatatacatataaataaacccctgtgaccaagacatagctgacatatcgtagctaaaccaaactgctattttgagccttgtctttttctgacataatccaggtttgacaaatgaccagatttattcacaggacttagttttgtttcagaagagcaaaacatcttcaaaatgatatattggcatgttttcagaaactacagactaaaattgaaatttataaattaataaattactgttttataaatcttacattttccaagaaatgatttaccaggatgttgaggatctggaatccctcatacaatgacactttcattgtcatattttaacctctaaaaacatatcctatttcagctatgcagatttgaagatggtcacttagtattctgccttatttttagaataagtttcagtaagtttcttcagggatgctagccataaatatatacttcaaagtcactgctattgattaagaaacataacgtcttatcagaaagaatagtatgaggctgtcatccaagaagaacttttcacaaactaacattccacaaaaattggagccaaactgtgaaccaaccacctgaatccaggtggatccagcttacaaagtcactgcttggctcttgctgccttctcagcactgtctgctttctgtttcctccatatggagttaataagtgctagctagtaaattctggatgcaaatcagagtaagaggagattatttttcaccttgagcagaagcatattcagtaggaagccagtaggtattctgacacaccacgatattataacttgtccaacctttattagggcacccagagcatccagctctgactggaattagctgtgtgaccttggattgatcacataatttatctgaacagtttatccatctttttctatgcataataatgcctacttcctcacagaattgtgttattaatgcagtgagctaatgcagatgtgatctgagatatccccttatcgactaagacagatccgaaagttagggaaacaaaacttacttacaggtggagagttcagggctcagctggtatggtaaattcctaaattcctaaggctataagaaaagtcacactcttgctaaactccccacaaataggagctatcagacccctcctagttcttatatacaacccagattgctacaattatgatgcttggacagagaactggccttacaaacagtcctttctgataagcaactaaagatcttaagacagtttcagccaacttattgaggctctccacgaactgcacattttagtgctaaaaccctgccccaaagtgaacataggacatgcattacatatatgtttacccattgcacgtgcacttggctgccatcatgaatatgtatagcttttcccccaaatctactgaatgtatatgattctattgtgtgatacaggccctgtgaggcatgaaaacccaaactgccccttccctccttgaagagaaatcaccttccagcacctgctggagattgtctcttcccagtttgcaaacagttattgccaaataaagctctcttttctactgtttagccatcctggtggtcttttggacaacacaggtaaaactgctgtacaaggataaaggtgttatgcaaacatctaggtgatagtttcctacagaatactgggttcagtttccacatatatccctcaagagaaagtgaaagaatacagaaattaaaagctctgtgataactttgacattttctaatgtaatatatttctttcataaacaaagaaacagagacccagagtgattaaattctttatctaaaaatcacagaactctacagtggtataactgacagtaaaatgcaaatcctttgatgcccacatcaatgcttggttaagatagctcatcctagcctcatagtccagcatactttgtttccaaaatattgacatatttttgtaacaataaactatccttcatatagcttctctgacatttgataggaataaagtcaacttcataagcaaattaaaatcaagaaatgtgttgtacataataaatacaattttatttgtcaattaaaaattaattttaaaagagaaatgatggaattcgggcaccaaaagaaaagggagagattaaaaaagggtagttaaaagtttatcagaatacaagtactactgcatcacttttcagaaacacaacaaaatacaagatcagtacaaagaaatgctcttctctaagttgtagccaacagatgacttacagaatttgtttttcttatctttgtggatcatgataaaaatttatttattcagcctgtaaaaagagagatacctaaagtatatgaggaaggcagtcattatctttttaattctgtgagtttctgcccagaggtacttcccactcctacatatacacataggagtatagtgaggggactaaatatatggggagattttcagtacagctatcctgttagtctcccttctgtctctcccacagtaaataaaacacaaatgctattatgtttctttatcaacacaaatatatctagagcaactaacaaaaatagtctataatactggagatattttttcctttggtggcatgagatcgtttttaaatgttttcttttcctcactttttcttttccctagataataccttctgttcaagtatgtgattccatgtcttaaaatacagagattataccatgtgattctttaattattaatttgtttgttatagtgttaataatacccaggccagagatattcaaacaattccatgctgccagtataagcataggaagtgatacattctctaaattgatttatacccagaaacataatgtgagcaattcagtaaatcccactgggaattctgaagctaagcttttgattgtcaatatgtcttagaaacaagagttttcatatcatctattaaaatatcatgtaaacatcaatgaaagtaaatattatacagtctaaatttttccaaacaatagaatgagagaatatttttgtagacctttaagtcatacttcaatattttagataagattaaaatagtctattttagccagaaatttaagccacataattacaaatttagcactcacatattaaacaaaggaagtggttaatacatttgctgttttacattaaacatgcaacttaattcaagtaaattgaaaaatgtacattttaatgtcatcagtcaattttccaggtcatttcatttctaacatctttcttagtgacatttgtgttactctgtcttgtttgtcatctacacatttatctcaaaggtgatattctggcataggagagagtgtgcagactgtgggaggaaacatatttgagtttaaatcacagacctaacacttagtaatggtgttaccttgaaatacaatgtttcataggtgttacctaagaaatacaatgttactctatttcattgagcttcagtttcacatcttgaaatggggataaactaccaatttcccagatttgttgtgagaattacatgacatgaaacactgaccacagcatctgacaaaacctacataaaggtgctcagtagggggaaccataattgttacctccttcactgtgtcatgtcatgggcgttaaaggatgataccttgttccttgttggaccagctaaactcatagcatgtcacctttctaaataatggttaaattgaatacaattaagcttctcagctgacagagttaaagtactctagagttatattggttaagaagaaaatgttagaacaaaatagagaaacacaaaaacacgaaagagaaaacactacttaccaataataccaaaagtaaaagtacaaacttgctaaaagcaaaaggaagtaacatatataaactcaggtatatcatttttgcctacacatttaacagacattttctaaaattataaaacacaaaataaatgaaactatgacaaagtagacacacacacagtgctagggacatatggtcaagccttctaaaaaacaagttgaaggttttatatatatatatatatatatatatatatacatagagagagagaatgtgtatatatgtgtatatatagagagagaatgtgtgtgtatatatgtgtatatatagaggatgtgtgtgtatatatgcatatatacatagagagagaatgtgtgtgtatatatgtgtatatatagagagagagaatgtgtgtatatatgtgtatatatagagagaggatgtgtgtgtatatatgtatatatatatagagagagaatgtgtgtgtgtatatatagagagagagaatgtatgtatatatgtgtatatatagaggatgtgtgtgtatatatatagaatgtgtgtgtacatatgtatacatatatacacacatatatatacatatatcacacacacaatatgacataaatgctgtgctagcaaattttatgtgtactgtttgaatcatgggatgcccagatatctggttaaacattaattctgggtgtgtctgtgaggatgtttctgggagattagcattgaattggcagactaaataaagagaattgtcctccccaatgtgggcaggcactatccagtccactgcagatctgaatggaacaaaaagatagaggaagggaagattctctagttttctgcctgactgcttgagcttcaggtgctgccagtgcttctagtttgcaggccctcagattcagactggaatttacaccactgactctcgggctctcatgctttcaaagtacaacactggcttttctgcgtttccagctagcagatggcagattgtggcacttctcagcttccataaatcatgtgaaccaataccttataataaatctctgtgtgtgtgtgtgtgtgtgtgtgtgtgtgtgtgtgtgtgtgatttgtgtgtgtgtcccactggttgcgcttctctggagaagcctgactgatacaaatatcttcagacttttgacctattatctaacattttgaattattctctaagcttttctaacattttatttctaaaatttgaaaactgttatattaatggaaaatctccctcaatgcataaattgtcacacaaaggtgataataacttatgcccaacaatggaagaatggtacagtaaatttttcattattcattgattatatatttaatgaaacttacatttttcagaagccattttaagggctacgaatacaatagtaaataaggcagagaagtccctgctgtcatggaacttatattttcaaagagaaaagatagaaattatataagtaaaattatttattataggactaattactgtgaatgtaattattttgtgaaggataatatgatagaaagttggggacaaggaggaagactaatatagattaaatgatttaggaaggttatgtttgatttgagacttgaataacagtcaactaggctgctctgtgaagttctctagaatacaacacaatcatagaaaatcatagaaaatatacagaaaatggcataagcactttttagaactataaaaaattcattcttatgtagaaaaaatgcattaaaatggcaaaagtagtgatatcaatatgatgaaggtatgggtaatttttcctttatttacattttttagtctaaaattatattattttatgttaaaaatggaaaaaatgaaaatataattaagcataccaaagaaaaagtcacaaatctcatcaacaacacttttcatatcagagtaccttgtatatagcattttaggcaaatacatatttattacacattgtttttaattatagtatagtaattataaatacataaacaaataataaatagaatcatcaaatatcttattagtcattattaatcctgttaagatgttgttagctgattttccttctcttgctattctactccaaattcccacaattatcctctaaaacactaacaacaaatacatcataatttgcatcctgtacttgtgaatatttcatcaacatcaccttctggaaaggcatcttgcaagaaagcaataagtgcactttcaagatgatctctcccacacatatgtcatttcacatctactctctattcctctcttgctgctacaccaaaaatattggaaataaaaatatcagattcttacgaacatgcataaacctacagggcatgtctgtcagaatatcctcacgtataggttacagcctgtctaacgtctgttcaaaaaaaaaatgcaattagtttctggaggtccaaagtcaaatacattgtcttagaaagtagttttagagcaagccacaaagctctctacttggtaatttaaatgactgaccgctcaatttatgagcattcccagcaataaaattcagcctgaacttactaatagcacattttatatgacaacgatgacaattacaacctatagttactgcagtcgccctttggtctagggaaaaatgacagtattaattatacacacttgccatttatcagacttaagttggcaggtgattgagctcagcaccatctctaacttgacttctacatttaccattttctaatccactgaaacgaagataattagaatagagaaaaatgagtggctccttctttcactgcctttatctctgatttcttatacagtatagttctttttttttttaatttctacagcaacacaattgttttattgatatgcttcatttgaatgtttactgtatattcaaatcttgatattaaattacaacttccagttacaatgaactggaagataaaatcaatcaaaaaagtaatttgataatatatgtttatgatccatttattgtgaagctcagaaacaaaagaaaaatctgccattgtggatacaattatgtaatagatcagtaatcttacctgtttttaaaatatataactttaataaaattgacttgattctctctcttaactgagaaagttactgacaattaaaatacctagtcattcataatggaggaatagaaagagctaaatgtgactaatatagagacagtggaaaggcaaataaagctactgagataggaaggagtagtaaatgtgagggctcttacatatgccgtagtacaggattagaatctcattaaatgaagagttaataaagggctttaaatgaggggtgataaaatcttagcaactctgcattgaaaaaaaaaaagaatcaaactttacactccccaaattcagctcaatttcagtaatatatgtaacataccaaaatttccaaagggaatccccacattccaaaaactttcaagttttattaaagaacaataaaacatcctcatatttaaatagtaggattttatgcttcttttttttttatagtatgtcataataataaattttcatttttaattttcatgaatctatagtaggtatatgtatttatagggtacatgacatgttcttgaatcatattaaatttatgccactttgtttaaaatcttgccattgtttactttctaaactccataacaaaaggtataatatttcatactgtagcaaggtgtcctgtagcacacaaaattttggctgtatgcaactttcacatttttattttataacttatttttatgtttggtctatttggggatcttgggtccttgttacatgattttcacttctactttatgttaccagtatattgagaactaaaattattttaaaacacggaaagctatctaaaaggcttgctgtctattttaggacataaaaatgtctcttgaacggttgtatttttattcaagcacgtctttataatttttatttaatcaggtatctgtcttattcaagcttcctttttttggcctctatgggcttttcagatacacagtatgccatttaagatttatgacgattataaaatcatgcttatctgcttctgtgttcagggctctacaacctcttctcagaaggcttaaagaattcctacttactgaactcttttagatgcattccttctgaatcttcacaaaactctaagaaatattatccctgcttttgaataagaaaaaattggggcttagaaagtttaagcaacagtgacacctgaaattagtccagaataagcaaccaaaaggtgtggctagaggtgtcataaaggtatagataagcagggaccctcaaccactgctatttctttctgaccctgtaattaccagtccaaagcacctgacaggataataccaatccagagaaaaccaaataggtaggtcttacagatttcccatttataaaggcagtatgttatactgaaaaattaattataagtatagtggagagtatggtctgacttatatctggaatctaaaaaagttgaatgcagaaacagagaatagaatgctggtttccatgggctaggcggttggaagaaatgaggagatgtttgtcaaaggacactaactttcagttatgagatgaataagctctagggatctaatgtacagcatggtgactacagttaataacactgtattgcgtactcgaaatttgctaaaaatgtttaaatattcttaaatattcttaccacaaaaaaagggtaaccatgtgaggtgatcaatgtgttaacttacctgattgtggtaataattgtaatatatatatatatatatatatatatatatatatatacacacacacaccaagtcatcacattgtacacctgacataccatattatttgtcaattatgcctcaataaagctggaagttttttttaaaatacatatattcaagaaaactgggaccagaactaattctatagttgcttcccacaaaatctttgggaagattaacttaatatccttgtacctcagtttcttcattcacaaaagtgataggattgaattatacatcctataaagtctctttatttcttcagttcttaatgcgactgtgaaatcctatactgaagtatgcagaaaggggatattttcttaaaactttaatcagtaggagccctactcctatgttaaagttgccagtggcagagttttcacaatgtaagcagcaggactcgatcttaaatttttaatagtgtgaaaactggcacgggagacagaggtgtgccctaaaccactcctgcattgttgaggtaggttgaatctgtttgggggactggtcttgtcctttttctgagaaggactaattagttgagcattttggttaggcatatgtaagaaattccttatacaattttttgaggaaaatttaaaccagtgaatatggcagactgccacagttactacttgagattgtcactacgacagatactactgttactacttgagaccatcattacaagactgaacgaagggggactaacgcagaaatgaaaacttaacacaaaagaaattgttttaaaaaggggggccaggggaagaagaagagagctcccttcttctagtgagcaaaggcagccgcctgagcctctacagccccttgtatttattggatagaaagagcagggaggaggaggtaactattggtcagctgcttgatcgatcacaggttcacatgattgctaacaggcttcagatttgcctaatcacaagaaacacttgtgcctgggttgtgactaccctcagcattccttctgggcaggagatgcagtttgtcagtttgccagcgccctgctttcatgagaacagttttctgtttattcatatagcctccagtggtatactgagttgatcacgaccctcactcttttggcctgcagcaagtgaagtagctaactgtagatgcttcagattaagattttaggtatattctgtttaaactctgtacaggcaaatcttctcttttgtatgactgtgactttagataaaattgtccctgaaaatatcgtttgttctgggaacagacatgaatgcacagaaggcatgcatgttggttcccacattctgtgcatacataaacaagacacacatgcacagaaggcatctttacagaagaacataccttccttgaacatatgggctttcaaggagttgtgagaccagagtcagaagggacttcaaggcttttttttctcttcacttcacatcaaaggtagaataaaaggccaagttagtgtattctgtttagtagattttgagtgaagagcacaaccttttagaaggtcctattgattttgcctagaacttggagaacagagtctaatatctctataattccctatgataggcagaataatgccccccacaaagatgtctacttcataactcctgaaagctgtgactgttacatggcaaaagggacttagcagatatgattaagctaaaaatcttgagtaggagagattatccttgctctgagatcaaaaatagcagagcataggtaccaaagtgagaaacttcaaaattaaggtttccccatcctgggaaagattcctaccacatggcatccggccagaggttaggtcccttttttttttttctgttccaccaagactacagtaaagttttgggaaacaccaaagggaattgagaaagcaacaaacgctgtaaatacatcgtgaggtatacgagagttatccagagaaacaaagacaatgggatatatagacattgatattgatacagataaaatgagaaattggttggcataattatgaaggttgaggagccccacaatctggttgtctgaaagctggagacccaggaaagtttggtggtgtagttcagtcccagtccaaaggcatgagaatgaggagagttgatggcataaatctgagttcaaggaaggagaagaccaatatcccaactcaaaaagtcagtcataaaagggaaaattttcccttcctctgtctcttggcaaacttttattagatcggatgatgcccacccatgctggagcagattcaattaaatagttattgtgtcacctggtggaagcattcctccctatggaaccaaaacctctaggccaacagagcatataacaaagtcatgagaaaacagaaagcaaaaaagttgctagtgggtaactaggaataatagtggtgccactctcatttccaccccttgatgcccggttcagtgaattctagttaggggagaaattgtaccatacattggatcttgattcagagcatatatagcctactggagaagcttgccccagtcctgcaaaataacatcacccagtgggtgctgtgagtcttcaaaaggctttctactgctctgtcaaatcagctgctttaggatggtggggaacatgtaaagaccagtgaattccaataacaaatatatggactcaacatagatgtccatcaacagtgaactggataaagaaaatgtgctaatatgttaggggtagaaggtatccaattcacatggcaccaaaatgttagacgtggtgaatatcagaatgactgatgggtctgaagcaacctcaattcttgcctcctctgaagaaacaattcaataaggggcataaggcagaaaaagagactgaggcaagtttcagagcaggagtggaagtttattaagaagctttagagaaggaaagtacacttggaagagacccaagtgggtgacttgaaggacaagtgccccatttaaccttgatcctaggactttatatgctggcccacttctggcatctcacgcccctttcccttcattcttctctaagagtgaccacccacaatgagcttgggaggtgagcatgtgcagtgtatttaggaagctgtacacatacccaactgaggctttcttcccttttctggtggaatgcctccagtaggtcatactctaccattttatctcttaatgtgcaagcctgagctcacttgtcaaattactgagatttttattgaaagttgattaccaatttcaagtgtttttatctgtttcagaaattgcttctccctggtgcctgcaattaattatcactttagtgtgacaactgtggaccatcaggaaattgcatctgcctggtgctggctgcctattatcatttttagagaggcagtgtgataattgtcaaaccatcattggtcgcctaacattgatggtcacctgacattcctgttgggtgtgcagggtgccctctgctcatgcctaactacctgtaacacatacaccatggaatactacccagtcataaaaaaagtgagatcatatcctttgcagcaacgatggagttagaggccattattgtaagtaagaaaatgcaagaacagaaaaccaaataccaaatgttattacttataagtgggagctaaacactgaagacacaaaacacaatgaagggaacaataaacactagtgcctatttgagggtagagagttggaggaaggtagggatggaaaaactacctttcaggtactatgctcactacctgggtaatgaaataatctctacaccaaatccccataacacacaatttacccatgttacaaacctgcacatgtgccccctgaacctaaaataaaagttgaaaagaaaaaaaaaaagaccagtgaattccataagtatgggtccattaccatacttcttttgctgtgaagttccttgatcagaagtaatgcgatgtgaaataaccatggaggtagataaggaatctttttaagttcacagatggtggttctgttagaaacattgcatgcaaaaaaggcaagtccatacccagagtaagtgtctattccagtaagaacaaaagtctgccccttccatggatagaagcagtccaatataaacaattcgtcatgagatagctggctgatcactgtggaaattgatgccatactggagactcattgttggtctccgctgctggcagattcagcactcagccatggtcatagccaagtcaaccttggttagtggaagtccaggttgctgaggccgtacataacctctgtctctgccatcatgaccactttcttcataagctcattgggtaatgacacggtggcttgggaaacagagcaaaaccaattgtcctatacaaataggcattccataagtgaaagaaaaggacaattattattacttctttttttgcataaaagggaaagagacagttgtctccttcttctccataatggcttccttaaaaatataatgagcctgagtctttacctccaccctttggtatctaaataaaatctctctaggagccagatactcccatttgtctcaggttttgtgacctgacaacgtctccaaggtctgaaagttcatttttttctgaaatacaaatacccataaagatagctttttagtccctcaggcaccctgaggattaacctagggaccagtcccagctgtaactatttagcctgcatagaagatataaaaggtattataattttttgagatcagagcagttaactagacaaatggctacaatctaattattatggtatatgaaaagtaaaatacttctgagggacatgaacacaaatactccctacttattttatacacatttccatgtctcaggtagctagggttttttgcagaagcactgagaaatccaagcaattttttatttttccaccattttctacccctagcctgcatctgtttgtttttaattttaggtttgggagtatgtgtgaagatttgtcacatacataaacacatgtcggcggtggggagttgttgtacatatcattacatcacccaggtacccaggtattaagctcagtacccaatagttattttttctgctagtctcctccttcctgccaccccccggccccaagtagaccccagtgtctgttattttcttcttggtgttcataagttcttatcatttagctctcacttataagtgagaacatgcagtatttggttttctgttcctatgttagtttgccaaggatgatagcttccagctccatccctgtttccacaaaagacatgatctcattcttttttatggctgcataatattccatgatgtatatgcaccacattttctttatccaatccgtcattgatgggcatttaggttgattccatgtctttgctattgtgaacagtgctgaaatgaacattcacatgcatatctttatggcagaatcctagactgcatctgaatcacctgaagggcctgtgaaaattcagactgctattccctcctgacccccaagcacaaacttctaattcagcaattcagaggtggtgtctgagaacctgtatttccaccaagctctcaggtcatgctgatgctgcttgtcaaggaccacactttgaaaactacttatttataccagtcataagtggcttcaggtttcatggagactgaaatttataaaaacttaagagccacatttagtttataaatgcaaggctagatttaggaaccgaaatgggcctttgcaaatcaggtaccataaagctttgactccattactccacagtaaatgttctgacaatgatgaaatacaatagaggctttaaaaattacctaatttacataaattttgtagatatacctgagattcattttgacaacataaataggaaataataacattcatgaaataaccactcatttacttgaagaattttaaagaaattatgaatgagaatcatcttgctctttagtaaacaaatgagagacagatctttatctttggtcaatggaattttcctgattgtacagtgtctaaaaatatttacacatcattggctggaaaactattacactggcatagaagaaatatcagcagctagtggctcaattgagggcacttgaatcttattcacagtatgaccatgcccaaaatattgaccttttatgaagctatatttcttttcactataaccaggctcaaatactattttagaataacaacattcaacaagcggttttgagctttcagtttaccagtgtgagcttctaacatacccccattttctaaaaatgaaagatgaaaaaaagctgtatgtcattttccccaaaatggtctctcttacataagaagaaaagatcatagaaatcattctttaaatcatttatgtttttaattttagaggccagttaaaacagaaagaaaaatgtattgaaatatgtactggtatttatattatttttaaaagcatatttaacatgtcttctaataaatcccaaccattctacagaaggtctcaaaatgtctttatacttgtaaaaatatcagctgaaaaatcagcttttttttttttcctgcccaggtctcagaaaaatgtcttgcaaaaaacaagctaacctcacctcttcaaatgtttcctgccaaccccattgatttcatggagggcccctgggttcggagaataaaaagcaacccagatggttttaaaaagtatgggatctgactttaaagtgtctaaattagatgagtgagatgcatcctaccctctacactgaacaaagaacaaatcaacacaaccatttcatgaaacttcaaaagcctgcagctttcactcaagctacaggttttcccactacagaatgaaagctacatgtgtccagttatggcagagttctagaataagaaatggacagaaaaatcaatttattgaacactctgacccaactttgaagtgcaatgtagcaaaagcattttagtacaaacctataacaaaggtctctgatcagcctacagaatgtctttgggtgtaataaggagcaaaacggaaggggatcaggaattagtgattatctgactggtttgacctacacagatgtcccagattttaatccaagccagagttaagctgtttgggtttttattttttatctgaaaaattctcccccatgaaaacagaggcagatatattcttgtgattattttctgcccactaagattacgtggttttaaagtcctttcaaacagtgattgaactggttgtcccggtaaacacactcagactgtgagcatccccatcagacctgaacttcctcagaggttaagattatattttattaatctatctaaaggacttcatatttcctggcacacaaatgggggagagtaattatttaaaacatgaataagtaaatacataaaatattgactaaattagaatgagaagagtaacatgcatataaaattttaaaattccagaataggttttttttcagaatggttgacaaataaatgttgtatctatacacagtggaatattattcagccatttaaagaatgaaatcctgtcatttgcaactacacagatagaactggaagatattatgttaaataagccaggcacagaaaaacaaattttgcattttcccactcatatgtaggagataagcttttttataaaatttgaactcaaggaggtggagagtagaatgatggttagcaggggctgggaaggagggcagggagaaagggataaagtggggatacttaataagtacaaaaatatagtcagacagaatgaaaaaaatctagcattcgattgcacaatagggtggctatagttgataacaatttattttatattttaaagtaactaaaagagtggaattggaatgttcctaacatgaagaaataataaatgcttgaggcttgaggtgatgaatacctcaattacccttatttgatcgttaaacattatatggctgtgtcaaaacatcacatgtagcccatatatatatatatatgtgtgtgtgtgtgtgtgtgtgtgtgtgtgtgtgtgtgtgtgtatatatatatatatataactattacatgccagaataattaaaaagtaaaattaaaaaaaaatgaaacataagttccagaacagtggaagatgatcaggataagttctctagtctctgatttttattattctaataatcaatctgaggccccttcaattgcagtcataggcccgggaaaatgaaaaagggagtaagagttgatatgcaattgggatgtaacaaaacaagttcatttgtttgcatgttggttaaaatccttgtaagcatttctcaaccccagacatttctacggatttatcttaaagtgagtttgctgtatactttttacctcagtatcttgaaccaaaaaatattcttaaaatgtcccggttgggactgacaaactcattttccattcaaaaggtgtgaagtttttatgtatgcacagacgtatttgcacatacatacacacacatacatacatacatacatgcatagttgaggttaagaaacaaacatgagagagaaaagggaatagaaataaacaaacaaatagaattttaaaacaagggaattttgaaagactcactgagaaaagtttcctttattatgccttagattaataataataataaggtagtttattccagggtttataatattataaatttcagaaaaacctggggctctatagttggatccgaaaaagcatccttactataaaaagcataatcagtgttcactggagtagtctgctattaaaaacaatttgagacttgcatttctatgatcattatgaaaaacagactaaaaacaaatattaagaaatactttattggtctgacctcaactgattttcttacttggtgcttctgagaagtatttatttatttatttagctatttattgctatgtgtatttgaacaaggtgtctccaaatatttacgaagaaaagcaatttagatttgttttgttttattctttggtaaatatagatgtatcttcataatgaagtattagaatattagttggcataaagaaatgtaatcagcattaactaaggatttgatattctcattgctacctaaccaaatgtttactgtctgactttgaacgtcttggtgtgtgttgattcagtaagattctagtgccttggcaagtagagaactgttggaaaccacacagtctgtatgtcagtcttttacaattgatacaaatagggccttccttacccaagagaaaatttaagtatcatttgtgatactttatgatgttctcataatatgcatgcagtactttaatgggattaatttaagggatttgtttttagttttacacttatcttaagttgtgttataaagtatgcattttcagagagataatcataattaaaagtttaaggcataatcatgatcaaaaacacttttggtataagaagaatactggataaaaattaagagaaaaaatatgaaacagaaaaactctttgttttcataaacccatacagctttctaaggagagttgaccttagtaatgaaaagattatttttttgttgaacacggagctggataagaatttcataggtgggataaattgttctctataataagaaagcagaatttccaatgccctggagaaatccaggaggcaaagatgctgaagcccagggagccaagatacccttctcccacatactctatcccatctcctcccctaacacacctgccatatgatgtgtgggagttaaaagagattttgaagagcaaaaggattttaagccattttctatgtgatacatgatataaacctccttgtctatatcatcatcagaaaataacacatttcgcaattaatgttcccattttattggtttctctgggggtatcccagagtggaattgaggtggcctttgacctctaagttttatgtgtattacagaaactcttacttgattttttattaaaagaaactggttataaattactaatagccatgtaacagatgtaaacatgcttgagccttacctgacatttaattgaatattgtgaacatgtataaacatactcaagtgtacacataccaaattttttaaaagaccaatgcaaagtgacaaacttaataattcatatcaccatgcacaagttcaactatatgcataggaagggcaggagaaatttcattccaaggtctgggcaatgtcaaagtaacctgtcagaacttcttaatgcattgatagtttccaatgtgtaaaactgtgatatatcaattttaggtctctctattttaaaatgatttttgagacaattcaactatatttgaaaatgaaaccaagacttttgtggagtccctcaaacatggacttgctaagaccagaatttgaaacaactttgctcagcgatgcaggcaatgaagggtattgcaaggcatgctaccttctcagagagtataacccactgtgctgtggaaatcagagtcttgcttaaaagcacaaactctgaagccaaactgcctgtatttaagtctcagttctgtctcttgctaaacatgtgatcttaggcaagtttctcaacttcttagtgcttcaatttccccctctttaaaatgaggataaaaatagtacttacggcatagggttgaaaggattcaatgaattaacatgtgtaacgcatttggagaagagcctggcacattttaaacactagatatacattcttacttgattagtaagtcatagtcactagcttcaagctctacagggacacttactccctttcctctctccttggcctaggactaaggtctccagggtaaactcttaatgtttttcagtgccatggagagaaagcagttatagggactgctaccacaaaaagcagagggcaaaagacactttcagagaactcatcaaccttaatcttatgtaatttacatttaagctatcatttagagataaaactattttaaaagacaagcaaatgaaattacaatttagttcacaaagctactccagagtcaattcatcctactagagaattactaagtgcagaacatcttattagtatatctcgtttaatatgcatacaaaattacatattttctgcctctttggaaataagctatcttccacccagaatttatatggggtgagcatgggacccagacctgactagtcaatagtacaatcccccagccacaaaggtaagttcagagttgggcatgacacaaggcctttcagaatcctttctggggcctttgcaaccagggctatcaagaaatctcatctatctgctaattgtctacctctgtcctaaccgtagactggaaggacttgaagcaaccaatcaccatcttttccagaaaccttgaaaatgtttcttcaaaagctgaaattattttttaaaaattcactgatatataaacaagatgaaaattatgattgagaatatgtgaaaattttatagcatttatgcagaggaattgtgatacatgttagcagttttctccactcacaatgcagttttaaaactactaatacaatattcggtccaaagcaagcatcaagaaatagaaaatcaccatatgcagatttttgatgaacatataacacatttagtttccattatattgtgatgtgatgagttcattatgtattggtgggaaagaaactatagctagagacaaaaaatggatctcttcagtgagttggaaatcttacaaaaatgtacactgaaacgttgttctaccctcctgaaattcatagaaattagccattcagaaaggaaagtactgtgtaaatttgtaccaattcaaataaaagagtagatttcataaaacaatcaggacaattgacctagactttataaaatagcaacactaaggtcactaaatataagaaactttatctacatctttttactagaagcattctagagttctctatttcatcactttgtgctttttaaaaagatattcttcatctgaaactattccaatgaatataatattttaaatattcaaagtaaaaatgataatgcatatatatatatcaaaaataatggactcaagatgtataaatgaatatacataatattagagaatgtattttactctctcattaaaaaaagctttcaaaaagtatcatagattattacagattgagccctattttctacagtttttataatataattttctctgataatctaaagttactgtaagataacagtatatttaattattcgggcaaagactgttggtacatcttagtctgataattgatactctgtattcaatgccatattcttccattaaactagaacttgcatctcaaatcaagagatatgtactgtaattgctaacacagtcatcaacattccaggattttggaattttagtacattagctttcacagtgaatcttctttatattatggtataatcactacaataactaaatgaacttttacttttgagattttaaaaatcaaacattttccaaacaagtagtaagatgtgatgaataaaactagcgtaaaacttagtaacttggttaccagttatatcttttccacttatgagctttacgagctctgtgactttggagaactactttaaattctcagaacttccatttgcttctgtgtaaaatggggcaccaataattacccagacaaactcacaaagtggctgaggaaatcgcagtgagaaattatatatataaaaatacttagtacatccagtatttcacatatgtgaggcacccacacagtacttgacacataaggaagtttccacaaatgggagtactattgtgtcattacacagatgtaagagagaagcaggcagtggaggatgagagttcccaaaattgctatggtcttatacactctgtttcacaagttgtggtctgtcctgcctcacaaaattggtcaaggtttcccatatcattactgctaatcctgtatgggaaaaggtaggaatataccagatgaaaaatacaatgtatacctatctttgttgtttcccatatgcttcatttgagtttgagtactgtagctcttaacagcttataaaaatgccttttattccccttttgcagtgataacatgaatagttttaagagctataaaaagttttaaataaaacatgtaggcaaaaataaaaggcatattagttgaaaattattttgtcacatatattaaatatcattacaaaacatttccataatagaaaaacaaggttatgtggaacagtgttttgtccatctaattgttacgttttcatagtctcttttttatccctacgatatattaaatctcaatccatgagccatcagaaattccttcaaatccaaagaacctgaagaggaaagggaaataacatggttaaatattcgcagccttatatcattttctcttggttgaatgttctcgtctaacaaacagaagctcactgagggcaaccttggtatctaagcctagcacaacaccttgcaaatagaaggtgttactatttgttgataaatagagtaaaagtttaggttgttatttgtttttgttttcatggaggttttattgttttatttttaatttatacagcagagaatacaactcattattgaccagatgaacaggaaaatcatgtttcttctggaaaaccacaccagtgctacagtgaggcaaatgtgtgtgaagtaatggaaaaaacactaactagtgtccaaaaatctggggttttgtgctcattctcaattgatgtgtctcctcaggcaagtcacttagcttctgcatagatctctattttatcacctataaagtgaggttaaagccttccttatctaccccacagggctattgcatgtaggacataattgagatcatgtatgttaaaggactttataaactacaaagtgcagtgacaaatggaaatgagtctaaatcttcatctgctccctgatttagaacaaacatgatttgtcacaagcaaaggtctattatcaggcaaaatacattttatagattgggacacacctccctcttttaagtcagtggagtagaggttatacagactttcttaccatatcctaagacactgtagcacccagaaacttgatttataattctatgtagtaatggagttacgtgatctcatattactcagaactgcaataagagtttagggtgcatcatttcctggtatcctctcaatttatatttatgtactcttctttgtaaacagagaaatgccagccaagttaaagtaaattggggcccggcacggtggctcatgcctgtaatcccagcactttgggaggctgagtcggccagatcaccagaggtcaggagttcaagaccagcgtggccaacgtggcaaaaacccagctctactaaaagtataaaaataagccatgcatggtggcaggcgcctctaatcccagctactcaggaggctgaggcaggagaattgcttgaacccgggaggtggaggttgcagtgagctgagattgcaccactgcactccagcctgggggacagagtgagactctgtctctaaataaataaaaataaagtaaattggaaccgtaagcaaatgttggtctgaatatgctgctacaatgttgagggagaagagttccagggagccgattttgttggctttgtaatgcagcacccatcatcctgcttctctgtaccctctcattcttatggctttcccctcaaacatctgggaagcagcaagtaacaatgcccccgacagtcagtttgagttgatggagctctctcaaggacctgcttgctcatataagagttctcaggcagttcctctggaagtttcccaagaagatatgcatttcacatctacttactgtctgtctgctagatgtcaagcactgtactaaatgtgagaagacagacatagaatgtgacacagcatatgctcagctgaccagtttactataacgtgaaataataatcacggttaatacttactaagcacctattaagccagtcattttgttaaaggtagttagctaggcatgagcagggcaggagagggctctccccaaaccaataaaaatgtggggcgatggtttggcaattttcgcattgcctctctaaaaataataattcggcggccgggcgcggtggctcatgcctgtaatcccagcactttgggaggccgaggcgggcggatcacaaggtcaggggatcgagaccacggtgaaaccccgtctctactaaaaatacaaaaaaaaaattagccgggcgcggtggcgggcgcctgtaatcccagctactcaggaggctgaggcaggagaatggcgtgaacccgggaggctgagcttgcagtgagccgagaccctgccactgcactccagcctgggcgacagagtgagacttcctctcaaataataataataataataattcggcacccagggagagacaagctcctgacggtccacacctgttaacattagaagtgttcattgaatacaggccccccagggaagaagcttcttcttgggcatgcgtgttaagagacataatgaccaagtatgacgttccaggggcacgcgccactggaaaaaggaaaaaaaagcctcagatgggcatacctgtaactccctaaatacacacgtgctgaattccaaagggtaaagaaagcactgtccatgcgggaagcccaccctaagggaagaatcatgggaaagaggcggcctataaagtcttaggatcaaggttaaaggctctctttttctttgcccttttttgctatcttttttctctctttgatcttcagggcgcccacttggacctcttataagagctcttttctttctttcctgttctgaagtattttttaataaacttccactcctgctctgaaacttgcctctgtctgaaacttgcctcagtctctttttctgcagaatgttcctcagttgaattatttcttcttgaggaggcaagaactgaagttgctacagactcatacaaataggccaccagtaactctgggtaacttggatctcttccaccagcaataattttaccaagatctttacatgcattaaatttttcaatccttgcaataatctgatgaagtagatactgttatgattcccatcttacaaatgagaaaaacaaggagcagaggtgtaactacaaagttttccatgtttagaaggggttggagctgtaatttaaaccagagtatatacattcttaaactcagaagcctatggagtgtaactatctctcccttcaggcaatgtccaactttggtcctcaagggaatctggccacagaatacaattcatctacatgacctccatggaacacaaggggatatatgccaatcaaaagaaagggaagtaacattttgagtacctattgagagctgtgggtaaaacaacggtccaggtttgatatcattttctctattttacaaatcaatgagcaggggctcagacaaattggccaatctaattctaacaatcaggtctcttacatcacaatgtgatgacaacttctttcaaaaccccacatcagtcataaacaatgatgtaaataaaactctaatgagaaaactccagttacccatcgaaaagaattaattatattcctcaaattgccgcttttacagcagagctaaaagtatgttttagaaatgaattgagtagacatgcacttgctccttggcacttgaggaacaaaatatgtcacaaatgaggggcaagtgaaaactttgattttagtcatttctatagcttttctattttctgagcgtaaaccttcccgaggactctggatatgcttaaataagtctactagtctctagtactgccacttgctcattctctgtgtattctcgggagtgtgccaagcttcagcaaagaagcagtcaagcttccaagacaaactactgcataccaaagacactaatgcccaatctctacaggctctataccactcaggggaacagaaagaggcagaatcctacccaaattgttctattaaaaaggttttaatgaaggatatttacaaaagtgtggccaagattaaagaaacccacaagagaaacccagaaacttgcagcagaagaaagaaagcaataccatccattcccgagcctaaaggagcaagaataagaaatcgttttacattaataggatcccagtgagagctggatcatggaggaagggccccagtcagactgatagaaggacacaaccacagtcagagacatagaaccaaagagaaagagagcaaggaaaaatacatttcttctctcctttccagtcctctcacctgccattgccttccattggctaaacaattagccagctggcaatagaacctgaggagaacataaaatgtatagggtgggagagctgttgggggtaaacagcatggctccctaaaaagagcctggttattagaacactcataacccaaatcctgttcctttagtctcagggaaattaatctcatcctctgtagtcttcagctccacactgaaaattccatctttctgacctacagggcgaagctagcctctacctttaggatcaatgtctctcttcaccaagaagactacctccttggtggctcttaaaacaaaaataagttgtaaattccctgtggcacaaggaatcccagaatagaaatacctattcttttatcttagtgagtaagtatacaagtgtgagtgtgtttagattgagatgtgaattaaaatttttttaaattttcctagagaagtgagaataagacaaattgatatctctcaatatgttaaaattgtcctgcagaagaagtttcacagaggaccctatttacataaggataaacagttaaacctatacatgaagttagaaacccatatggtagaatataaagaaacacacaagggaatgactacacagttcatatgctccactagcttcctgaagttgttaaaacatgaaaagccgattcctagcactctcaggcaaatgtcttacatggagagttttgttgattgacttttttgaaatacttacattgtcctgcagagttggtaacaacttatcattttatgtgttttattgtttgatcaattggcttttaccagtattttgaaaactatcaaactctgatccaaggaattttaaaatgttttttccttcttattctctattctctgtaaaaatacacacacagctgagatactatggtcaaagcataactggcatttgtgactaaagtactgaatccaaatcaggagtgagtgcaagagaaaaaaacaaagtttccatgggctgtcaccaatatcagggctgaattctccagaattttaagaattaatgaccttgaatcattgcaagagttttattttcaaatagatacttaagacttaaaattatagattatgtttctatgaataaaaagtgaccttttatggcttcttttccaaaacttcactactttattattccagtggtctctcaccccatgagtaaaaagtctttaactgtgtgctggcattatatttataaatgatttatgagtgattaacatgcataatcatttgctaataatatacaaaggaaaaatattaatttagggtgggagctatcatacacacattctagtgatttttaaatctacatataaaataatgtttcttactaattttaattaggagggaggcaagtatgtcaaatcctatgagatcgctatttatttatctcttaataagaagctgcccaatagcttataccacaattgaatttgtgagctctgcctttttttcacgtttttgtttacttatgtttcattgcattctttttttttctgtataggaatattttcaagtcatttgcccatacctgtgaaggttaatttagttagtgatatgcaatgatttgtaagtccactcagtcaggcacatatgagttttaatagatcaccaaatattcactgactgatatgaatatcactacctaccacaaactcccaagcacacaaaccaaaaaaaaaagagagagagcttttgtcatatttcaaatattaacatatttttaagtgtatatatatagttgattcttattatttatggtaattatgtcttgtaaagtctgaatactacttcagcaaatactgaaccattgctcttatgggaaatgaaaggttaggttcctgtaagtctctgtttacagtttcaccaactaatcaatacataaccttgttttatgtgtgtttcatttaaagacaccttatttactatatattgttgattcattaacaactgaattaatggccaactcattgaatccatgacaacacacctgaaagaagcttatctaacaaacaacaaatattttctctgtaaggcacaccacagcctgcttacacttaggaacaacacacagaacttcagcttttacattcaggggccattttgaacagcaataaccaagaaaaagcacaaaagtacaaaaacatggcacgaaaaagactgcataaagtacatttgctgatagtatgagagctgaaatgagaaggctgagcattgcgttgtttgaatttagctgggaatggacaagtcaggcaactcaaaatttttgtgactctgtacatgtctgcaaataaccacaaaagcacttcaagtgttgattatggggttacaaataagaagatatgattctatacctagaaaatcctatagtctctgcccgaaagctcctagaccttataaatgaattcggctaagtctcaggatacaaaatcaatgtaaaaaatcagtagcatttctatacaacaacaacatccaaactgacagctaaatcaggaacacaatcccattcacaatatccacaaaaagaataaactacctaggaatacacttaactagggaggtgaaatagctctacaatgagaattacaaaacactgctcaaagaaatcagagatgacacaaacaaatgaaaaaacattccatgctcatggaaaggaaaaattaatattcctaaaatggccatatcacccaaagcaacttatagattcaatgctattcctatcaaactaccagtggcattcttcacagaattaggaaaagaaccatttcaaattcatatagaaccaaaaaagagcttgaacagacaaggcagcaatcctcagcatcacattacctgacttcaaactatactacaatgctacagtatccaaaacagcatggcattggtacaaaaacagagacatgtaggccaacggaacagaatagagagcccagaaataaaactacacacctacaaccatctgaccttgacaaagtaaaaaaaaaaaaaaaaaaaaaaaaaaaaaaaaaaaaaatgagcaatggggaaaaggactccctatttgataaatggtgctggaataactggctagccataagcagaaggttgaaactggatcccttccctacacatatgcaaactcaatgcaagatgaattaaagacttaaatacaaaacctaaaactatataaaccctagaagataacctaggaaatgtcattctgacataggacctgacaatgatttaatgacaaacacaccaaaaacaactgaaacttaatttgacaaatgggacctaattaaactaatgaaagaactactacacagcaaaagaaactaacaacagagtaaacacacaacttacagaatgggagaaaatatttgtaaactatgcatatgacaaaggtctaatatccagaatctataaggaatttagtcaattcaacaagcgagaaacaaacaacttcattaaaaagtggacaaaggacatgaatagacgctttcaaaagaagacatacatgtagccaacaagcattaaaaaatgctcaatatcactaatcattacagaaacacaaatcaaaaccacaatgagaaaccatctcatacaagtcagaatggccatcattaaaaagtcaaaaaataacagatgctggttaggttgcagagaaaagggaatgcttatatactgctgattggaatgtaaattagttcagccactgtaggaagcagtttggtgatttctcaaagaactcccagaagaattaccattcgacccatcaatcctattattgggtatatagccaaaggaatataaaccattctaccctaaagacacacacatgtatgtttattgcagcactattcacaagagtaaaaatatggaatcaacctaaatgccatcactgatatactgaataaagaaaatatggtacatatacaccacagaatactatgcatccataaaaaaaaaagaatgagatcttgtcctttgcgacaacatggatagagctggagatcattatcctaagtgaactaacatgaacagaaaccaaatactgcatgtccttacttgtaagtgggaactaaactttgagtacatattaaaacaaagaagggaataatagacccaggtcctatttgaaggtggagggagggaagagggaaaggatggaaatactaccaatcaggtactatgcttattacctgggtggtgaaataatctgtacaccaaacctctgtgatatgcaatttcacatatatgtagccaacaagcaacaagttccattggtctgtgtctccgtttttgtaccagtgccttcacatgtacccctgaacctaatgtaaaagtttttttttatatttttttaatttagctggtaggtaaatccccaaatacagaatccatacatgatgacaactgaatatatatattgaacttttatcaaggctaatataattgcagttcactttgaaaacccctatactactctattagtctccaacaggtgtgaatgaaaaaaaaaaaaacctggatagttgctgcaaaacatacctccctctctctttcccctccatatatcatctgattactcacattactgtgcatagtagggtttgttatttcacgtagaaaaaaaaaaagaaaatttgattaattggggactgcagaagggatagtggatagaggttcaatggattatataaaattgttttcacatagttctcccacgtttagaagagagtgatttctgagagtgatggcaaaagtatttgctaggacggactgtgcaatgagacatgctgggcaaagaatgaaggctggaagcacagaggagctttccagagagattttgtcaactctgcgtacagagccaagtgataaaaatggtgtaacatggccaggcgcagtggctcacacctgtaatcccaacactttgggaggcagaggcaggcagatcatgagatcaggagacagagaccgtgctggctaatgtggtgaaaccccgtctccactgaaaatacaaaaaattagccgggcacggtggcacatacctgtaatcccagctacttgggagcctgaggcaaggagaatcgcttgaacctgggaggcggaggttgcagtgagtagagatcaagatggtgccaccgcactccagcctggtcgacagagtgagactccgtctcaaaaataaaagaaaaaaagaaaaggtgtaacattggagaaaaggtcgtttttgcctgttccatctatttctgctgaaactcagcagaacttccacactctgaagactggatgtttgggagcatctggaataagcaccttggaatgaacattggctttgtcgatgcagacagggagagcagggaagctaccccgagtcttcagtgagatgagtgggagatagaacaagagcagaaaagcaggtaggaggcaaagtggtaaatcttggttttccaaattcatacctagacaggtaatcctttgaggacacccataaataattgtaaacacattgaagttgatgattttgtgacaaccagggtagtgggagtttgtgctatcattatttggtctttcaagtaaatatagggtttgtcgtattcagaatacacagagaagtttgtctctgatttgtcatggagttggatcaggactgagaacaggtctttagagttgccaaagagaatctcatgttaaatattgaaaaagttcttttgatggatgttagatcaggcagtaaaagtcacactgctgagaaaaatgaagcttgcaaatgacatcatttcaagaaatttggtaaagccaagaaagacacatctattgactaacgagaattcatactcagaaggaaaattgtacaaattaaaattaggacattctaaccatgtctctgaatgacaaacagcaagttgttgatagataagctgaggttaaaaatgttaggaaaacaaaataaaggaaataattaacagattgccttatattttaagtataagtgtgtgtgtattatatatatttatatttttgccatgttatttgttttttccttcccctcccccacagctttacagttataattgacaaataaagattatatatatttacatatacaaagtgatattttgatttacatgtatacattgtgaaatgattaaaataagtgaattaatatattcattttctctcatacttatcaatttttttgcagtgagaccacttaagatctactcttttaccaattttcaagtatataattaatacattaatgctaattatagttaccatgctatacaatagatctccagaatttatttaaaaaatggaatgcttcacgaatttgaatgtcatccttgttcaggggccatgctaaacttctctgtatcattccagctttagtatatgcgctaccaaggcaagcacaagtatatatattttaaacttggtaaaatttcacaaggacggatcatttatgtattcactcattcaaacaacattcacagggcactaatctgtgctagacatagtgataccaaagtgaatgaaagagacagaatccccaccccattagagttaacaggtcacagagcaataaagagctatgtgcaatgcagtgtaaaaagtgttgggatgtggaaaataccaggccttaaagcaaataggaaacatgcctatctcatcctggagaatcaaggaaagcatcatgtaggaagaaacatgtgactggacaaaggtagggctgatccaggcatgaagaacggaaaagaggactctggatagcaaacatacagtagcttggaggggtgaggccaatgtgtacaagaatagcaggacagttgttgtttctgagaggaagagttctaggattgaatgataagagatgagttggaaaagaagcagagggcatgcaaggccttataaactatcttaaggtatctggacatcattcaaaatgcagtgaggagctcccaatagcttttaagtagggaaataacataatcagatttgggttttagaaaggtcactgtctgcaacttcatcactgcagttttccatttaggaatctttggtgaaagtgatccttcatttgaaagctctacatgtcagaagcatattctggctcagtgtgtattttgcttagggactcctcatcatcaacccattaagagtggactaaagaaacaaagccaaggagacactagtgattaacaagagccacacttaaattcccaaggtccttaaatactacaggagaatcaaatgtgaataaattttcctgatagattgctacagtaaagcatttttttacgttcttacagcagcatgatgccaagttttgcaaatttccattatatgaccctgatcacaaagtcgtccttgagaatgaaacaatacagaaaaggcaaaattttataatacattggccataaatggatcttaaaaagaaaaataacaatgtcttttttgagttaagtctttaggacattttctaatcctggggcactgatcgagatccttagatgtagtttcctattgtcttgactatgtagtcctccatgtcctgctaatatttttttcttattaactgtttgatacatggaaatcaatacgggcaactcacagaccttcagaaagccaaaactacttgctgggattttttgtaactattcaaaatttttcattattcctacagtcctcctctagaaagtttcttgaaaggttttgttacttagggagctgcgtatggacaggtacattttacgagactttgttatctcatttacatcacaattatctccctggtacattctcttgtccctccctttccccactttgtcccctccaatacacacacaaaaaccaattttacagagaactcacaaagagcttagaataaaagtatttctgctacatttcattttaaatcatctgattgaaacagagaatagtaatgaagttatccttataaaacataatatttcttctacttctgtattgaaggttgagagccacagatatataagtaaccaataaaaatttggacaggaaaatgatgggttagcaacttccttaggctgtgttctggaaatgtttacatatatacacatatacatacatacatatacacatatacatatacatatgcatacacacatatacatatatacatacacatatacacataacacacatatatgtactacatatattacatatacatatcacatatatgtgtatatatgtatgtataaatctatatgtatgtaggtatatacatatatacacacatctactttttctaatttcctgaccgttccattgaatgcttcacatgttcttaccttaatctttaggcctaattttgataattgtcatattatgaatatatgtatttttttgcgttaggcctggagacttttagttatatgtattatctatagagagactgacctaattgtacttcaacttcaataaccattgcatttccctaagtagatgtaagcaacattttaaaagggcccctttatcttaaagaagtagatgaaacgctggtaactgtgtaataaaatttaaataacctctatggaggcattattttgttacataccattttgagttttaattgaagaaaacagctgactaaattgttgccaaaaacattaatgggactattgttgtttgatgaaatttcattcgtgtgtgtgtgtgtgtgtgtgtgtgtgtgtgttacctacaatgtacttgttttcctctttttcttctgtaaaacatgactgagaacacataaaatcagattggaataataatattaataacaataataatagttaccatatatttgatgcctaccatgtgtcaattcattctccacctaattttcataaaaatccaaactccttttcatacagggtcacacctaatccgaccctaacaccctcactttttgacatactctcaggccttgaagattctgttttcctggtaaaggacaccaattttttaaggggctaaaggcagaggttaaaggtgaaaagctgtttctaatctgttaggtctcgacttaaaggatggctaatctaatcatcccacttgacatagggatttatagttgccatttatctcaagaccctgtgtttttcttttaatttatagctattaaaaattaatgattgtgatatttgcacctttactttttttttcctgtttccagccagactctaagctccactacagtatcaaagtgcccagcttcatgtgtggcacattagttaagggctcaattacatctgctgagtgtataaaagggccctgttctgggcacctttcacatagtacactgtctgcagatgagaaaactgaagcacagaggagtatattatatgcattatattctggttaatgggcaacagaggtgctatgaggggaccacaggtctctaccccaaggcctttgctcctctgactccacccaaccacctccaagaatcaaggcctgataatgacagccagtggaaatatggtttggcaagaatactctacagttggattttgaactctgctaacttgccaatcactattgtgtactgagaattttcattggtctttcattgtacatcctgatctataatcagacatggaaagagaagggttcttgagcatctctttacccagttttgagctgggacaattcctgacagttattgacctcccttggattttttgttctgtactaaggcagaggcagctatgaggacagccaagcctttgatttgagtcatacccagctatcaggaagcagatggatagggaacacatccaaactgctatgctttgtcatgacttgatttaagcaataactattggcttatttaccaatttccaaacagtgtttattcaaggaactacattttctcatattctttctcaacttcacatttcttccttccctaatacttaatgcctggtccatgaccattatcaaaagcaaatacagccctgtaagtacaacgtgacaaggcaggattcaaattggcttactaacaatacttaattctatggattaaagacataatgaaatgatatttgacaaacatgtattgagttattctcaaggttacctatgtcaaaggaaacaagagctggacagtagttaagggctgcactcaggaacaactgcaatgggttgagggagacttcagcaaagaactagtctccattccaaacacagcaaagacaagtggggctttatagtcaaggagcaggctgaggatcagcagatagaaaattactaagagaaaatatccaggccaggggtatttttggctaaacctagttgacaagattcttgctgaaggtaggcctgggtgataagatattaagcatggggaatgaggatgttgatcagatattgaggataggcaattattgataaaatgacttagcaacattcttgctagaactgggcaatgcaaagatgaaaatggacaccctataaggcctagctgagaagaaagttcagaggagtctgactaaaggtaggttaaggagagagtctttatcacctagtttgtctgcacaccatctaatacaacttgccacagcaataggggagtttttctcttcctagtgtctaatagtcttaattttataatttgcctttattacttcatataaaaagataaaacttttagtgtttacatatgcttgggcactatggtagctattttagacattgtaaacctagctcaatggccatttagaatttactttaaaatattgagtgctatgatccaaatatttttaaaagataagttgtaaattttaagcgtaagtaatgattgaaatcaggcttcctaatgaacccaagtgatcctaaattgccaacatagatattctttttttcaaaaggattttatttctggaaactcatggctactctctctgcccctgggcctttgtcagggacatgggatgtaccctggctcatatccctaggcacaagtactagggagaaagttaggatatttgttccttccatttcagaagactccaaagttgtttaatttgaactctctctttccagagttcagcatacttgagcaagaggaattattatcaaaccccttaagataaaatatccaattattccttctctcctgacaaaggatagctactcagctgaaatgtgcacaatcagtaaaaccacactggaggtctttcaaagggcaaagactctcttctctaagatggaagtggcaatactcctttaagctagttctatattttataagataaatttttgttgaatctcgaagcaaggaatgcttattcctctgataatgaccaggataattcctttgtgggaaaaatactcattttaaatggaacaatcaccttcaaatttttatattcaatacaagttgaaaattctctttaaaataaggtaaagcgtagcagtagccaattagaaagcaaagaactaaatgcaaaacttatcagttgtataaagttacctcctatcataaaaagaatcctcataaaagatcagacctagttcctaggtcaatattcaagtcttataaatttagatatattaccaactggagtatgacaaaaccccatcttaatatttgaatccagattcaccataaagcccaacagttacaaatgggttcatagcacattatgactaagaagtaataaaggacccaaacttctgattgttaccttaaatacattaataaacaggaaaaaagtaagcttttttcttagcataaattaaaaatattttttcaatgaagttcttctaatagctaacaccttcaatattgcagggaaaaaatttaattctatcaaaagtacagtttctatatacaagtaaatattctcaatacaagtaaatatttaactctcaggggaggcttcaagatggcagtctaggggtattttgtattcacttcttcccccccaaaaaaagaaaaaaaaatagcaagtagataatcacactttggaaaacccatccaagagagaacactggaatttaacagaaaagtgacaggcaatatctaaagcaagaaaggagaaggaattgaggcagcctactcagccaggatctgctgggagccaagagaggctaatacagggaaagtgtaagtgagagaccctcagcagtccacattcccaccatggactcctgcaatcctgatcatgggacagccccttgactctcttgggccctgaaactaacatagggagctacagagagatcatacaaccacggctctgccccatggaggaagctcatgctggatctctcacattccctgagaccttagcagctacagcaaggagccgttttagaactccacccctaacacacagcacactgtcctggagcccagtggtgctgcagctgaggtgcaagacaagcattggctgctgcccgaagggctgaagcacaagtaccataggctactgcacatggggcagaggtgcaacagaggtctgggatattctctttagaactgaggtgcaagtgaaacacaattctagagccctgcacccgtatactgagcactgtcttggaacccagcagtgctggggcggaaggcccagagaaatgacagctgctgcccccaggacctaggcatcagcaagtgtgggctgctatacatgtggaagtgtcaccaaagtgaaggctaccaccagggctgagcaaggtgccattcagagtcccacccccaacagactgaggactactctgtggcactgcagtgctgggactgagactcaaaagaagatctgactgctgacttcagggctgaggtgcatacagttgcaggctaccacatccaggctgaaggatgagtgctcccaggaatgaagtataagtgacatgcatgctccccatccgacagcccagccactggtgtctcccaccctagccttccactggtggcctgaggattgccccacccctgcctaccatggctagtacctatacatatcatcagggaagctgagggcaagcctgcctggcacagcttcaccccttccaactgtgacaaagcacacagtctagggggccacactcactcagcccagtacaccattgctggcactggaacactcctcccatgggcctacccacccagccactaccaccacagctggggcctacctgcatacaccacatgcaggcctggagactcagccactcagcccattgcagccactgccaacaccagcctgcaccactcaggaaccacagggttgtcttgccactggcactgccactgcccatgccacataggatgcccaagggccccaaaacctgcccacttcccagcccacacctgccatactgggatctgagtaagccacctggagtcccaagaatcagcccaccaggaccctcaaacactagtgctacctaagccattctggggcccacagacaggcaagctcagtccactggagccaccactaaggtctgaagcctggtctacctggcatccaaatatccagcaaaactgtaccatagcctccactaataattgcaccctaagcaattgaggaaacctcagattctactgatgctatttacagccaaagagattatacagagtctacactactacactcatctagcatgaaaaccaaagtgcactaccctatcaacaccatagattcaaaggaagtggagggtatgggagatgaaaaaagtagattaatgagtactaacatattgttagataaaggtataatttctgccattaaaaagcagggtagaataataacatgttatatatttcaaagtagcaagaagagagaattcaaattgttcccaacacatgcaaatggcaaatactcaatgtgatggatactccaaatacctgactggatcattacacattctatgtatgtaacaaaatatcatgtctatcatataaatatgtaaaataatatgcattaatttaaaaagtaaacaaaatgaaaaaatatttaatttatatacctttgaaaaatagtaagacaaattagacaaatagttcatcttaaatcttttagtattcttctataaggaaaagaagtgcttaaactaagcaaaaacaatactggatttgacttttatagaatattacctataaagagttatcctacctggaaaaaaacgttaaattgtaggtggtcccccaaaatatttcacaatatttctgttactgatagaggaagaagattcttagtgtttgttggcatttaaaagtttgaaattagactttagaaatatcaactaacatatcactccatcaaattggtttctgggtagctggtgattttgtgctacaaattccatgctgaatgctactaattttatgtctctttcaaagatcagagaagcttttatagacctccccagggatgtattttgaaaataaaatgagaaaatgcttctgagaaattttttaaaaagaatattggggcccagtatagaccaatgttgaagaggaacattacatagcaaatccactacagcttcctctcagctataatacaatcaacaagatggatttgtcaaacttctgcttatcagtgagcttctggactgtgttcagtcctcaggatatactcctttgcaagacacaaaattaatcactacagacattgaaacactgtatcatgtttatatagcatacactatatggcaagtgttgtaaatcttcatgtatattaattcatatgatcctcatcacaattctgtgatatgaggttaatagtaagcctattttatagatgagtagactaggcactgagaagttctagcaactttctcaaactcacacagctaatagatagcagagtgggtattttttccccaggtaatttggctccaggacccatgcttttaaccagtatattaatatagagtgtcttttctgatcttgcctttttaacccttgatcccttcctctgttcccatagtcaccttctggttccacacttgctgctcctggtttgcgtttaccattttgcctcatttacatttgaaaatccatctgttgccaatcattatgactagggtgatgatacatcctagtttctccagtatactcagggtttctgcttgttgtattgatatcataattcataacacacatcccctccctcgttaattctcaaaattttcagtgtgatgataaattttatggccaccctagtcatgactgactcaaaaacttcattaaaatgttttggctggaagctcccatcaggctgcagactttataactggggccacataccaccacctattaccaggactctccagtattgccaacagtgtccctgaaaatggtcatgcaaatgatagttacttctcttgtctataaaaatgagataataaatcaggagaggacagtgtaaggtataacatattattcaatctaactcttacacctaaaaagtcaaaattagataaagcagattgagtttgtttgaaaaaaaggcagctgaggaatagggaaaaactaagagatggaactattataacactcaaagccttagattcccacaaaaacccattataatagaatgaataaacaatttcatatatatatatatacatatacacacatatatacacacacacatcttttttgagatggaatcttgctctattgcccaggctggtgtgcaatggcacaacttcagctcactgcaacctccggatgcaagcaattctcctgcctcagcccccgggtagctgagatttcaggtgcccaccaccacgcctggctaattttgtatttttagtagagacgggggtttcaccatgttggccaggctgggtctcgaacccctgacctcaggtgatccacctgcctcatcctcccaaagcactgggattacaggcatgagccactgtgcctggcctacaatttcaacaacattgaaggacatgaggtcagttctcaaaaatcaattgtattttgatgcactgtcaataaacaatctaaaaatgaaatcaataaacaatcgcacttacaatagcatcaaaaataacagaattcttagaaataagtaatcgaggaagtgtaagactcggacattgaaaatgataaagcattgaaaaaactttttaaaaattaacaatcatttattagtgtttgtgaattggaagacttaatattgttacgatactaataatccccaaattgatctacagattcaatgtaatttttatcaaaatcactgcaacctctgcctcctaggttcaagctattctacttcctcagcctcctgagtagctgggactacaaaccacccagctaatttttgtatttttagtagagacggggtttcaccatgttggccaggacggtctcaatctcttgacttcatgatccacccgccttggcctcccaaagtgctgggattacaggcgtgagccaccacacctggccgaaagctgattctaaaattcatatggagttagaaaaatccagaatagggaaaacaatttgaaaaaaaaagggacaaatttggagaactcacccttcccaattttgttacctacctacaaaactacaacaatcaaaacaatatggtattgacataaagacagaaatagagattaatggaatggaattgagagtacaaaaataaatccttatgtttatgattgatttttgacaagggtgccaagacaattcaacagagaaagaagagtctttttaacacatggtgctgggacaaatggatattgatatataaaagaataaaattggaaaagctccctcacaccataaacaaaaatgaactcaaagtagattgcagacttacatgcaacttctaaaactgtaaaactcacaaatgaaaataggtaaatcttcatgaccttgatttgtcaacaatttcttagacataacaccaaaatcacaagcaacaaaagaaaaaaaaagtgaattgtgcttcaataaaattaaaatattttgtgattcaaacatcactatcaagaaagtgaaaagacagcccatataagggaatagatatttgtaaagtacatatctggtaaggaactagtacccaggatatattaacaactcttacatctcaacaataaagacaaataactcaaacaaaatgggatttgaatagagatttttttgaaaaggatttgaatagaggttttcccaaagaaaatatgcaaatgaccaataagcacctgaaaagatgctttaacatcattagtcattagggaaatgcaaataaaaatcacaacgaggtattaaccacttatcagatacatggtttgtaaatatttttttccattgctttttcactgtattgtttcctttgctgtgcaaaagcatttaagtttgatataatcccacttccttatttttgcttttattgcctgtgcttttggtatagacccaagaaattattgccaagacagtgtcaagaggattttcccctatgttttctattagcggttttataatttcaggtcttatattcaaatctttattttaagtttttttttgtataatgtaagataaggatcaaattttactcttttgtaggtggatattcagtttttctaataccatttgttgaaaaaaacaatcctatcccaattgtgtattcttagcacatttgttgcagaatagttggctatgtatgtgtgggtctatttctgaactagctattctgttctatttgtctacatattgcctttatgccagtaccatactgttttcattacagtggtttcataatatattttgcaaaccatatttctgaaaaggggttaatatccaaaatacataaaactctcatagctcaatagcacaaaacaaataaactgattaataaatggacaaagaacttggatagacatttctccaaagaagacatacaaatggccaacaggtatatgaaaaggtaatcaacatcaccaatcaattttcagagaattgcaaattaaagccataatgacatactaccccatacttgttattatgactatttttttaagaaaaaagtaagtgttggtgaggatgttgtgaaattggccccttgcacattgctggtggtagtgtaaaatagagcagccaatatggaaaattgtatggatgtttttcaaaaaattcaaaccagatataccatataatccagcaatttcacttctagatataaattaaaaataattgaaatcagaatcttgaaaagatatctgcactcccatatttattacatcatcattcgcaatagccaaaatatcaaaacaatgtaaaacatccactgacaggtaagtaaagaaaatgtgatataaacatacaatagagtattattcagccttaaaaaaataaggaaatcctgtcatatggaacaacttgatgaacctacaggacattatactaagtgaagtaagcctttcacaaaggacaaatacaggtatatctcattttatttgtgcttcactttttttcatttcacaaatattgcatttttttttttttttttttttttttttacaaattgaaggtttgttgcaaccctacttcaagcaaatctgttagctccatttctccaaatatatgctcatttcatacctctaggtcatgttttactaattcttacaaaacttcaaactttttcttcattattattatatctgttatggtaatctgtgaccagcgatgtttgatgctactattgtaattgtttgaggacaccatgagctgtgcccaaataagatggtgaacttaataaacgttgcgtgtgttctcactgctccattaaccagccattaatccatctctctccctgttttcagtctttcctattccctgagacacaatattgaaattaggccacttaataaccctgcaatggcctctaagtgctgaagtggaggaaagagtcacacatctctcactttaaaacagaggctagaaatgattaagaataataaggaaggcatgtccaaagatgagacaggttgaaagctaggcctcttgcaccaaacagctagccaagctgtgaatccaaagagaaagtccttgaaataaattaaaagtactactccagtgaacatgcaagtggtaagaaagtaaaatagatatgtagaaaattttaatgatttggatagaagtcaaaccagccacaaacattcccttaggctaaagcctaatccagagcaagaacctaactttcttcaattctatgaagactgaaagaagtaaggaagctgtaggagaaaatatggaagctagcagaagttggttcctaaggtttaagaaaaaaagttatctctgtaacatgtacgtataagatgaagcagcaagtgaggatgcagaagctacagcaagttatccagaagatctagctacggtaattgatgaaggtggctacagtaaacatttttcaacatagacaaaagtcttatactggaagaagatgccatctagttagagtgaagtgagcctggcttcaaagcttcaaaggacaggctgactttcttattagtgggttaatgcagttggtgactttaggtggaggataatcattccaaaaatcctaggagccttaataattatgccaaatctactctgtctattttctataaatggaacaacaaagtcagatgacagcacatctgtttgcagcatggtttactaaatatttcaagtccactattgacacctacttctcagaagaagatgcttcctaatgttactgcccattgacaacgcacctggtcactcaagagctctaatggagatgtaggaggagattattgttgttttcaccccttctaacaaaacatcttttctgatgaatcaagtagtcattttgactttcaaggtgtattttttaagaaatatacgtcctaagtctatagctgccataaatagtgactcctctaacagatctggataaagtaaattaaaaatcttctagaaaggattcaccattctagaaggtaagctggtcactggagcagtgacaacacacatgactattcatcattaagaacattcatgattcatgagaagtcaaaatatcaacattaacgggaacttgattccaatttggataggttcaaaacttgagtagaggaaatcacagcagatgtggtagaaatagcaagagaacttgaaatagaagtggggtctgaagatgtgactgaatttctccaatctcatgataaaaccctagccgggagcggtggctcaggtctgtaatcccagcactttgggaggccgaggcaggcagatcacaaggtcaggacatcaagaccatcctggctaacacggtgaaaccccgtctctactaaaaatacaaaaaattagctggacgttgtggtgggcgcctgtagtcccagctactcgggaggctgaggcagtagaatggcgtgaacccaggaggcggagcttgcagtgagctgagatcgtgccactgcactccagcctgggcaacaaagcaagactccgtctcaaaaaaaaaaaaaaaaaaaaccctaacagatgaggagtgcttcttatggatgagcaaagaaagtggtttctttagggagaatctacttctggtgaagatgttgtgaacattgttaaaatgacaacaaaggatttaaaatattatataaacttagttgatgaagtagtggcagggtttgaaaggattgactccaattttgaaagaagttctactttgggttaaactctatcaaatagtatcacatgctacagagaaatctgtcaggaaaggaagagtctatcaatgcagcaaacttcattgttgttttaacaaattgccacagccaccccaacctttggcagccaccacactaatttgtcagcagccattaacattgaggcaaaatcctctaccagcaaaaaaaattgtgacttgcagaagactcaaataatcattagcatcttttagcaataaagtattttaaattaaggtacatatttttagacataatgctactgcacacttaatacactacagtatagtgtaaatatagcttttgcatccactggaatcccaaaaattcatgtgacttgctttattgcaatattcactttatcgtggtggtctgaaactgaactcaaaacatccccaaggtatgcctgtattgcatgattccacttacatgaggtatttgcaatagccaaactcatagaagctgagagtagactagtgtgccatgggcctgggggagggccaaatggggaattgtttaataggtgtaaagtttagttctgtaagataagcaagttctagagatttgtgtaccaacctagtgcccatacctaataatattgtaatgtgaatgtaaaattttattaagaaagtagatattatgttaagtgttcttaccacaaaaagatggggccatgagaaagtgttagaggtgatgggtatgtctattaccttgattgctgggatgctttcaagaaatgtgtgcatatgtccaaactcatcaattgcacattaaatatgcgcagttttgtgtatattgattattccccaataaagctatttaaatcacaatgagataccaccaacaataagagttgttgagaatatagagaaattgaagccctcatatactgttgctgtaaatgtaaagtggtgaagccactctggaaaatagtttggcaatccttgaaaagttaaacatagaattaccatatgacctactgagagcagttccacttccaggtatatacttaaaagaactgaagacataagtccaaaaaaacacctgtaaatgaatgttcataacagcattattcataatatcctcaaagtggaaacaacccaaaggttcatcacttaatgaatggataaacaaaatttggtacatctgaagagtggaatatcatttggtcataaataggcatgaagtaatgattccatactaaaatatggttgaaccttgaaaacatcatgctaaatgtaaatttcatttatatgaaacttcagaattgtcaactctgtagtggcaacaaagattaatggttgctaggggctgaagtgagaggggaatgggaaatgactaagggatatggagtttccttttggggtaatgaacatgttctgcgattagataatagtgatggttgtacaacttcgtaaatatactaaaagccaccgaattgtacacatcgaaaataaaatgtaaacaaaaaaattatgtaaataaaaataagctttaacataaacagcaaactatcaattaggatccaggaagaccaaattagaaccggtgacaaagtgtttgagtttgtcatgtacttttgtggacctcacaaaaactctggaagaggtagtttttcccaagatgatggtaaggagaatagtctatgcaaaacaatgtactccagtggctcctggagttcaactatttcaaatgaaagcaccctcccctgcttcaagcattaggcttcagtggacctctctcctacacatggcccttaggaatatcgtttttgcctttcaattcagaatcctactgattcaggaaaccattctcttattgtcaggagaatcatgtttcttaaagtctaaaatgttattatatcacagatttcagtgagaatctgaatattaaagagaaataaatggatttctagaagaacaaaatagtgattgtttctttaattacatttttggctatgaaaacattttagttctctctttttaacagaattacctgacaatatatttatggtgaatgagtcaccacaaccaaattatccagccattcctaattaatttttcatacatccacatttgaatttatagaacttttctataaaaggcggaaaaagtagtagaggaaaaaaatctctctttgacttctgttcttcagctcttcagctccccacactggaggcataaagtatttttagataatttcttgagagcaaaattattttcaactttagtctagggtttggaaacctaaatatacagagtatctgcaaaaaaaaaaaaaaaaaatcttatgaggtgactaacaggaaaaagtaatgtgtgtgtgtgtgtttacatttaccttaaatgtatatgatttggccagctagcagagccattaagaagctgttaacagtctcctaggtagtcaagtgaatcatggtgctggcaaagtggcccagatcctataatcttgtaaattgctcttggccgggaagctacatgcatagagatattcgacttcatcttcaggagcatttacttcaagatacttaattaaatttcaaaatcattcctatgttagttttatagatcaataaaagttctttcatgtgaaaattggctaactgtaaagatggaggatgctcctgaaccatggttacactttgacctagattgtactttgagacagagcagaagattcaaatacttatttataaacaccctctagtaatcactgatggtgactggtagaaatattaggtcttgggtctgctgcaaaattgaaatacagaaaatacttaagctgccataattagttaaacccaaggagaattatgtatttaaaacattcttaatgttacagtttgaaaacatttagaactatcccactcagagtttcagaagccgagctttcccaatttctacgttaaaaattctcaaatgactaggtaaattatacaagtttctatcccattttaaatgagaatgtcatttccagtggtaccatggcatatgaaaattaatttggcaaaaattaaattactcagaagtcactgtatgacaactctctgataagatggcaatataatcactgtttccctagaagattaagaaattgttcatcacattcagtgatgtccttcatcccagtgtaggtatcagtgaattcatgaaattgaacgcattttgtttttgaaacaaaagctaataattcctacagaagcaatattgtttgaatgattaggatttgagttagacaataacatcaaatctagaaaagaaaccaaagaaatcttaaaagcatgcaggtaaaaggaccttagcaaacatttcatttcacatataaggaattgaagtcaaggaagttgaatgatttactcaaggtcaacaagctgcttcgtgactaaaccagattatttaaataaataaatcaaccaaaggaacaaagcaactctataaaccctaggtttttagggtgtggtagatacacattaactgtgattattttcattctactttttcagcaagttgtttctttttccattcttaatgaaaacatacattgtaaaagtacacttcagtacagtacaaatgacatttaatatcagagaaaaattattccattgcccttttaggtttggctcagttttgaatactgcctggtatgcagtggatgcaataaaaattcattgaatgaagaaatgcaatattttaagcaatcaaatcttcttgattctgattgtaacctattttcaacagcttgaaagaatgtaagaaatgcaattcaacataattatttttgttagtttaatgtgagattatcacaacagacaaaatctctatattcagccttttctaaaactacgatttgatatgaatgtggtctttaaagactacacaatttgaactgcaatataaatgtgccagggggatcagcaatggggaaggaaaacattttttaagtgtgctcaatagtgaacaaattatacattttgcacctgcaaaatacataatggccgaaagttacattttctctgtacttccaagtaagccatgctgtaaaaaacaggagttcaggctttgaacttctttcatttgtctttgttctttcttgtatcagattgtactatatacaaagttccatcaagttagtagttatttaaacagcaaaatacttctttagcaaaaaaaaaaatggcaattttttttatttttatttctatttatttatttatttatttatttatttattttgaggcagggtttcactctgtcatccaggctggagtgcagtggcatgatctcggctcactgcaacctctgcctcccgggttcaagcgattttcctgcctcagtcttcctagtaatagggattacaggtgcccaccactgcgcccggctaatttttgtatttttagtagagacggggtttcaccatgttggccaggcttgtctcgaacccctgacatcagatgaaatggcaatatttttgttaaactatacaatggatgtgtgaaaagatttgaacatgaaaaatttagcagtagtttgtattcctcttctagttaagtctaatttaatatggtgacttctaaacctcaagatcctgtggcttccaaagaagtggaaagaaaaaaaataaaattgagaggcaaagcatctttactgaggcctgtcaaattagcataattgtatgctctccttattttttttgacaaggatacttacgtttcacaggcataccctataatggaatgtctatcactaaaaatccagtggtgacataagtttcaaagacattttcatcatgagtcattagactcatcggacatctttcagagaataggcttgtctctctcttgcctgggagcaagctccttagaggattctctgaaaggccaactacctttccatgctggatgctggcagcaagtccccaaagatataaagtaaacaatgccaatattcagttgatgttttttgtcagtcaaattattttcaaatgctacagttctacctctcagtgagcagtgtaataatgacattaagaaatattaaggatatgaatctggaaacgtaccagcaaaaataattcatttcagattttaataaatgaaatatttaggattttattcttttctatgtaattggttataattaaaatctcaagactagctaagatcagctatctctgattaccttggctgttatgaattgcatttctttttttaaaaaaaaaacacacacactttatctaatagtttgcacatgtatatttttatgtaatgcagaaactcttgcttaatgattttattttaagaaattaaattttcttaatttattagaagtgattttatacaattgaggagataaggaaatgtattatctgtaataattctcaacttgaaaacaatagtattgtagagttttaagaaaatttgtatttttcccacaggagaattatattaaaacttaaaatatcccagggtgttacttagagtatttgaaaaagcaccccagtggatattagaagacgtaatgaagacatatcagccatatcaactttagactctgattctatcaccataactaatcatacaaattcttcagtatcctcaggtaacattcagaatggaagaaaagtagagaatgacaagccatactttattgatctcatatcacttttcagcctttaaatattgcaatgagaatccatttaacgactttcatctggaaattacttatcacctttcaaggacataatgtaaaattcagtagaagtcaatattgttaacagggcaagagtttcatgaacataagtttttaaatgaccaaagacagggttatgatcttgctatagaaacttcgataacacagaaaagaagaatgtggaaattgattagggaatttttgttgttgttgttttacttgctgttttattttgaaagatttcaaactcacaagttcaaagaacaaaataatgaactcctatatactttagaccagttgttaacatcacaccacacccccacattctatctctgtgtgtttgtgtgtatacccacacgtttgtgtcgataggtatatatgtgtatacatgtattacatatatatttatatgtgttttatatatacacatatataatacacatgaagcatattcatatgtgtgtatactcacacagaaagagagagagagagagaacatgagagagaaagagagagttcttttcattttttcaaatcatccttaagtggactatgggcatcatgactttttaagccccaaatacttaagcataaactctgaaaagcaatgacattttctatgtgaccagaaaaccattatcacacctaagaaaatcaacctcagtgcaatataatccaaggaaaaaatctataataaaatgcctgtattgtttcaaaaatgttctttatactttatttttttccatctgaaatccaatcaatattacaaaatactttggatttaacttttatttttcatttgtctccttaaatttagaacaattctctgtactccctttgttctttatgccactgaatcctttcaagagttcaggtcagttgtcctgcagaaagctcacattagtgattcatcttgtgttgaaattcaggtcaaagttttctagcaagaatgatatattggtgacattgtgtatcattgaatcacatcagaaccctcatttcaagctatgttcctactggcaataaaaagcttgattacttgtttaaggtttccatcataaaggaaaaattaccctttgtaatcaaggagtattttgtgaggtgaacaaattgattatctatgtttgaatcaaattgggagttacaaaatggtgattttctaattgaatcatcttttctattttaatcagctggtattcttctgtaaagaagagtttttcacctttctctgtcttcctttctctctgtctctcctgttttcatttattgtttttctttaatatcaatatggagtcatgtttttaaaactttattccatgtgttataattcattaccatcataattttgcaaaatttagactgcttcaagctggctcctgtatccttttagccttaccccatccttgtgtatttcttcaagctttctgttacaagaagatgtttcaggctcaatttgtactttcctttgtgcagatgtgaaaacagctatttttccaaggagtcaaaattccttttggtaggatattatatttagaaatctagatgtatcactatgttatactgctagctgctcattgccactagggtgtcattgcttctatacactttcagggacagatctaggaaaccacaaatacatacccacaaatacacagttgaactatagatgtatattatggatgtattattcaacacataggtgaatttttatatatatagaagtactgcattttatttataattgctgcaatatataggaatatatatgaatatatatatttttttcaataacataaaattattttcaccttttaccactccatattggcatctccctttacccatagtaaaagtttaacaatatctttattttatacatttgctttttcctaaaacacataaataatgcttttagaaatacaacaccaatatcactactaacagcaaccatactaagtaaagtctaatattctttatagtgattgggaagttttgtgtgtcccagaatatattccattaaaagcatagagcaagaatattatattcaatagttatttgaattaattatttactctggtttcattgtccctttgaaaatattatttttgtgtatttctcatgtgtttttattctttttaattttttaatttatttttgtctatggccagatcaccctgaatgtgcctgatctcatttttttaatgtaaatcattttttacatgattcataatgtaaagctatatacacaggcatagtcagagaaccctcaattctctccctacatcttctacattctgacattcctacgcatcacttcctgagcttctttatgcaaaaacaagcaaacatgcatatatcaattgtcctgtttaattaaaaaaggtaacattttatatatcatcttgcataccttgctgttttgacttatcactatatcctgaagtttatgccacatcggcatataaatggcatcctcatttcttgttactgctgcctcactttcaattttgaatgtaaattcataacagatgtgtctaagttgtcatcaatatttttcaattgacaaaaaacatggtatgtttttattatgtgcaacatgatattttgaagagtatacacattgtggaatagttaaatctagctaattaataaccctttgcatatattgttgcatatttgtgcagatgaccaccagcataaataactagagatagatttgcttgtcaaaggatgtgcatatgcagatttgttagatatttgcaaatttactaccataaatttgtactattttgcagtaccatttgcaatgagtgaaaattacatactttgttaagatttccttagttttagtttttatttaatgtacctttttctccaaggtcccatcaagatacatgtttaactgtcatgtcctcttaagttcctattggctgttagcaatttgtttcttacttttccttgtttctgatgacattgacagttttgcagaatactagccatattttcccttgactgagattcatctggtgtttttttcatggttagattgagattataggtttttaggaaagaagaccataaaagtatatatgccaatttcataaaatataacatcatttaaaggcaacattatcagtatgacttatcattgttgatgtcaaccttgttcacttggctaaagtaatgtttaccagatttttccactataagtttaccttcctgcttctttatcattcttattggaaagaagttgctatggaaagcccgcacttaaggagtagggagttaatacttcatctctttgagggcaaagtacataaacattatgtctttatcctatactttgaattataatccaataccacttcatatcttgttgctcaaattgttccacttttggccattgggagctctttcatttggttcctgtgtcccttctaacacacccccattattgtgtttttttgcatgctttcttactttctggttccacaatatgctctagactcaccttgtacattcttggctccagtcatttttccaagaaacccaggctgttatttttatggaaaatcatattagaaaccaagctctggatgctaggcatgttcactgctatgagagtatcactttttctaggtcctctcagatgaaaaagtaaggaaatatacatgtatactactctgtttacatttacatatctataaatattttacaagtatctatctgtatctgtcttaagctaaagaggagttcacatgaatgtcctcaactcaaatccattaccacatagataaattctagctttctgcatctgcttatctgttttctactataccaacagtgagaaacctggctcccttgatccatttatgtaatttttcaatttgtatacatgaagtgttaacctatatttctgtgggattatgactattatcaactagagtacagtgcttatatagagctctttttgcctttaggctcacagacttcatttatttccaaaattccttatgtcagtactcttttcctccacacctttcaatgaggttgtttcatgtccttgtaatacagttagattcttgcaccatactttgctttccattctgggatctcctactatcttaaatgaactcattttaacttgcatatattaagattcactttttgtgctgtaaagttctatgcatttttttttttttttgagatggagtttccctctgctgcccaggctggagtgaagtggtgtgatctcggctcactgcaacctccacctcccgggttcaagcgattctcctgcctcagcctcctaagcagctgggattacaggcaccctccaacacacctggctaatatttgtagtttttagtagagatgtggtttcaccatgttggccagactggtctcaaactcctgacctcaggtgatccacctacctccacctcccacagtgctgggattacaagcatgaaccaccgtgggcctgaccagctctacacattttaacaactgcataatgtcaggtaagcaacattacagtactatacagaatagtttcaccatcataaaaaatcctctgtgctttttctattcaactctctccttttccccaagaccatcaccactgatctgtttagtgtagtttcaccatcataaaaaatcctctgtgctttttctattcaactctctccttttccccaggaccatcactactgatctgtttagtgtattcatagttgtgcctctcccagaatgtcatataaattgaatcatacagtatgtaatcttttcagatttttatttagcaatatatacttgaagtctctccatgtcttttcatggtttgatagccattcacttttattgctgaataatattccattatgtggatgcatcacagattgtttccccttcccctattgaaggaaatattggttgcttctagttttgggtaattattaatatgaattaaattgctgtaagcatttgcatgcagttttggaatgtggaatacagatataagtttttaagtaagttgaataaatatataggtggacaattgctaaactgcatggtaacagtattgatagggacaggaggcagaaaagagcgggtccttggcaaaactccaccctccagctgaaaaagcctgaaactgcggcccaaagtaagaacttacatccctgttttcccactggaatgttaccttttcctaaatcactcatggccctgccctgccctgccctgccccaccccaccctatgcctataaaaaccccagactcagctggtagacgggactatggctggacatcagagagaagtagcttcacttcagaggcacaacttgttggcataacttcaaagaagaatccatctggagacagccggacttcaggggaagtttacctaccaacttcatcccgttttcatccccccttcccactgaaagcctctatcatcagctataaagtcccttgcatttaccgttgttctattcattagtgtgaccttatttttcatggatgctggacaagagctcaggaatgatgaatacagatacaaaatgtcacactggccctttactcttgctggcagaaagaagctgcctcacatgaaaaggcaaaggtccactgagctgttaatgcttaagccatccgtgaatggcagagctaaatgagcatgtaacacaccctctggggctttgggagtagcaggcacccccgcctggatgctgccacagggactgcacagagttcactgctgctggtgcccaaaaatggtcagccagagcctgtactcattcacctacttattccctcccacaaggggataagcacagtgagctgagtaaatggagtttgttcctgccagcggtcaaaagcacttgctctgtttcctgcactcatttgccctcatgttacctccagcgagtggtagacaggggaaagctaagcaagtgaggcactcctgttgcgagtcccatgacggggtaaagaaaatattctgattcactatgtttaactttataagaaactgcttcagttgtcttccaatgtggctgtattattttgcattctcactagcaagaatgagaggtccagttgttccacatcctcaccagcaatcactatcgtctgttctttggcttttagccactctaataggtgtataatgatatctcatggttgttttaatttgcatttttctaatgaaaaaatgatgctgagcatgttttcatacgattattggtcatttcatgggtgagatgtctgttcaggtcttctgaccactttttaattgggctgttctttcttccagttgagttttaagaatttttaaagtttctctgatacaagttctttatcagatatgtgatttccaatattttctccaagtctgtggcttctcttttaattctcttaacagtgttttttgtggagcagaagttttaaacttttattcagtccaacttatcattattttatgaattgttcttttgatgttttatctaaaaattcatcagcaaaccaaagctcatacagattttcttctatattttcttctaaaaatgttatagttttccattatacatttaagtctatgattcatttaagcttattttttgtataaggtctctgtctaaatatacagatgcacaatatttttagcacaattcctaaaaagaatatcttttcagcactgaattgtcttcatgcctattgactatatttatgtggttttaattctgggctctctatcatctatcactcacctatttgtctactcttttaccagtacaccacgtcatctcaaatgttgtagctttagtttaaatcttgaaatcaagtagtgtgagtctttcaacattgtttttcttcttcggttttatattctagatcttttacctttccatataaactttagaatcaatttgttaatttctaaaaaatagcatgctgagcttttcttgggtattgtgttaaatccagaaatcaggtaggaaagaatcaatatattgagccttccaatacatgaacatagaatatcttttcatttatttaaatgtctgattattttttgatgaatgatttgcaagttttgacataaacagcctgcatatattttgttagatttatatctatggttgttttttgtttgcttgctttggtgctattgtaaattgtaataattttaaatttctaaacccaatttttcattactgatacaaaatttttcattactgataaaagcaattttgtgcaatgacttggtgtcttatagtcttattatactagcaagatcatgagttttttgtagactaattgatattttctacatctgtcatctgctaataaagacaattttattttttctttacaatatgtatatcatttaatctttgctttcttttatttcatgaactaggacttccagaacaatgctgaataagagtgatggaagaggacacatttgcttgttcccaatctaagaggaaaaggatccaatgtctcaccattagttacagtttactatttttaatgtgctttggattttgtttgttaatattttattgaaaattattgtattgatattcagtttattttttagacaatttttgtcagttcaggaaaagtgtcatactttactaatagcaagtaatttagaagttttatatcttttttaattaaaataatttaggtagaaatgggatctatttctaggtctataatcatatcatctgcaaacaggggtagtttaacttactctcttcctatttggatgccatttatttttttctcttgcctggttgctctggctaggacttccaatactatgctgaatagaagtggttaaagaaggcttgtcttgtgtcacctttcaaggggaatgcttccagcttttgcccattcagtatgatgttgtctgtaggtttgtcatagacagctcatgttattttgaggtacgttccttcaatatctggtttattaagaacttttaacatgaaggatgttgaattttatcaaaaaacttttctgaatcttttgaaataatcatggtttttgtcttcagttctgtttatgtaaggaatcacatttctcgatttacataccaaacttgcaccctgggataaagtctacttgatcatggtatattagttttttgctgttctgctgtattcagtttacaagtattttgttgaggactttttatagatgttcatcatggatattggcatgaagttttcttttgttgtcatgtctctgccagattttagtcacaggatgatgctggcctcgtggaatgagttgagaaggagtccctccgatggaatttttgagaacagtttcagtagaaatggtaccaacacttatttgtacatctgatagaatttggctgtgaatccatctgctcctgggcttttttgttgttaggctatttattacagattcaattttggagctcattattagtctgttcagggaatcaatttcttcctggttcattcttgggaacgtatatgtgtccaggaatttatctatctcttctaagttttctagtttgtgttaatagaggtattcatagtagtttctgatggtttgtcttatttttgtgagacagtggtaacaacctgtttataatttctaattgtgtttatttgaattgtctctctcttcttttttattattctagctagtggcctatcttatcaattctttcaaaaaacaaactcctgggttttttcatcttttgaatggttttttgtgtctcaatttccttcagttcagctctgactttggttttttcttgtcttctgctacctttggggttgatttgttcttgcttctctattctttcagttgtgctgtttgattgttaattagagacctttcttactttttgatgtgggcatttattgttatgaattttccctttaacactgcctaagctgtatcccaaagattctgagatgctgtgtctttgttctcatttgtttcaaagaacttcttgatttctgccttaatttcattatttacccaaaaatcattcaggagcatgttgtttaatttctatgtaattgcatggttttgacggattttcttagtcttgacttttatttttcttgtgctatgatctgagagtgtgtttgatgcaatttattttcttttgcattgggcaaacaatattttctgtccaattatgtggtcgattttagagtatgtgccatgtgatgatgagaagaatgtatattctgttcttttggagtggagagttctgtaaaagtctatgagagccatttggtttaatgatgagttcaaatactaaatgtatttgctatttttctgcctacattatctgtttaatattgtcagtagagtgtttattctcccactattattgtgtgggagtctacatctctttgtaagtgtctaagaacttgctttatgaatccgggtgtccatgtattgggtacatttttcttttgttttctagttgtttttgagttaggtatatatcttatattattcttttcattcttattgataaaagaggcaagaactaagaatgtatatatgtcagatatttaggtcttcttgttgaatggaaccctttaccattatgtagtgcccttctatgtctttgaaattaggattgcaaccatgctctttactttcttccatttgcttggtagattttctttcatcccattacttttgagactgtgggggtcattacatgtgagatgtgactcttgaagagagcataccattgtgttatctagaacacctcatactctcagcccaaaatgtccatcagcgataaacaactccagcaaagtttcaggatacaaaataaatgtacaaaaatccttaccattcttataaagtaacaacagacaaaccaagggccaaaccaggtaggccattctattcacaattgccacaaaaagaataatatacctaggaatacagctaaccagggaggtgaaagatctctacaataagaattacaaaatactgctcaaagaaatcggagatggcacaaacaaatggaaaaacatcctatgctcacagataggaagaatcaataccattaaaaaggtcatatagccaaaagcaatttatagattcaatactacttctgtcaaatgaccaactacattcttcaaagaactagaaaaaaaactattttaaaattcatatagaaccaaaaatagcttgactaaccaaggcaaccctaagcaaaaagaacaaagctggaggtatcacatcacctgacttcaaactatactacagggctacagtaaccaaaacagaatgacactcatacaaaaacagacacatagatcaatggaacagaataaagagcacagaattttggcctcaccccaatgaccatctgatcttcaacaaaggagacaaaaacaaacaatggggaaacgactgcttattcaataaatggtactgggataactggataaccatatgcagaagattgaagctagaccccttccttatactacatacaaaaatcaactcaaggtggattaaaggcttaaaagtaaaaccccgaaatataataacactggaagtcaatctaactaatgcaatcctggacatatgaatgggcaaatatttcatgacaaagatgccaaagcaatcgcaacaaaagcaaaaattgacaagtgggatctaattaaacttaagagcttctgcacagcaacagacaacctacagaatgggaaaaaatatttgcaaactatgcatataacaaaggtctcatatccagaatctgtaaggaacttaaacttacaagagaaaaacaaacaaccccattaaaaagtgggcaaataacatgaacagatgcttttcaaaagaagacacatatggggccaaaaagcatatgaaagaaagctcaatgtcactgattattagagaaatgcaaatcaaaagcggaatgaaataccatctcacatccatagaatggctatattaaaaagtcaacaaaataacagatgctgagaaaagggaacacacactctgttggtgggagtgtaaattagttcaaccattgtagaagacagtttggcgattcctcaaagacctaaagactgaaatatcatttgacccagtaatcccattgccgggtatgtagccagaggaatgtaaatcattctaccatgaagactgtagcttttttggatagttctttattactttattccatagagtttgatctgtttaaaccttcaatctcatttggagtcaattttgaagattctgttttcctagtaaattgtaaattttatatagaatctcaaatatattttgaaagaggtgttttaaatttcctctgctttaatatttcccctcatattttcttttaggtatttgcctttaccctctttttctttttgattaggctaattagggctttgtctacaccgttgaatttttagcaaagccaccattttgatttatttatagttctaataagatgttttctactttctactttattatatttttatatttattttttgtttttcttttgttttctagttgtttttgagttaggtatatatcttatgttattcttttcattcttattgatgaaagaagcaagaactgagaatttccctctgattactgctttaagttgtatccaatagaacctaatgtagttttaacaattatttttgcttagaaattctgcaaatttagttttttatttcccttttacctatattcaatagaaagtttttaaattttcaagttaaagggaatttttgttcttaatattgttattaatttctaatttattgtattgtgatatgagaatgttatttttacttctgttttacagaatttgttgtgatcaatttttgtaaatgattcatatgtttataggaagttttatgcacatctataatgtctacattattggtgtgttgcttttgtctattgcactaagaatgttattttaaactccccataatattgctttatagttgtctatttttttctgtattatgaagtttttgctgcctgtttggtgcaaaaagatccatattgttctgtctttgatgtaaattttaacttttactttataaagtttccctcttcctttcattgttgcctttggcctgctttctgctttgcctgatatcagtattacaacctccacttttctattgtttgtgtttgtctctgaacggttgcccataacttaacttgcagccatcctgaatcacttaattttggtttaactgtattttgtgtaccactccaaaaattatttgatttgttgagtgagctaagcccatgtatatgtgttaatataactgatacatctggcatcaaagttttatttttttgctacatttaatgtgtacactttgttatatttactgtttctaatttctgtatttttttctttgctgtttaattgtactccttttgctatttagaaagttaatactattgcagtagctacctttaacacatttcataatgacttagttcctcctttttaaaattagctttttaatattagaattggcagctttagatatatttatttagaagttatatatttagatatctatatttagaattgtaggcttagatattcttttatttccatttattgtctatgtggcaatcaatgagcctattgtacttttctccttttatatacctcccattttttcagttatgttttcttctcatttattacaatttagaacactgacatactaaccttcaacactgtactcacctgaattttattcttagagcttcacttaaataccttaagtaaatactaccagtccttttcccaaagttcccccatcatgtgttaatcaaatgaaattttttatctctagatgcctcaaaatgtgctcatgagtaaaatatttccagattactcgaatgcttacagcatttgcatggttacagcatgttatataaccttaacacattaaggatactgtgatagaaaagaatccttacctcaaattttctttcctttttttaaaacttttattttaggttcagaggtatatgtgcaggtttgttatataggtaaattacatgtcacaggagtttggtgtacagattattttgctaccaagataataaacatagtacctgataagcagtattttaattgtcaccctcctacctccctccaccctcaagtaggcaccagtgtctgatttccttcttcaaggtaatatatattcaatgtttaactcccacttataagtgagaacatgcagtatttgtttttgtgttcctatgttacttcacttaggaaaatgacctccagctctatccatgttgctgcaaaggacatgatgtccttcttttttatggctgtattccatggtgtatatgtaccacattttctttatccagtctagtcttgataaggatttaagttgaattcatgacttcgctactgtgataagtgcttcagtgaacatacatgtgcgtgtgtctctatgatagatggtttatattcctttgggtatgtacccaataatgggatcactgggtcgaatggtaattctacttggagttcttcaagaaatcaccaaactgatttccacaatggctacactaatttacattcccagtagcagtgtatacacattcccttctctctgcaacctcaccagtatctgctattcgttgactttctaatgatagttattatgactggtataagttggtatctcatcgtggtgttgatttgcatttttctaatgattagtcatgttgaacattttttatatgcttggtgaccatgcatatgtcttctttctaaaagtgtctgtttatgtcctttgctcactttttcaaatttattttttattactttaagttctaagatgcatgtgcagaacgtgcaggtttgttacacaggtatacatgtgccatggtgatttgctgcacccatcaaccaatcatctacattaggtatttctcctaatgctatccctccccttgtcccaccccccgggcctgagtgtgtgatgttctcctccctgtgcccctatgttctaattgtgcaactcccacttatgaatgagaacactggtgtttggttttctgttcctttattagattactgagaatgatggtttacagcttcatccacgtccttgcaaaggacatgaactcattcttttttatagctacatagtattccatggtgtatatgactttgcccacttactttttgttttttttgtttttattatactttaagttttagggtacatgtgcacattgtgcaggttagttacatatgtatacatgtgccatgctggtgcactgcacccactaactcgtcatctagcattaggtatatctcccaatgctatccctcccccctacccccaccccaccacagtccccagagcgtgatgttccccttcctgtgtccatgtgatctcattgttcaattcccacctatgagtgagaatatgtggtgtttggttttttgttcttgtgatagtttactgagaatgacgatttccaatttcatccatgtccctacaaaggacatgaactcatcattttttatggctgcatagtattccatggtgtatatgtgccacattttcttaatccaatctatcactgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcccatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttcttttcagaagtgtctgttcatgtccttcgcccactttttgatggggttgtttgtttttttcttgtaaatttgttggagttcattgtagattctggatattagccctttgtcagatgagtaggctgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccgtgcctatgtcctgaatggtaatgcctaggttttcttctagggtttttatggtttgaggtctaacatttaagtctttaatccatcttgaattaatttttctataaggtgtgaggaagggatccagtttcagctttctacatatggctagccagttctcccagcaccatttattaaatagggaatcctttccccattgcttctttttctcaggtttgtcaaagatcagatagttgtagatatgtggcattatttctgagggctctgttctgttccattgatctatatctctgttttggtaccagtaccatgctgttttggttactgtagccttgtagtatagcttgaagtcaggtagtgtgatgcctccagctttgttcttttggcttaggattcacttggcaatgcgggctcttttttggttccatatgaactttaaagtagttttttcccattctgtgaagaaaggcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaaattgcttatcagcttaaggagattttgggctgagacaatggggttttctagatatacaatcatgtcgtctgcaaacagggacaatttgacttcctcttttcctaattgaataccttttatttccttctcctgcctaattgccctggccagaacttccaacactatgttgaataggagtgctgagagagggcatccctgtcttgtgccagttttcagagggaatgcttccagtttttgcccattcagtatgatattggctgtgggtttgtcatagatagctcttattattttgaaatacgtcccatcaatacctaatttattgagagtttttagcatgaacggttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtgaataagctttttgatgtgctgctggattcgttttgccagtattttattgaggatttttgcatcaatgttcttcaaggatattggtctaaaattctctttttttgttgtgtctctccctggctttggtatcagaatgatgctggcctcataaaaagagttagggaggattccctctttttctattgattggaatagtttcagaaggaatggtaccagttcctccttgtacctctggtagaattcggctttgaatccatctggtccctgactctttttggttggtaagctattgattattgccacaatttcagttcctgttattggtctattcagagattcaacttcttcctggtttagtcttgggagagtgtatgtgtcgagtgatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattaatttttggaagggttttttgtgtctctatttccttcagttctgctctgattttagttatttcttgccttctgctagcttttgaatgtgtttgctcttgcttttctagttcttttatttgtgatgttagggtgtcaattttggatctttcctgctttctcttgtggacatttagtgctataaatttccctctacacactgctttgaatgcgtcccacaggttctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtctcgttgatctgtccaacgttgacagtggggtgttaaagtctcccattattaatgtgtgggagtctaactttgcccactttttaatggacttgttttttgctttttgatttcttaaagttccttatagattctggatattagaactttgtcgtatgcataatttgcaaatattttctcccattctgtaagtggtgtatttactctgttgttagtttcttttgctgtaaagaagctattgagattaattaggtcccatttgtcaatttttatttggttgcaactgcttttgttttcttcatcataaaatctttgccaggtcctatgtcaggatggtacttcctaggttatattccagggtttttatactttcaggttttgtatttaagtctttaatccatcttcagatgattttgaatatggtgtaaagaacaggtccagattcaacattctgcatggggctagtcagttattgcaacagggagttgcaatatttattaaacaggcagtcctttcctcattgcttatttttgtcaactttgtcagggatcagatggttgtgaaacaggagagttctgttatcccttttgcagggtgttcaacaggggtgtggctcacttcttcggtgccccactgctcaaacccctaggggaaccgtgcagacaagcaggtgaagaggttgtggggaggatttttgggcttcgaccccatggcagtatctaggggtcagtgtttacaaagcctgaaacccaaataggcatgtgttacattgtgctctttcagctttgctagctacaggcagcttgtgttaatcagctcaatcagactctacaccttgtcataaggacagatggctttttgtatcccgggtccttgccctagtgtaccagaaaaatggaatcacacatgggcttgcaggatgagtgcaaggttttattaagtggtggaggtagctctcagagaaatggagatagatggggagtcagagggggatggattaggaaggtggtcttcccctggaattggattgcccagcagccagactctcctctgatatccccaagctgaattccccttggcatccacatcatttcaccattcctggtctgctggtgtctgctgaagtctgtcagtgtgttctgctcctctcaactccagctgcttgtgtctgtacccactgtggtcttgagtttttatgggcacaggatggtggcatggcgggccacagtggtcttggaaaatgcaacatttgggtgtaaaaacaggagtgcctgttctcacttaggtccgtgggcacaggcctgagggtagagccctcaccaaggaccccatccttctctatccagcacttccctgctcccatcccatgtcagttgcaggtgtgcagcattatttctgagctctctattctgtttcattggtctatatttctgtttttgtaacagtaccatgcattttggttactgtagcctcagtatgatttgaagttgggtgatgtaatgccttcagctttgttctttttgcttagaattgccttgacaattcaagcttttttgggttccatatgaattttcaatttctttcttttttgtaattctgtaaagaatgtcattggtagtttgataggaatagcatttaatctgtaaattgctttagataggatggccatttaacaataattattcttcctatccatgagcatgaaatatttttacatttgtgacttctctgatttctttgagcagtgttttgtaattctcattgtagagatctttcacctccctagttagctgcattcctaggtattttattctttttatggctattgtgaatgggattgtgttagtgatttggttgtcagcctgaatgttgttgttgaatacgaatgccactgatttttgtatgttgatttttgtatcctaaaactttgccaaagttgattatcagataaatgagttttggggcatagactatggggttttctatgtgtagattcatatgatctgcaaataaggatagtttgacttattctcttcctatttagataccttttatttctttatcttgttcaattgctctggccaggatttacagttctatattgcataggagtggtaagaaagaacatccaggtcttgctctggtttttataggaaatgtttcaagctattgcccattcagtatgacgctggctgtgggattgtcatagatggctcttatttttttgaggtttgttcattcaatgcctgcttgttgaaggtttttaacattaagcaacattcaatttcatcaaaagccttttctgcatcttttgagattatcatatggtttttgtttttaagtctctttatgtaatgaatcgcatttattcattttgcatatgttgaaccaaccttgcatcccattgataaaggctctttgatcatagtgcattagctttttgatgtgctgctggattcaatttgctagtattttgtttaggatttttgcatggctaccaaagacaatggccggaagttttccttttttgttttgtctctgccagatgttggtatcatgataatgctggcctcctagaacaaactggagaggaatccctcctcctcaatttttttggaataattttcatataaatggttccagttcttaacatatcttacagaattaagctgcggatttatctggtcataggcttttttgggttggcaggcttttattactgattcaaacttagaactttttattggtctgttcaggaattcagtctcttcctggttcaatcttgggaaatcgtatcattccaggaatgtatccacttctaggttttccagcttctgtcatagagctgcttgcagtagtctgagggtttttgtatttctctggggtcagtggttatgtcccctttgtcatattcaattgtttttatttttatattctctcttctttaagtctagctagtggtctatctatcttactaattctttcaaagaagaaactcctggaattgttgatcttttgtttgctttttttgcatctcaatcttcttcaattcagatctcattttggttatttcttctcttcttctggctttggggttggttgcctcttgtttctctagttcctctagttgtgatgttagatttttaatctgagatctttctaacattttgatgtgggtgtttaatgccataaactttcctcttaacactgctttagctgtgtcccagagaccctcttatgttgtatctttgttttcattagtttcaaagaatttattgatttctattttaatttcattatttacccactagtaatttaagagaaggttaatttccatgaaattgtatggttatgagtgattttcttagtattgatttcaatttttttttgcactgtggtccaagagaatgtggttggtatgattttgatttgttgctgttgtttttgaatttaagaattgttccatggccaatcgtgtggtcagttttaaagtatgggacatgtgcaggtgagaagaatgtacgttccattgtttctggttggagagttctgtagatgtatgttaagtccatttggtcaagtgttgagttaaaggcctggatatctttgttatttttctgccttgatgatctgtctaatattgtcagtggggtgttaaagtccctcactcttattgtatggttatctaagtctctttgtaggtctataaaaatttgctttacgaatctaggtgctcctgtgtttggtgcatatatatttacataattaaatcttgttgagttgagccctctacaattatgtaactcacttctttgtgttttttatcttagttggtttaagtctgctttgtctgaaattagaatagtaacccatgcttctttctgttttccatttgcttggtagacttttcttcatgcttttactttgagcctatgggtatcactgcatgtgagatgggtatcttgaagacagtatccaattgggtcttgcttctttattcaacttgccaaactgtgccttttaattggggcatttagtccatttacattcaaggttagtattgatatgtgtggatttgatcctgtctttgtattgttaccttgttattatgcagacatgttagtgtggttgctttattatgtcactggtctctgcaattaaatgtgattcttttgtgtcactggtctctgcaattaaatgtgattcttttgtggtgagcattgattttttctttccataagcactcccttcaggacctcttgaaaggtacgtgtggtgataacgaattcccttggcatttgcatgtctgaaaataatcttatttatccttcgcctataaaacttagtttggctgagtatgaaattcttgtttggaaattcttttattcaagaatgttgaatataggcttccagtcttttctggcttttagagtttctgctcaaatgtccactgttagcctgatggggttcactttgtaggtgttttggcacttctctctagctgcctttaacactttttccttcattctgaccttagagaatctgataactatgtgtcttggggatggtcttcttgtgtactgttttgcaggggttctccacatttcctgaattattacattggcatctgtattgaggttggggaaattttcatggatgatatcctgaaatatgttttccaagttgcttgcttcctctccttctcttagggacaccaatgagtagtagatttggtctctttacataagaccacatttctcagaggtttcgttcattcttccttattgtttatttatttttgtctgactgagttattttggagagccatcttcaagttctaagtttcttttctctgcttggttgattttgctgttaatacttgtgattgtattctaaaattcttgaagtaagtttttcatttctatcagatcagtttggttatttcttaaaatggccatttcttcttttatctcctgtatcattttactgcattccttagagtcctcatattgagttttgactttctgctgaacactgatgctcttcattcctatccagagtctgaattctatttctgtcatttcagccatttcagcctggttaagaaccattgctggggaaatattcctgtttttggaggtaagaaaacactctggctatttgagtttccagagtgcttgtgctgactctttctcatctttgtgggctttgaagttactattctttggatttttttcttttatcttctttgatgcccttggggtttggttgtggtataagatgggttctgctgacttgcttcttttccggaagatttttagggggccaaagctctccttaggactcctggactgcataccatcattctaaggggcaggtatcaggcccctgcctttgttctctggcctttagaggttagaatcctgctgtgctggaggggccaacatgttcctggactgctggttacaacactcgatgggtggtggcagccaaagcacttcattgggtgctggcagtgggatctatgcatattcacatatgccagcagcagtggcagtgtggcaggttacataggctgaggtagggcacttgaaggcatgagtctggtgtcttccctgtgcacaatcatgctggcagcagttgcagcacagggagggagatggggctgctggtttctatgcacacccttgcattggcaatggtgcagcaaaggggtgatatgttcatgccagcagcagtggcacgatggtgtgcatgtgcacacacatgccagtggcaaaggggaggcaaggtccacccatgtgcacctgccccagcaaagcaatgtggtgggtgactgtaggcaagtgcattcctgcaaagtggcatgagggaggcagtggtagagggtggcaggtgggctagtgagcacagccaggtgccgccctgctggagctctcttatggtcaggtgtggtctgttactgcagaagctatgataagggccctcaagagacaccccagctgggcatccaaggctgcactgaaagtaggcatggctaggctggggttccaggagaagctagcatacggcgggggctctcaggtcagatcagccccaactcatgggcaggattgctctactctgtccaagcaccacagttcccctgtgactgaagtctcataaggaagtaaggcaatccttggagtgtggggatccctggccatgctccactgaagatgctcctataccaaaccctctgggctctgtaccagctggacttctgccagtaccacctcactaagcagctctccctgccagctcaagtgtccatagggtcatggggtctcctgctaccaagattccagaggtccatggtgagaggccagttgctcctcacctgctcaactcatcccttccccaggagttgttggggaccagggactagttgtggtgtgtagcagcagccctttgcagagttcccagtttcctctccattcagcctagcttatttaacctccctccatctactctcaatgccatccctctgaatatgtgctcagaatgcaccagtcttctggatgccccattcctctgtggcagattttcctccttgctgcatctagtcagccatattgtctctcaataaatcctttaatttcttaaaaatgttttaccattgttacctatcagtaactgaaggatctgagattggggtattatttactggggagctaataaggaagccagatactgcttttatggatgatgggaaaagacataagactcctggcccagagacaaagggctctattactcatgcactgtaagaagcatgaacatcagcatatttttcattacttcctcttgtctgcaagtcctacagcaatgatgcaggtaggaactgaatgtctgaacatagagtagcttgtgttataggaaagaaatcctgagcttagtaaaactatatcatttacaataggtggtaaccatacctaccctttgttccagagggagatactatatcttccaagactattcactatacaaaaatcctggaaaagatagtctggaacaaaagacagtcagtgcctctgcttgcaaggcatgtagaagcacaagagatccataggtaattgtctccccagattaccttgatttatataatgacaacctaattttgttggtacaaagaatcttcagagattttactggtgtcaagtttctcatatagtcatgaatataaggaagggtatgctttttgtagtgtaggttaaagaagactattaaaaaaaaggtgcatatgagtactaaaccccttctactcagtcatgccacgcatgaccccaagtcttaggttttctatctcttttgacatcataaggcttggggtaatgtatggcatgagagaatattatcatgaaggtcagaggggttacctagaacctgcatcttagcttccacttatgagcactcagccaatgcccaggacacatctcagaacaatgaattctgaaactgtgaatctgggatccagatggcaggacattttaaagcttcccaggtgattccaatgtgcagccaaaggtgagattgagctctgatttcaatgcaaagataaaacctgattactggccaggcacggtggctcacgcctgtaatcccagcactttgggaggccgaggcaggtagatcacctgaggtcaggcgttcaagaccagcctggccaacatggtaaaacccatagctactaaaaaaacaaaaaacttgctgggtgtggtgacgggtgtctgtaattccagctactcgggaggctgaggcaggagactcacttgaaactaggaggcagaggttgcagtgagccaagatggcatcattgcactccggcgtgggcaacaagagcaaaactctgtcaaaacaaacaaacaaacaaacaaaacaccctgaaggtctataggagataacacttattttaggagagatttttaatgccatttttccttctttatgaggtacagactttgaatacttatcttcaaatgcacaacaaaaacttgaggacagatgactaattattttcgtaagacagtttgtgatattgcaggcaaattcttcagtagtttagctaataacagagatagtatttaaatgttcaaaccaaagtttcatgtgggagggaaaaagagatattttaaacttcaaagtgaatatgatttgccctggaagtcacagctactgcaaagcacttaaaattatttcagacagctagtctgtcggatcactgttatagctaggcattcctcaccctataatttggggaaagtgggtactgaaagatagagaattcacagagcttagcttttagctttagatgaagagttacactgttgactttatacaaaaaattctatgtgcttaaagcatatcttacagaatgctagccaactcactttggcagagatacatgcagctaaaattgcttcccttctgactaatactatatattcagcattttcctgataggcacactcttggaagaagtcctcagatatacactgaattactctgtgaataaaatatttagtctctttagagcccttaaacagagccttgacttatcgactccaaagctgctgactttctacagttcaaatcagtagacttcccacatgaccttaccgttaatgataagtaaagcacttagctacccctagaagactattataaactaccataaaatgtttaaaatgtcttttaggaggcataagtgaaaatgcttcaaaatccactgaagaagtgtatccacacaatcaaatttcattataaggtatgagcaaagactgatagaatgcttacaaaataaaatgcacaagtcccatttaggatttagcatgtttaaaaactataccaaggctaccaaattaacatgatggcaaatgtaaagatgatctcaaattgtgttcatatgctattttttcccaaataattcaaaacattttaaagagcatcaaactattaaatcaaaagaggtagattcttactaaccccattttttttttttttttttttttttagagaaaggagatcacaagaaatcaattcatggtccaaatgaactactacttggagccagtcaaatttttttttatacactgaggccaggtgatttggaaaaggcaattaagtaagtgtacagtaaaaataaggaatatatacagtatatgtagttgtcaatgaaaatctgcaaactcattaccatcaaaaacacaagaaaagtttggttataagagttaatcttctggtaaatatttagttaatccttttttaaaaaaaattatcttgcttgcccttggattaagaaagaccatcagagagctactcatagaaatgctgttacaggacaatactttgctttttatcattttactgacagtgcaaatattactgacaaatgttctctgatgactatatctccaatacactgtgttcatactccataaaaatgttctctaaagccattttttcttaatagattactttgttttcattttaaagatagttgtcaatgataatttattcttctgcatttgcttcttgaaagcagaatcagtgagcaatctttataatatgcacacagcctacctctggattcatgttatgattacaactctttttctcatttgtcttgatttactatagtcatacaaaaatttttctagtttaaaagtaacataaagtaaaactttgaaagtggaaaaaggaaaatatgtaaaattcatgttttttctatttttttgagtctagataatttataatgatacatcttcatatttgcttttaagtaaatgtacatttatattacagggcaatgtacattgtaattttgtagatgcacatttattttgtttctaggaggttttttaagttactgctttaacagttgtctattccattatttttctcctcttggttttcacttactcatatactggatctcctttacctgtattacaaccctatcattttgccattaatcctctttgaaatgtttacttctattttcttttgcttgttatttgtaccatttttcttacaatgtttttctcaaatgattcctaattacatcaactttttaattgacaaatagaaatggtatatatttatggtgtacaacataatgttttgatatatgtatacatagatacccagtaatgggattgctggatcaaattgtagctctacttttagttctttaaggaatctccacactgttttccatagtggttgtactagtttgcattcccaccagctgtgtaaaagtgttcccttttcaccacattcattccaacatctgttattttttgacattttagtaatagccattctaagtagggtaagatgaggttttattgtggttttgatttgcattcctctgatgattagtgatgttcagcattttttcatatacctgttggccatttgcatatcttcttttgagaattgtgtattcatgtccttggcccactttttgatggaattgcttgtttatttcttgctgatttgtttgagttccttgtagattctggatattagtcctttgttagatgcatagtttgtgaggattttctcccactcgataggttgtctgtttactctgctgattatttcttttgctgtgcagaaactttttagtttaattaagtcttatctatttatctttggttttgttgcatttgcttttgggttcttggtcataaactctttgcctaagccaaagtgtagaagggttttttcccatgttatcttctagaatttttagagtttcaagttacagatttaagtctttgatccatcttgagttgatttttgtataaggtgataaattatgaaccagtttcattcttctacatgtggcttgccacttatcccagcactatttattgaataggacatccttttcccactttatgtttttgtttgctttgttgaagatcagttggctgtaagtatttagctttacttctgggttctctattctgttccattggtccacgtgcttatttttatactactgtcatgttgttttgataactatagcctcgtagtatagtttgacatcaggtaacatgatccctccagatttggtctttttgcttattcttgctttggctatgtgggctcttttttggttacacattaattttaggattgttttttccagttctgtgaagaatgatgatggtattttgatgggaattacattgaatttataaatgacttttggcagtaagatcattttcacaatattgattctgtccatccgtgagcatgggatgtattttcatttgtgttgtcaacaatttctttcagcagtgttttgcagttttccatgtagagacctttcacctccttggctaagtatattcctaaggtttggtttggtttggtttttgcagtcattataaaagggattaagttcttgatttgtttctcagcttggttgttggtgtacagcagtgctactgtgtacatttggtatcctgaaactttactgaattcattcatcagatcgaggagctttttagatgagtctttagagtttcctaggtatacaatcatatgatcagtgaacaatgacagtttgactttctctttactgatttagatgccctttatttctctctcttgtctttttgctctggctaggcctttcaatactatgttgaatagaatggtgaaagtggccaaccttgtcttgttccagttttcaatgggaatactttcaacttttccctgttccatataatgttggctgtgggtttgtcataggtggcttttattaccttgaggtatgtcccttttatgccaattttgttgagggttttaatcataaagggatgctggatttagtcaaatgctttttctgagtctattgagatgatcacataattcttaattctgtttgtgtgatgtatctcttttattgtcttacatacgttaaaacatccctgcatccctaatatgaaacccacttgatcatggtgtattatcttcttaatattctgttggattcggttagctatgtattgcatcaggatttttccatctatgttcctcaaggattggtctgtagttttctttttctttttttttttttttttgttatgtcctttccttgttttggtattagggtgatactggcttcatgaaataattagaaaggatcccctttctctctatcttttggaatagtttcagtaatattggtatcaatttttcttttaatgtctgatagaattcagctgtgagtccatctggttctagactttttttgttggcaactttttcattactgtttaagtctcactacttgattttggtctgttcagagtttctatttcttcctgatttaatctaagagggttggttatttccaggcattttccatctcctgtagattttctagtttgttcacataaaggtgttcatagtagccttgaatgatcttttgtatttctgtggcattggttgtaatatctcccactttatttctaattaagcttatttgtaccttttctcttcttttcttggttaatcttgctaatggtctatcaaattttttatcttttcaaagaagcagcttcttgtttcatttatcttttgtattgtttttgtttctattttatttatttctgctcaaatttttcttatttcttttcttctactggctttgagtttggcttgttcttttttctctagttccttgaggtgtgaccttagattgtctatttgtggtctttcagacttcttgatgtagacacatccctcattgatgcaatgaactttcctctagcaccacttttgttgtatcccagaggttttgataagatgtgtcactattattgctcagttcaaataattttttaatttccatcttaattttattgttaagacaaagatcattcaagagaagattatttaatttctatgtatatgtatagttttgagggttcattttggagttaatttccagttttattccactgtggtctgagaggatactttatataatttcaattttcttaaatgtattgtgactggttttgtgacctatcatatggtttatcttgaagaatattctatgtgctgatgaaaaggatgtatattctccagccgttaggtcgaatgttctgtaaatatctgttaagtccatttgttctaggtgatagattaagtccattgtttctttgttgactttccatcttgatgacctgcctagtgctgtcagtagagtattgaagtcccccactattactgtgttgccatctatcttattttttaggtctagtagtaactgtcttataaatttgggaggtccattgttacgtgcatatacatttaggattgtgatattttcctgttggacttatccttttatcattatagaatgtctgtctttgtcttttttttactgttgttgcattaacgtctgtttcgtttaatataagaatagctagtcctgctagctttcagtttccatttgcatggaataactttttccactcctttaccttaagtttatatgagtccttatgtgtgagtctcctaaaggcagcagatacttggttgatgaatttttatccattctgctatcctgtgttctttaagtggagaatttaggccatttacattcaatgttagtattgagatgtgaggtactgttctattcatcatgttaattgttgcctaaataacttttcttttcattgtgatattgtttcataggccctgtgagatttatgctttaaggaggttcattttgatatatatttcaaggttttgcttcaagaattagaattccttttagcatttcttgtagtgccgcattggtagtggtgaattctctcagcatttatttgtctgaaaaagactatctctccttcatttatgaagcttagttttggtgaataaaaaattcttggctgacatttattttgtttcaggaggaccccactcccttctggcttgtaaaatttctgctgaggaatctgtggttcatctgacaggtttaacttataggttcctgatgcttttgtctcacagctcttaacattttttccttcatcttgactttagataaccagatgactatgtatgtacctaggtggtgatctttttataatgaatttcccaggtattctttgggcttcttgtatttggatgtctagatctctagcaaggccagggaagcattcttccattatttcctcaaatatgtttttgaaacttttagatttctctttttcctcagaaaaataagttagtcttagatttggccatataacataaacttaaatttctcggaggcattttaatttttttctgatatttttttcttagtatatgtctgattgggttaatttgaaagccttttctttgagctctgaagttctttctactttttcttgtctattgttgaaactttccagtgcattttgtatttctctaagtgtgtctttcatttccagatgttttgattattttttctttatggtatctatttctctggaaaatttttatgcatattctgtggttttttttttaattctttaagttgggtttcacctttcactggtatctccttgagtagcttaataaacaaccttctgaattcttaatctggcaattcaaaggtttctttttggtttggatctattgctggggagctagtatgataatttcaaggtgttagagaaccttgttttttcatattacaagaattacttttctggttccttctcatttagatagactatttcagtggaaagatctagaacttaaggcttgctattcagattctttttttccatggggtgatcccttgatgtgcgctccttctttctctaaggatggggcttcctgagtgttggactacagtgattgttattgcttttctgcatctagcaacccaggctagatgcaggctccaggctggtgctggggaatgtctgcaaagagtcctatgatgtgatccatcttctggtctccaagccatagataccagcacctgctctggtgcaggaaacaggggagtgaactagactctgtaagagtccttggttgtagttatgtttattgtgctggctttgtcaaatgtttatgctagcagtgaagttgtgacatggacaggcttgggaaattccggctagcctggatgtttcaggcagtagaattaactgttgttttctccttcttggaatcagggttattctgtcatgagttatgctgtaatggcctgagttagttggcttccagccaggaggtgcactttcaagatagccccagatgcagtagtagtagggggatctaagcttgcactaagttggccagcataagcattgtggttcctcaggcaatgggcatggtcataaagctcccaagattttatgtcttttgtctttggctaccagggtgggtagagaaataccatcaagttagggcagagttaggtgggtctgagctcaggctatccttgggcagggcttgtcacggccactgtctttaccatacagatctcagaagtcacgcagcagccatccacatgaatctactggaggtaaacaatctacagtggtacttttgcttcctgaaatcctgagaaaaccaagcttctttgagctctctgctggaccatttctcagacctcatttatacagttccaagaggcacattttactaaatcttcccaaacagcagtataaaggtaagaacagagtgagaaaagaccatggccttgctattgattaagggaagtcctagaaaatactaaacaatacttttgcttatacaccattgacaagaattatgttatatgctcacatgttgatgtaaaggagcctgggaaatgtagtctttattgcagaccggcatgtgcctacctaagaacaggggtttcaattatcttggaacaaaaggaaaatgaatactgtggaacaaactagcactctagtgctatgccagaaaatggatttgggttacgtttataccatgactgaaaaggtatttgagttatgtttctaaccctttcatttgtcacaaaaaaaaagaaaaagaaagaaggaaaaaggagaacagcaaaaaaaagaaaaaaaagaaaaaatagactaataaatgtccagaaagaatctcaaaagtaacagtgttcaatctagatgaatatattcaacagatggagaaaattacaaagaaaacagagccataaattttaaaaataattaggataaattagaagttgtaaaatgtaataaactataataaaataaatttggtattaaaagtattataattccttaccttcttgcatcctatgacaaagacagtagaactcaatagtgctacatttttataagaactaaatgcaagtaacgtggataaagactacaccattaatatgtagttttattgaatctgaaattatttgctcactactccattaagaggctaagttatgatgggggactaatgctggattggggcaggaaaggattgacagagtggaaaataaatgttggaaggcaacctgtggtcacaatcatacttttttattacatctctctgattctgacacagttaaaaatacactcagaatttgagaaaataaggcataatttctagatatcattattacagcagacagacaattatgcaagagcactaaccaaagcaattatactaccagcatggggcaacggcagccattttgcaaatccatttgcaccctccttcctctcctcagggatgcactgagggcataaatgatttcttccactcttatttccaaattatctatatgatgatgagtaagggctgttccattccaaccttacttatcatcccattaaacagtggaaaaatgtggacagcaggaatattgaaaattctgtctgcatttacaatccaatttcctacaaataatcttccagttctggctgaaaagtcaagcacaatgagcttcacatctggtggatgcagtacatcaagttaccaccccactcagcacacaggctttactgccaaatgccagaacatcctgcagcaggagcaatggaaagacctacattctattgtttataaactcattgtgtgggaaaagcgtagttaagctggttctattctaatcatctctgatggcacagggcaggtgattccaagataatggcacctttgaaatgggttttatggtgatgcaaaatttataatttgtaatagaaaattacattatgctagctactaggtcattttttccacttggataatagtatttttatctcttctgttctaatttagaagtcaatgcagtgtaaataactacagcatttgcttattaccatcaaattcacagaagcaaagatgattagagtcaattttgtcatttttgagttaatgtggtacaagggtattttagtgtctctaacaagtgtcaaagaaacaaaaaacatcaaatacaaacataccagttttgaattttctgctttttgtatactctccaaaagtttatttaggacatatccaatatagtttaccataaatagtacagataagcaagctgctcaaatccaaaggggtattttttgaggtagtcaatgcaactcaattgtattttaagactatctctcttgctttctctacattgtagaatttattaactattttgagataattttatacttacaaaaaaggttgcaaaaatagtacaatggaatttcagtaaatttgttttcatgcctcagtatatgttattaatgtgaataagaaatagtaaccaaaacagcatgatactggtacaaaaatagacacatggatatattaaaaagaatagataatccagaaataaagccacatacgtactaccaagtgatctttgacaaagttaacaaaaataaataataaggaaaggaaaccctgttcaataaacagtgctgggaaaacttgcaagccaaatgcagaagaatgaaactggacacctacttatcatcatctacaaaaattaatgtaagatggattaaaaacctaaatgtaatacctcaaactatacacatcttagacacaaaaactagaaaaagctcttctggacattggcctactcaaataatttatgactaagtcctcaaaagcaaatgcaacaaaaacaaaaattgatgattgagatttaattgaagagcatttgtacagcaaaagaaacaatcaacagagtaaacagacaacctacagaataggagaatatatttgtaaattatgcatcttctgtagattaatatccaggatctataaggagcttaaataaatcaacaagaatgaaaaacaaataaccccattcaaaagtaggcaaaggacatgaacagacacttctcaaaagaagacatatgagcagccaacaaacatatgaaaaaatgctcaacatcactaattatcaaagaaatgccaatcaaaaccacaatgagataccatattacaccagcagaacggctattactaaaagtcaaaaagcaatacatgttggtgaggatgtcaaggaaagtaacacttgtacactgttggtggaaatgtaaattagtttaacccctactgaaaacagtaaaaagacttctcaaaaaaccaaaaatagaactatcattcaacccaaaaatccccctactgggtatctacccagaggaaaagaaattgttctatcaaaaagatacctgcactcacatgtttattgcagcactattcacaacagcaaagttatggaatcaacttaagtgcccatcagtggaggactggataaagaaaatggggtacatatacaccatggaatactccacagccatagaaaagaatgaaattatgttctttgcagcagcaacgtaggtgcagctgggggacgtcatcccaaatatattaacacagaaacagaaaatcaaatactgcattttctcgcttataactgggagctaaacaataggtatgcatggaaataaagatggaaacaatagacactgaggactccaaaagaagggagggagggagaagagaaagtgttgaagacctacgtattgggtactatgttcactgttggggtgacgcgttcaatagaaacccaaaccccgacattatacaatttacccttgtaacaaacctgcacagatgcaccctgaatctaaaattttagaaatacaaaatataagaaaagaaatacccaaatgttatattcaagtaatattttcagagactatttaaaggagccttatcacagacttacatgaaaggtgggtatggtaagacattatttcttagcacttaaaaagtatgatgaattgctgcacctagtaatggttttatgtgcccctctagagaggagaaagaaaacaaaaaaccatcacttcaaggaagctcttcattaacctcatgaagctaactcagaattagcattaaatgccatcctggcccagaacttcttttgctacaattttggggcaattatgtatcactcttcaaagtgttatgaaattttttttggttagcccagaaacagtttataacatgatactacttgaccatggggatgatacaacataaatgttaactggattttcctgatagaagcaatgtcgctttataatttcttttatcaatttctcagctgtagaagccatctcctgcatttgttacctctatttgctgattatcttctattgaactagcttagatgttaatttgagaatgcattctgtttgtttgtggaataaaccaaatagtacattttctaatataacattttacttataaatgagttaacattttgttatatgaaacaggtttctttaaatcaaagatacaaaaagactttaaaaaaaaaaaacactgtatgctacatccacaataaatattttattgcctagagatacaaaacaatattttattatgtccaccagttaagcacttaaaaaagtaaatctgatgttcttcaagatgagctggcagtctatggtatgagaatacataatttttaaacagaaaagataaaatatataagcaatgatgctaccgaaaaaagtcaaagctatatcctgtgtcctctactgctccttccaaactccaataaatgaaaatattccaataggctcccactgaatataaatatatggagatacatatatctccgtaaggttaggaatgaaattagtttaagatttcttaactagtagaaaagaggggctaggaaacttagtagaagctatcgtttcacctgtggagatctgtgtttatatcctagctcaaacagaaagaaaaaattagtttgatattgacttatatatcccataacaatcacctgactaactctaactgcttggaaaatatcaaagcccaaggcagcactatgcaaaagcccaatatataaaacatttacaaacagtatgagaataattatattaataacaataatgtgaaaaataataataaagcacaaggaacagaaactaaatatgtttcatctccccctttattatcaatggtataaaagtcaattaaccaattatcaagcaccttctctgttcaaccatttctgtaagaaactgagagatataaagataaatatgtacaaacagaagactaacataactctaatgtgactctcattcctaaagggttatgcaacactaggtggggttgcatttatagaacttgagcactaaatagatgactgattctgaagaccaggagaactattcccagtgtacagcaggggccattggaatgcatttcaatccacagtgaacctctaagatatgcaaaaataactcatctgagaaaaaaatgttctgattgaatacaaaattactagttcacaaacatgcctgagctgcaccatcaagaaggagactgtttaataacagagattctcgggcaccacctcaactctttggaatctgcatggaattaatacttgcataaagaaacaccatttcactagatacctgtgagtcctgtagcatcttcaggcattttaagctaggaaaggccagggaagcaaatttacctaccccagggataagagtcagggaacttacatcatctctgggaacaagaatcaagttcacttaagcaatatcttaccaagttcttccaacttgttagctcacagccactggcctggacactatttggtcacatgcaacaatattgcttctcggccaattttaagaagctggcattttgaggattaaatgtggaggtttctgtgccatgtcctgtctaaagcaccactgtactagtccattttcatgtgactgataaacacatactggagactgggcaatttaccaaaaaaaaagggggggttaattggacttacagtttcacgtggctggggaagcctcataatcaaggcagaaggcaaggaagagcaagtcacattttacatggatggcagcaggcaaagagagcttgttcagagaaatccccatttttaacaccatcaaatctcatgagacccattctctatcatgagaacagcatgggaaagacccaccctcatgattcagtcatctcccactgggtccctcccacaacacatgggaattatgggagctacaagatgagatttgggtggggacacagagccaaaccatatcaaccacatattgccaaagtttaagtgaatgtcacatgatagaactcacagtgaaccgagtgctcctaattgaacaagatgccttcacagaggaaaaaaccataaaacattaaacctctaggtattttttccattgttcaacaagagaagtcatattgtcatattgactcagttgtttttaatgaagataaataatcaaaaccctcactttaagacactttaagtagataaagcaccataggaccactgacaataactgtcattagaaggttagggatagttgatttaccccactttctagagaaagagatttgtaacagggatatccttacactgagagttttaaaggaaagttaaggagaatactagccaggagaggaaagttaaggagaatactaggcaggagagggtgtttgggagtcttcaaagttgtggatatagaaacagacatttctcacaaagcatctagagtgccaacaccataaacccagcctcacctacattttatcccttggcagcttcatttgtgtaagtggacggtggcttccagctgaatgaaaccattacagctgaactggtgccatggtcagggttccacctatgaccctgtaccactagaattattaaacagtaaagacaaagaatgcatatctgccaaatttttaggtaatacaaaatagaaggatatcaaagatattggtccactttctgaattcaaaaatataatagtttataatgttgagacaaatatagcaagataatcataacagagttaattagaaggccctgtgtgtaccaatagaaagacaaaatcagcacaactgatcatcaaggtatgaatttgtagtagcacctaaacaatacaaagaaaattttaaatcagcaatatgccaaccctaagcaaactccaaagtggcacatttctcttattataatttatgagaagtacttggaaaagaaattacaacataacctataactttcttatcacacatttatttgtattacttgctaatttctctacaatatattatgttgaggtgttagcagttgcctttgtacagatatattgactatacttgtatgaatttaatccccacctctcttatttgcttgaagaggaaggacaaatttatttttggcaagaaatttaaagcaagtgattccttatttattgtcttagttattagtcacagttagaaaatcagtgatcatacgaacttatcaataaaatattttattcattgcttgtatcaaattgctagtgtatttgtcttctgtattttttaatatgacttttctaaaattggttctcctttcttagatacaatacttgctggaaaattcagggaggaaaagggaaaatattaatatttaagtcatgaggaaagaagattctttactcaaattatcactttcccactcagcagcagccctgagtaatatattcattataaaccagcagcactggatctcttttagtcactttataacactgacagaatcaatagttaaaattagacttctcattttcatatcagaggagacatcaacattagtttctatattaaacattctggaactgtagaaagctttttaaattaatttaaatgatggatgcagaattgtctgaccacttatttaatagaaattatgattatcaaccaaattatactttggaaaggcaatcatctcgtccctgcaaagcagtaatacagtttcagcccacaaaaagtactatgtatgaaaaagtattttacagtactttttatagttctgaagagtatcacattaccacttgtcaaccagcaattgcatcataattcaacctgctgcaactataaaactgtgtcttgacttgattaaacaaaagacacagtatagtgttgtacatatatgtgtgcatacagcaattctaggaatgaaaataatttaatatgcttagcatcaaaacatacaatgagacaaaagcagagcatctaatgaaaataaaatagattctacctttaattttctattccacttggtgtcagttttctaaagagtatttgtctacagacaaatcagctaaattttgacagagagctgattttatttcctttatctaatatagcaaagatctgaagaagagaggaatactatcctaaaagtgttcctcatgcttctttctatcacagcagtccccaacctttttggcaccaggggccagttttgtggaagacaatttttccacagatgggggcaggaaggggttggttttaggatgattcaagcacactaaatttattgtgcactttatttctgttattattaccttgtaatatataatgcaataattacacaactcaccataatgtagaatcagtgagactcctgagcttgtcttcctgtaactagactgtctcatccgggagtgatgggagacagtgacagatcatcaggcgttagattctcataaggagcacacaacctagatccctcacatgcacagttcacgatagggtttgcaatcctataagaatctaataccattgctgatctgacaaggggcagagctcagacagtaatgcgagcaatggggagcagctataaatacagatgaagcttcacttactcccccgccactcacctcctgctgtgctgccatgttcctactaggccacagacccttactgtagggttgaggatccctgctccatcaggtcatggcattcatagaaaatagtaagatatacctgccctaattctcaggggccataggagtctggccatggagctatggttgttcatcctaagtctcactggtcacccaaccagggctgaggggtcactatctcaatgtatgtgttacttatcagtggtgaaatgggttgggagcatctgatttaggtaattgtgggattcacaaatggaagaaaaactatgataaatattacagaacaaggagaatttccccagatccaaattatagaaaatgtttttggaggactgatatgattatttgtaaaaatttgaattgccaggatgctgggaagcatagtagttataagggaaggttttgccctgtgaatgccttagctcagaacaattccatcccttcctagccatacaaatatgaggaagttactgaactcctccaagcttcagttttctattctgtgtaatggggatagtaatagcacctacttcaccaggctgctgcaaggattgaatagcttaatatgtggtagcccttagaggaatattcaataaatatatcttaatataaatacattgaaattaattttttattttctaacaatatcaaaatatgaaaaacttgcaagaaaatagaaagaaatgttatttttgagacatttgagaataatctgctacatgaatattaagtatactaagtatattatttatttttaaataaatttttaaacaattttactgtatttttttaaatgacattctcctacttaactatgaaacaaccattaatatcagacaattagcaaagatatgcttccaccatctaatcctcagacctcattcaaggatcagcacttgtcccagtaaagtcttttataaagaatccagttcagaattatatgtgcatttgttttcattctcttttaatttggaggagatctcagtctttttctgactttcatatcttgacacttttgcacactgcagtccaattattttgtcaaatgttcctcaatttggcttcgcctgtcatattctcacaattagattcacgttaccaatctttggcaggaatatcacaaaagtgatgctgtgttctcattgcatcctataagtttgtacacactttgatttgtctcgttagtggtattggtaactgattattttatcaggtggtatctttcagccttctctaataaaaagttaatcttttttactttggagttaataaatatttcaggggacattattatgaaactattccatttctaatcaatctttcaatataatcttttatttatatcagtatagattcatggatttatagtctattaatgggctatagtcaactgcaactactacttattttgatgcttgagctcaaaagagatcatttgatatgacccaatcattttctgtgcactttcttgctttctggcataagatgttccaggcttattttgaacattttctccaacagtccaggaatcaaccatttttccaagaaacattagtttcattttagtgcagaataatgtttacaatccagtatctcgcactaggggtacttgttggtagagggtgtcacttctcccaggtcctctcagtggacaaagtaaaggaatacaatttatacacacacacatacacatacacagagatatctatatagaatccataaggttacacaatacattcaattccaatccaacaccacacagttcattctagttttttatttttccatatttgaatattctttgacggttagaaacctggctcctcaatcattactaatatggtccaacccctgcacataaccaatttcccatcaccacaactacaatcactcccttccccgacacagatattctcctcacaatgcttagtctccattgtaaggtgccccttctagcagaagtccatgtcacccctctcatgtctgacactcctcttttggttatcttcccatataaattcccaccttatcatccctgcttgggttataacacccaacaataggccattcgcatgtgtggatgcatctgcaccatacgtggtcttctacatttcattctgggccaccaaaatcacctccatactccagaatcaatgtctatcttcctcagtcctgccaagtggcttttggactaaattatttcaagaaagggaagaaaagaggaagagcaagagcttgtaatgcttaaaatatcttgtgaggtgcaaatgctctaatggagcttaaagtgctttggaagcagggaagcattatacaaaaattaaatgtatttgattctagatagtgcccccagcacacacagctgccttctcctacatcatagatccttagaaaaactagaaaataactaagaaaagaaaaagctagttagagtggatgggtggatattagatacaagatagatagtagaaaaaagaaggggaatttctagaggacgactagggaaattactctcaataatttctaaaacatgcacaggattgtacttgaataaggaaaccaaagtgccttagatatgagaaatggattggaggatctaaaaccaagtgataagtgaataattgggacagtgcaggaggaacagtcagatagaaaacatcctgtgttctatcccccagctccatctctcccaatagcgttgtcctcctgcaggtaggaacattgagtgtggacttggttcagagtcaggaccacacattggtggctggtgatgcccaagaagaatgagaacacccttcttcttataaggccagccatacaataccagctctggctgggcttctctctcctctgaatcccatgaggagaggttggagcaaaactgcctcaactcatctctcaccttcccctcagcatgaatctcaagtaaaagataaacatacatgcaggtatcaccaacttgtaatttgcgaaaaaaaaaatcaacaccatggatgtcatacaccagagaatagaggaaaatatatatatgaaaatgaaagagaaatggggaacagattcagaagtgcctacacattcttttgctattccaacactgaggaatatgaagaaagaaaagaaataagagaacttcccagaactgaggaaagtcagggtactcatgttgtaaaggcaactaagagtagaagggtacttcctaattaatgtgatataacaagtaagagatactaatgtttagcaaggaagacatgcagaagatgtgattgattatctgagtattggcagaaaatatcaggaaaccaggacctgtgtaccactgggcagggcaggcgagggagggatggacaccaaaatcagggcagtttagttatgtctaaaagatatatgttatgactcagaaaaggttgtataacaagattataacattaaaaaaatgtgttctcttctcctattttgataagtataccttcattgtcataaaattggaaacaggcataatgctacatcttttgatttactgaaagttagtcaaataccaagtggctaatttagttattattgccatggtctaaatagtctcttaatgggtgagcaacgtttgaatcaatagcataaagacataataatttataaattattatatgtacttttttattccataaaagtaatctttctcgcttttgcttcagtaaaattattagaccatgctataatctagattttcacacaatttttgttctgttgatattaatgtcaaattagatatccttctgacgccactgtagtgtttacttagtttttattcattgtaatttggagtaattgttcaccgctgaaaatatataagctgcaattatcatagaattgataaatgataatatataggttaaaaatgaataatacattttacatccagttttacatattcaaacactgtaatagactacatacaataaattataactgttgtagaaagtattataaaatattttcatttgttgtataaatcactaccccatttaagtgtcataattttccacaacacttaaatcaatatctaggctcataaaaatgtttttaagttctttcttccagtttttcaatgctgaagcattataaagaaaaacaaattaaaaatcagtatgctgtacaatttggttaaacctccctttgagattataccttgatttagaacaaccagaaataatctcaataaaaattagttttttgagtctatgtgtactttgaagaaaaaagttagttttaggcttatttgttcataaatcttttcctttatagtcacataattttcattatatttcatacaaatgttaatttttgcatatgtcacataaactttctattaaacctttctgtaaattaaaaaaattctaatttttgaaagatgaaatattgacacatatttggtacacttttgctaacattttcaataatgagcaagagtttataatcaaatgactgtgaacagtacatattcaaaattagttttcacccaaaaccatggtttgcatttatttgaagatctactattgtttcaaataactattccactgcattttattcacatctcatctaaattaaacataattgctttaacagtgttcagttgacattctcatcatgcatcaacaggcgatttcatgtcaaatctgatatgtgattcatcaaaaggttcaatctttgggcacacagatcagatgtgatctttgacttgctccaaggaagagcatcactcctggcataggtgaggccataacccatggggataaattaataatgcgctgccaaataggtcatgaaatgtttgcaagtatgtaatatatgttctggcctaaataccagtcatgttagcatcattattacaagtttacttgtaatcatgttttaagctaatgctcaatgttcaaaattgttttcttgtttttcctcaggttgaaatttacactttctacaacagatgtatagtcaatgaaatagtcattaattttggatttctttatttctggtcttggtggttaaatcatatgcataataaaagtttgctgtttagaattcttattttgtgcattctcatttgctgaatatgcactttataaaattatatttttaatttcttctctcacttgatttctcccaaaattacccatctatttttatttctccatctaggcaccatttgttttattatgtttgtatttttatccgtcttacatgattagccattctagcatcatattttgaaaacatttcagctacatccagacattttccacctatgaatgctacaaaaagaatccttattcttagctaaatattggacacatattaatcttttaaaaacttcacacaaatgttatcagtgttcttgggtctttgttgaatataatcaattatttactcttttttttcactacatagaaataactgtactccagatctctctctctctgtatgtgtgtatatatattatctataatatatagtatatatatctatatctataatttaatttattttatataatatatacattttatatataatatataaattttatataatatataatatatattatagataatatatatatacacacatacacagatggaagcataaatataaaaattggtggaatttttaatgagatcatattctaaataatgaatattaaatttaaattcatttgagtttaagagaaataaaattggagagatattatgttcccaaagatttctgtaaccttaagacaaaaaaagcattaaaaactttttaaattctgtaaatacagatgtgccttgctgtgtgcaggtgatactttatgttttttaatagagaaagtaattgtttccagttacctatacttcaatgaccaaagcttatcttgaaaataaagtatgaaacatataacgcaaattacaaaacactttgtcttttagctgacaacaaaaagccatcttctagcttacttcgccatttgcaaatcatgttatataaaataaaacataaattccctgtgatattcacctaatggaaagttgtaaatattaatttgttcgagacttttattttgctataaatattcttaggctgtatgaaagatgtgacagccattttttagtatcatcttccaataatcagagaaaatggactcatttttcttctccaactagccaacttcatgatggtaattcgccttctcatggttgggcaaagttgcatttattgattcggatttgtgaattcaacataaataactcttttttctcatgatttttatcaataactaaattcttcatttagtaaaatagatataaatcaaacagttcttatctaatatgcttaagttacaggtttgcatttggtaaggttaatttttggttcacttttattgtttggatcagtaactgactttcaatgaataacaaatctgtactgtcctttagcaaattttacatggttcaggcttttaccagcataaaattttcactttatttctttattgttctaggtttttttttgttttgttttgttttgttttttttttttttttgagacggagtctcactctgttgcccaggctggagtgcagtggcacaatcttagctcactgcaacctctgctgctcgggttcaagagattctccctgcctcagcctccagagtggctgggattacaggcgcctgccaccacacctggctaattctttttttttttttttttttttggtagttttagtacagatgaggtttcaccatcttggccaggctggtcttgaactcctgacctcgtgatccacctgcctaagcctctcaaagtgctaagactacaggaatgagccactgtgcctggccctattgtttcatcgttttaacatattaatcacactgcctctttgaaaatttttctccttttttcttttcagttgtgctttctttctgcactctattttttattagcttggccctacttatttttaatgaaaaaattaaaaatgaaatgaaattatattcctagggtagaaaagtttaatatattttctttccagatatttatagtcaatatttatagactcatccaaaactcactaattaaaataaatgtaaaaaataattcctatatgtgaaaagctacttttaaagtatttacaattaaatgctaaaattaagataaaatgagaactttaatttttaaatcaaaattatttaaataaaaccaacatttacatttagtttctgaataattaaatcctattaaatattttttaaaaataacatttttctgagtcttacagtttaagatccagctagtgaccaatgtaaataatcaacatcctacatcacctgtgacacagctggattttataacagcattgtagattgtttaatactataaaatgtttcccaggcaccatctagcactattgtgattactgtgctaatttattgcaccttgattggaagaggacgaacagaaaagaaaaaatatgcacttagggctatcgaaagcaatattttattttgaaaaaaactattaaatatactctctggccgggcgcggttgctcacacctgtaatcccagcactttgggaggccgaggcaggcggatcacgaggtcaggagatggagatcataatggccaacatggtgaatccccgtctccactaaaatacaaaaaaattagctgggcgtggtggcgggcttctgtagtcccagctactcgagaggctgaggcaggagaatcgcttgaacctgggggacggaggttgcagtgagcccagatggcgccactgcactccagcctggtgacagagcaagactccatctcaaaaaaaataaaaaatacataataaataaacaaatataatctctaagaagaagaaatggacattctcattaatttatccttcctcttattttaaggattctatggataaaatcttccccaaactcagaggcagtgttcatgtctgatatggcagcagcagcacccacagtgtcatttcctcagggaatacctaccttttgtttgttggcacaggtcaagagccgtggaaagacatttccccggggccccaattgggttaatcataaaatggatgcttgagatataattgctcaatgccatcccttagtaccagatccagaatgataagtgccctgaaattcttaataaatttattaattggacttctgatatgtgaggccaagggcaggggcacttattttccctaaggtaccatagaaaatataattcagtaatatatccattctaagcaacagttaaaaagagatatctctgtgtactaacacagaacattcatcaagatattttgttaggtgaaaaaaaattgttacaaaatatatgtataataccatttatacacattttaaataaaaatgacatatttctatgtattctgcatatgtacataaacaatagaattatagatgcatatgaagcagattattatcctagagaaggtgaggaaaactggctaggaataaaacaggaaacttaactttatctacaatatttaagttttcataagaaaaatgcattaattattcactatattattaaaatttgaaaatttcccttcaaaatgaaatgtgttggaaaacttttaattcgtaagtttgacaatatgaatgttacatcatgcatatatgtggttcaaatcattaatagactgctcttagagctgttatattctttctcattctacttgatgttatgtatttcagagttccttaaaatttgaatacatctactaatatgattcttcattactccatcagatggagactttagtagttatctggatgtgccctttttgatataaaatatatttttattatagaaaaacaatccacaaatattcatattgtgtgccaaaagttgtgctgaataattttttatgttaatttcatttaattcttataacaactctgtaagaaaatgttatcatttttacaaatgagggaactgagggctgtggtaacaaatgttgtcaacaaagaatccagagtgagaaaatgtaaacgccagagagctggaaatatcaagacctaaatctaataggttctaggtaggcaaaaggatgaggtaaatgcacagcaagcatggaacaaactcattttggatttcgatagtataaggaaagagttatcaaaagagaaaaatgtttacccacaatgtctaagtttagttgagctggattcatcctggagaaaaagctgaacaaatgtgtattttaggcacgaacctaaataaagtagctataatgcttcccaaatttaacagaaaacagtcccagagaagggtgtactaagaagtagaataagtaaataagatttagtgcaggaaggaaaaagaggaacactgaatggatcagctttcacaccttctggatggccagacaagataggctttttttgttgcaaaacagcaggcctggaatacagacccttgtaaggttccacaggcttaagcagcttgatatcccctatgcaaagctgctagtgcttaacagatagttaatctaatgccaacactcaacattgtttcagaagtcccagagaaatctcattgaaattttaaatatgtaacacaaaatacaatctaaaactagtagttaaacaaggttagaatttatagaatacctccaatgttttcaaagtgtttccatctatctaattcttgcttaaaggtgtacttttacttattttcctagagaaaggtgtgccctttcattattattttagtgtgtggatgtatactgcatattatatatcagtattttttttcctatgtaacatacattatctttctcttccacttggaaggctctgatttacaacaagacatttttaccatcttgtgtcagcaatatgaattgcaggcagaatttaaaaacccagtgaaaaaataacaagcctcagaaggttagatgtggaagaagacctacatgctttctaaaaaaatactgccacagtcagcaccactatgctaccaaatttcacagaaagctcaagatatacaaatgagtttctgattcccaaagtgattgtgaaaagtgatcccgtgacaagctgaacattttaggtgatattttctttcccacctctagagtccatgcatgctctgaatggataccaaccacaaaactcaagattgttaactggggactaccaatactgccacacaactcaaggaacagaacaccatgaggatggctgagactagaaagtgggtggtatctagaaataggttcattctttgaagataaaatatgtcttcaggatagaggcatacttccttttattgcaccttccaaatattgtgttttcaacaaattcaaggtttgtgacaaccctgcatccagtgagtctatgggcatcatttgtccaacggcacgggctcactttgtgtccctctctcatattttggtaattctcataatatttaaaattttcagtattatatctgctatggtgatctgtgaatagtaatccttaatgttactattataattgatctggaatgtcctgaagcacacacacagaagatagtgaacttaattgataaatgtatgggttctgactgccccactggctggctgtttcttcatctctatgcttctcctcaggcttccctattccctgacacacgataatattgaaattaagccaagtaatagccctataatgacctctaggtgttcaagtgaagaaaaagccacaagcctctcacttgacattaaaagctaaaaataactagactcagtgagaaggcacaaataaacccaagatagtccaaaagctaggcttcttgcaccaaacagttagccaagctgtgaatgcaaaggaaaagtttctcacagaaattaagtgtgctactccagtaaacaacaaatgataacaaagtgaaacagctttactgctgatatggaataaatattaataatgttagaggtctggatagaagatcaaactagccacaacattcccttaagccaaagcctaatccagagcaaggccctaattctcttatattttatgaaggctgagaaaggaagctacagaagaaaagtgtgaagctatcagaggttgatttatgaggcttaagaaaggaaaccatcttcatcgtataaaagtgcaaggtgaagtagcacatgcttgcacttcataatataaaggtgcaaggagaagctgtaacaaggtatccagaagatctagctaagatcatttatgaaggtggctacactaaacaacagatttttcaatgtatatgaaacatccttctattagaagaaaatgccatctaggacttccatagctagagaggagaagtcaatgcttagcttcaaagcttcaaagtacaggtcttcttgttaggggctaaatgcagctggtgactttaagttgaagccaatgatcatttatcattccaaaaatcattggacccttaagaattacactaaatctactctgtctatgctctataaatggaacagcaagcctggatgacagcatatctgtttacgacatgctttactaaatattttcagtcagccttgagatctactgctcagaaaagagattcttttcaaaatattactgctcattgagaatggacctagtcacccaagagctctgatagaaatttacaatgtttttatgcctgctaacaaaagaaccattctgcagcccattgataaaggagtcattctgacttgcaagtcttattatttaagaaatacactttataaggctaaagctgccataaatagtgatccctctgatggatctgggcaaagtaaattgaaaaccttctagaaaatattcactattctagatgcaattaagatcattcatgattcatgggaggaagtcaaaatatcaacatgaacaggagttaggaagaagttgattcgaactctcatggatgactttgaaaggttcaagacttcagtggaagaagtaactgcagatgtagtggaaatatcaagaaaactagaaatagaagtggaggctgaagatgtgactggattattagaatcacatgataaaacctgaatggaggaggaattgcttcctatgaatgagcgaagaaagtgttttctgagattgaaactactcctggtaaagatgttttgaacattgttgaaatgacaacaaaagatctggaatattacgtaaagttagttgataaagcagcaacaggacttgagaggattaactccaatcttaaaagaagttctactctgggaaaaaatgctatcaaaaaacattgcatgctacagagaaatctttcctggaagaaagagtcaatcaatgccgcaaactttattattgtctcattttatgaaattgccacagtcaccccagcctttagcaaccaccatcctgatcagtcagcagctttcaacactgagataagaacctccatcagcaaaaagattatgccttgttgaaacctcaggtgattgcagcagttttaacaataaagtatttttaaattaaggtatatacatttttagacataatgccattgaacatttaatacactccattatagtgtaaatataactgttatatgcactgggaaaccaaaaaattcgtgtgactcaccttattgcaatatttgctctattgcagtgttctggaaccaaacttacaatatgtctgagctatgcctgtacacatattctaattttgtggtaaatgtataaaattctaggagaaaaaatagctttggaagacttttagcaagttagttttatttcatctttatcacatcagagggctagggatcataaaaatggttgcaactttcttattacttatatagaaaacctttagcggaaagattcaaaatgtctatacggataattatatatttttaatacatgattttacttacctctgtgacatttattaaagcttaatgttaatatgttttataaatccattgtaacttcttgtggcagtctacatttagtcctcaccccttacagtcactgaaaaatttagccaaaaataactaatgctacataagcatatggctctatggcataataaaaggaaaatctatgtcatccatggatttcccactaggttttgaagctctggctttcaagaaaatcttcttaacactgtattaaacacaaccattagtattatctttggaaaatcaagcattatttagaccatcaatcaaattcataggaaaatctcacaaacattatccctaaaataaaaaagcatttaagcacctaatcatgcatgaagccctcagtgctaagaaaattaattgtatagctctaggtcattgacctgtagtagttttacaacctgaaacagatcatgtccctgtccctgtaggtcttgtggttaacagagaagtaatagtagtcttcaaggagtttagacctttacatgatttcatggggaaaaattagaataagtatctgcaggtatttgggacattcctttgttttcttgttcaagaatgaaacaaccaaaaatcaagagaaatttatcttttccatgtaatcatgtgataaatactatagaataaaggcaactgggccttctccagtatggaaatttcccggtactagatgtagtattgtatgcaatgatgtacagtcttccgcagatttaccaccacaactatccacacctaaccccagtatacagaacaagtattcccccctcattgaatttatcactattgcaattaattcatggagtactttcttcattgaatgtttagtgtctgtttcctcctgtttgtccacaaactccataattcctattatctacttgcaaagcttagcacatggtagttgttctgtaaatgtttctggaacaaaagaagggaagaagagtaaaaaggaaaaaagagaactctgaccataaaacatgacatataattaaaagaaaagactctctaatattcagcaaatacagagcagctagactaacatttaagcactttgaaaccgtcagttgacaaatttaagccataaccactgacagtttctcatttcctgagaaaatgtaagacacaaattcttagcctgctttaaaccttaaaaggtcccaaaacatccttttcaattgtcccatatcaaatctgcctcccttaactggtgctgtcttggctgcctggttactgagctgtaatctcctcataccccattttctgagaagccctagctaagttacaatgattgcctgtataaattaatctccactgcaataacaaaggcaatcccgtcagcagttgacattctggcttttaattcactgaacaactttttgtttgttaatcaaagctgcatctcatcccattgaggatgtgatttgtctctgcttctctgggtcgtggtgtcccttacgccagtgctgctcaaaatgtgatccctgggctagcattagcaccttctgggaactcattagaaatacaggcctttatgctcagtctattgaaacagaatatctggcaacgagtccaaggactctgttttaacaagttcttcagaagattcttgtgtatgctgactttgagatgcatagctctacacactactgtaatactagtctgtggcatagacattagtccctcatactttcttaggtacagtttgcattaggaaaacatgaatcagctagcatagacattccagtaccctctctcgctatcctgcctcttcaccagcctccagtgggagtagtgacttaaagcatgcattctggacttggattgctggcatttgattcccgcctctactatctggtagccgtgtgacctcaggtgacttattcaatctctctgtgcttcagtctcctcatccataaaaggcaggtaaaaggagtatcatctcatatggttttaataagagttgaatgagttaatatatatttagctgcatagaaaaatgtgacatatactaagggctatatttattaagatagatttaactgatttaaaaaagttcttgttttctgtccaaagagcatgattatttcacccatcatctttgctctggaaaacaaatccatgtaaatgtctcatgcaagctgaaatctggtctttatgacagatacaacggttagactctttaaaagcattttcctagtttgaagtgtgggatacagtattataatggaaaaaaatacaccactatttctttcttttatgaatatatttcttacaaaattagttataaacatgccatgtctgtcatgaaatgctgatacacaaagatattactggctttgcaaggtatcctcttgtgtgattcaaatatatacattaaattgtcaggtggcctccaagaaggaagtgaaggaaacctctaccaggctgatttctattcttgataaaataaaaatacaggtaagaaccccattataatgaattccactggaactttaatttgcttttgctttaattaaattttgtttttgtgactatattgctagaaatcctatccctagtaagtagaaactagagatgaaacccatctgataggtatcctctctggtatgtattaacaagtgaaaaggaatattttgaacccacttgggaaagaaaaagtttaatgagctcaccaccttgcacccttttcttctccaactgctgctggtctggtttatccttagacagtgtttttaggtcctgtaagcatgaacatgggtgtataatgtacttggctcattttgggttttgctttttctttcttttccttttttttttttcgagtaatgaggagaactacagttggaaagggggagaaagaaaactgaatgccaattgctacttaattctgtcaacataaagaattattagagatttttaaacccttctatttccctcacttcccttccttcattaaaagcagtatatttggacatggctagtaaaagtgaagaggcataaaaataccgaacaggatcacttggagggagaatatttgtaacaagaacatcaaggcattggtggtttgggccacatgcaactacatggaaatctctttattttctgaaatgcttatttatgaggaaaggtttatgtatgattgactggttctgtgatatccaagtctgtacctcaaattccctatttaggctttattatttcacatatttaagattcagtactaagttatatagtcaataatgggtatttgccaaatatatgtatgtacgtataaataatatatatatgtgttttataagtagtgtatatatcagtttgattctcaacagtggattctttaactctgagttttcagtttcattggtgttaattactgttaaatggagctagataagtaaaatattctatgtctatctgatttaatccggatatttaacttcaagcaatatgtcataagaaaataaattataatgagtaaaacaatatatacctgagtagtcccactttgatgttatttatgagtgaaaaaggaatataaagttcttgtccaacagtaaagaggtgacttagattaactacagacaaacatgtaatggggcatttgtggtaattaaaaattatgcttatgaatactgtaaatcagcatggaagccaattacgctataaagaaaaaactaggttaccaaattgttcatttcatgagactaaaaaatgagaggtatatgaaaaaaagataaagataatacaagattaataatggctggatgttggcttttaaaaatttctgtatttgcaatctgtttagctttcatgacgaaaaagcagtggccgggcacggttgaggtcaggattttgagaccagctgggccaacatggagaaaccccatctctactaaaactacacacacacacacacacacacacacacacacacacacacacacacacacacattagcagggcatggtggtaggcacctgtaatctcagctactcaggaggttgagacaggagaatcacttgaacccaggaggcggaggttgtggtgagccaagatggtgccactgcactccagcctgggcgacagagcaagactctgtctcaaaaacaaaaaaaaaaggaagaaagaaaaaatagtatttatctcagtataactcaaagatgaaggcatttcttgtaaaacctagagacttactaaataccatgtgaaatgactgaattaacacggcttagatattttaatagaactttgtattataccaaatgcaattttgttataagaggatttgccttgaaagatttttaaatgacaagtatatatttttatagttttttacaataatatggtattatgtgatgttatatagaatataagagcttacaaattgtgaacttataaactgtattaagtgtatcctgttgatttttaataaatactaaacagacaataccatcattaatagagagtcattgcgtgtgcctgtaatcccagctactcgggaggctgaggcaggagaatggcatgaacccgggaggcggagcttgtagtgagccgagatggcaccattgcactccagcctgggcgacagagtgagactccgtctcaaaaaaaaaacaacaacaacaacaaaagggagtcattaaaagtggaggggccgggtatggtgcctcacacctgtaatcccagcactttgggaggccgaggcaggcggatcaccagaagtcaggagttcgagaccagccttgccaacatggtgaaaccctgtctctactaaaaatacaaaaacattagccaggcatggtggtgcacacctataacccagctacttcggaggctgaggcaggagaatcgcttgaacccgggaggcggaggttgcagtgagccgagatcgcgccattgcattccagcctgggtgacaagagtgagattccgtgggaaaaaaaaaaaaaaagttgagataagattacaaggacgtagcatactagatatgttcactaagttaacaaaaatattctaatctgagtagtgtatattttccattaacattaccatatgtcttaggaaatattttaagtgaaatcctcattttataattgtttaataagtttagataagagattttaatctagagtttgttttttctgtgtgattgaattcattgatttcaaacccaattatattaacaaatataagaatgctaacaacactgtatagtctttcagtttgctattccattatgaccaatttttattttcatataagtatggtaaatgtaattaataaaattggacaatttatattcatgtaacttaattcttggaatacaggactctttattattacagagcaccatgactgaacagaccttcttgtcaatgcattaacccactgtttctctataaggtacagcaaactctatgaaaggaaaaggaggggagtaacttttcacagtactaaataaagatctgttgaacaaataattaatttcatttatcagaatatttgatagattaaaatataattgatgaaaactattactgtgaatgccatgaagacagaattttcattgtagcgttgttttatggaagcaataaattgaaaatagtttaaatagtcatcaaaatgaaatggtagtataaattatggcatatcctcactatggaatattaagcatgcaataaaaaggaatgagtagatataatctactgacctggaaagatgtccatgatacattattttttacttaaataaaacccagcatcctccagcccattatgcttggcaagtttccattttaatttaaaaatatgattatagggtatgtattattaatagtagttacttctgaaggttgaaatttgagaggtaaaaaggaaacattccattctcaatttttagaattttcagcatagtgtaattactgacaatttttgcttttttgcattatctgaattttctaaattaaaatatactgttctaatgataaattaatatctgttaattagagagcctttaaaataaagaaaaaacttgaaatcacctataattctcctgtgataattgcaagaatttatcacagtgaataatttggttatcttctagtttttttttcataatttatatccatggtctcaaacttttacaagcatcagaactacctagaggactctttaacacacaggttacctgttcccagccatagagtttctgatgcagtaagtctgaggtgggatccaagaatttgaatttctaacaaggtctcaggtgatgctaatgatgctggcctagatactatattttgagaactactgtttgctatattaggagtattctatattcaacattatatatttttagtttttacattaaaccatactataaatattttccatttatattaaaatttcttgaaaatatttattttgcttgatattttcatataaatagagaacaatttaactcatcttttttgactcgttgaacatgtgtgctttatttttattttcataaataattctgaaataagacttctcatgctaaaaatatctaacttctttgaataattttataaatgggaagttataaaatctgtatcttggattatgaacagttttaggctcttgtgatatattgccaaactgtttaccagaaagtttgcaccaaactgtaacaacagcatataagaccatccactactccacaccctcgttagcaaattaattgttcttaactcagcctaaggactaacattgtagcttgtccagtttaacaagggaaatcaaaggagaaaatgctgttcaaatttataaacaatttttatatttggctagttcacaaatttaccaatgtcaaattattgtaccatagaataaatttataagaaggtcttatatgccacagtcaaagaggataaaaaaatatttttgacctgttagaatgtgcattaaaaggaaatagagaaaaggagtgcattcaatagctaaaaaacaaatcttattggaatttttaaggctctcgttattttctcctccctacaatttaaagtaaatttgatgtgtggaaataaacaagtagggaaaaatctgaaatgtgaataaagagcaccagcccaaaataactttgtgtaagacttgtcctgtctcactgttggcactgacagattttaaagatatgccaggtttccaatctttagtctttcacttatctggtaaccttgggaaaattactgctactgtctgtgcttcagtttcctcatggaaaaaatgggataataattcttgtaccattgaattcttgctggtactcaataaaatgtcatatttaaagcatatatatagtaggcaatcaatacaggtagttattactctgtttcatccaccagctcttggaatacagtaatcattcagtgaatgagtggatgaactaataagttaataaatacaggtataaatggataactctacctctaatgcagcatcaaacaaaagttttagatgctctgcttccaggcccttagtccaagaagacacagcataatgtattattacattccctcaatttcttcctgcactcccacatgggaagtctttgctcacatctttttttttatatggcacaacaaaaccttccctcagaaagaggccaggatgaataaaagggtcctgagtgtctggaaaaggaaaacattcagcagaaataccacaacatctaaccagcctttctttctttctttctttttttttctttttttggattagcagggtattttgcttttatccttctcaatgtgaatcctggtatttccccctgtaagtggcatttcaaagctgacagctccagctgtccagccttcctccctccaatgactcatacccaacagatggtgcaaatagcttggcatcaattcactgaatcagtgttgggggaaaagccttgccagacgactgatggtttctttgaagttgttcattctggcaacaatgcacagctaatagaacagccttggctgaacaaaaagatatgaaactgatgtttgagagaaaatctggaacataggggtctatatctgtcacagtgcttgcaattattttctaccaataatatcatttttattattattatctaccagagctatgtaattctctcacttgacattcctaatacttgatattaaaataagcctattaatcctgctcaaataacattagaaacaacattggactggaggtcagtgcacctagattctagtctaagttccacctgaaacttcttggatattcttaaccgaaacattttgtgctgacctttagattctgcagctttaaaatggtgacaaaaatatctttcctgacagatttacaaggtgattttgagaaacagataaaataatgaattcataggtgttatgtaaataagttttataaaatgttataaagtttaaagtgttatgaagaacactatactgacccctcacaaagaggcatgaattctttccccctcccctccccttgagatggagtctcgctctgtcgccaggctggagtgcagtactacaatctcagctcactgcaaactctgccttccgggttcaagcaattctcctgcctcagtcccccaagtatctgagactacaggtgtgcgccaccacacccagctaatttttctatttttagtggagacaggatttcaccatgttggccaggatggtcttgatctcttgacctcgtgatctacccacctcggcctcccaaagtactgggattacaggcatgaaccaccacgcccagccacaggcatgaactcttaaatgaggatgggtttacgcaggtataagctctcaccttcctgtatactactgtgagagctatgacaggattggagagacaatgagtatcatagaaccatggactctcacccactcatttttaccaacttctcaacacaccttaaaagcatgttaactccacaatcccataaaatttggttaaatcttggattgatcttaaaattctttgcataatgtgaccaattataataaattagatggaattaaagaaaattgtgatatcatcaaaccagttattacaattgaataatagatcctaaacacactttcataaataaaatagtagaatccacaattaaagttaccaggagactgtagcttcctggattagagattttcacaaatccatctctgtatcatcaccatggtaggaagtcagactgaaatatggatatgggtatctagctccaaagcacaacccatatggatttctcctatattaaccaatttgtagtattacctgacagctggagaagcagaattattcaaataatttatttcattttgcttttaatcctttgtatctatatttcccagaaacattctagggtgttttaaataagtaaatattcacagttcacagaatccaaaaatgcattcaaatatctaccactcaaaaaaaaaaaaaaaaaacggcccacctaaagcctttcttcctgtttactaaaacgagtctctcataataactattttccgttttcccttttcactaaaacttagttgacaggaaaacagatgatactgactcaaatgataacctaaaactcacttctagtaattcaatttattcaagatttcacttatttattcccatgtgcaagataccactatcaaaataatctgtttgaaactgaaagtaacaagttgttagttttcatttgtctttctaatgaatgtgagtatacataagaggcttaggtttagagtttgtttgcccataaatgtggctaaaactttttctacggtagctgtttaaactgaaagaaaattgtactaggtatccattaaagtttgatcagaaaaacatatgccactgtagacattttgagctttctcaggaaattcagagtttcaaggttacaaggaagctgccaccagttatttcatctgccttcatcaccaaacgggggttcctgaggaagatgcctccaaattgcaggcaaaatccatgtctgccatctgctgatgctcatgtgcctgacctgatgtgtctcttctttcctattttgaatcttcatgaaagcctctaattggcagaatatcactggaatcctgcaggccatggagtatgggaactgtagtctccaggcttccaaaattcataaaacaggacatttttctgacaggccacctcatctcttgtcaactgaaccaaaagagccaaatcaaagagtacaaggcagtcctcctctaaagagtgacgcgtattgccttctcagtcactgaaaacccttgtaagagctctaattatgccagaaaatgaattttcatgaagagaatttgtcatcagcagcagcagcaagtatttattgccacaaaaatgagagaagcacagttattgttccaggagcatacaatgccttagtcgggaagataaaactttattatttttaaaagtgttgagcaccaaattcatgtcagggacttgactaaaggcttttcgaatttcttaaatcctcataacttttctctgatgtatttattgtttgctctatttagcagctaagaaaattgaaattcaaagcagttaagaggaaattgcccaagtcctatctacagcattggtgccagacatacccggattatgtctgattccaaagcttttgctctttctgctacacagtgatggtggtaaagtcatatttctgagggtcaaataattactataagaaaataagtgctaaaataattcaaagagatgaacaaaagtaaatttatattggatgatcataatcacccattctttttaagtcaggatctgtattattattttgtgaacatttgacatttgtttactaccacagataacttagggtatctctttgaaacttcttacttctgttgccagttaacaggaataaagatttaaacttgaattaaaatgctattcagggacttccattaaccagtatcagttggttgcttctaaagctaaccatgagaaaaatatatatatatttaaagaaactttagcaaggactgtccattcattgcctgatgctatttgggaacaaaatggctcaattctttttgtcctcagattaatagagcaagctcaagtgttataaagagcactttaactccctccaatattttcactgtggtttcttgtggcagagctcatttgcaataatccatgtgtaatttggtaaaccaaatggaaaatctggcattgtaacaattctctttactgggagaaatgctaaatatataaaaaattgaaaggcaaggcaaccccattcttcaactttatcatctctttgacaagtgaaattttccatttgttgatagaatattaaaaaacagatgacataaaactgaagaaatgtaatgaggaactctgatatggttgtcctatgctttctaagtattgtaagatgtgaaatgtgtattataaaatgtccttctcaagagattgaatactcctagacctaaaattgaattactataaaatacttgaaatcattaaaacaagtatttctctttttatttggcatattatatatgtaaataacatacactaattcttatatcagcctggtattggagaaaggcaacaaggctgaagcaatgggaaagggctttacttcataaggatgacttttttgaatgataaaagtacatagtgaaccacaacataaaaaaacatttaggcataaaggctaaatcacttattttgaagtaaaaaatcataagatttatacactagaattgaatgtttatcaagaatacaaaaagagacttggcaggtacggtggctcacgcctgtaatcacagcagtttgggaggctgaggttggtagactacctgaggccaggagtttgagaccagcgtggccaacatggtgaaatcccatctctactaaaaatacaaaaattaactgggcatggtggcatagtcccagctacttgggaggctgaggcaggagaaccgcttgaacccgggaggcgaagtttgcggtgatctgagatcatgccactgcactccagcctgggtgacagagcaagactccatgtaaaaaaaatatatatataaaatatacaaaaaggaagttattttagatttagattttgatatttaattactccatatgttagagatttttaaataaatttttgcttaaaaatgcaacagtgtcaactttgctgtaatttgatactactttcatttgaatttacaacagggtgggcttatttttcacattccatagaaatataagttccagagacttcagcatcacctttgggatcttatgaggtcagtaaataatacccttttcttcccatcttatgttcagaatagatttaaaaataaggcagaggaaatagatcgagatttaaacaacagctttatgactgataaagcagattagagaatgtggcatcaaacatgcatcaaatagcttcccaacatgccatccccaaagtagacagactcacacacccagagacacaccgagctgtgggcttttcccatcccatggagttcatctgaatgcacaagagcaaagaacaaaagtggaggtagtgacttctaaaagtaggaaagaagggctgggttggctttccccaaaacctgcaatcagtgagaagtgagtgatgggtgaggaaatgaggcagtagtactatgctacagggaccctgtacatggaaaaacgaggggtaaaatagtgtctcccgtccccaaaattcaaattgaaataaggaatcagtgagggtgtgtagcttccagggtgacagcctgcagtcatcctccttcacctactaaatatatatgttttttttcctgcatatagcacatacaaataatatatatttcatttttacaaaatatttacttctttttctcattttagtgttcgttagcccatagtacaggcatataacagttttttccacaaagtattttaacctagtactggagatgaatggatagataggtaagatgattgatacatatatatagatagagagaaaaaaaaaacttccagaaaatactgcattgggtctaatcatcttttgtattataaaataacaataaagggttacagtccatataatagatactaacaaaattagttactaattatgtatctgaatttatacgggttatttgccttccctagactgctttatgcatcacaacatatagccttggatgcagaatgcaattttctatgccctttagaaactgctatttcccctttttcatctggttatacattttcattgtgccatcattgtgaataattgggctcacatgatactaatagcatagagatttggaatttttgcatttataaagatctaaaatagtcatgattaaatatttggaagaaactaaaactaattttgaataactgttattgtgatgggggatgggattcaatcttaacacatttaggaaatgcaaaataaattatctaatctccttaattatgtagagtattttaatatatgcaaaattaaactttaaatgatcgttcagtaagatcaaatattcgttatgaaatcactatttaatcattgctcatagttgcctaacccattacagttcaaactgctgttaaaagaatggcctaaacttgcagtttcacctattacattgtttgaggagccacagatcatagcgtgtgtggtccaaaaaaagtcagaaagaataaaattgatattagcattttttgtttacttctcttaatattgctgaaaaaagcaaagacactcttcatcctccttgatgtgatgctgattttccattcaagtggaatcccacagcaggacattggaattaagcaataaagtgctcttggtgaccaaacaccagacatgtcacaattaacatgagtaaattaggttacatcttatttgtcaactcattttcattactagttttctctaaccaccaaatggatgggttagaaagtgatggattatatgcctgttcaccaagctgctataagtgtcttagaggctttgtcaagaaagtcacccacgactgggcaagctaaagggacttgccaaaggagtcaagaggaggtaggcagagcatgaaagcccttcttaggagaatgaaaaaagaaatgggaacagaagctaaaaggtaaagcagataattgtaattaaagtttcattagaaagtattctccaaaatcaaccaaataaagttagtgggaaacggtatatagataatggataacaatctaggatttgaagtcagacagaactagacatgaatttcagctcatacatcaatagacagtacaacctgaataaatttcttaatttttcaacatttcaatttcctcattgaaaaattgtcataataatactattatgattgtggcgaagagaaatgaattttttttgcatatcaaaattgttcaataaacactccctataattactgctgctttgctgtgctgtagtttttattaatgtagaaaggcattagctcccatttctttaaattcagcagtgtaattatgaatatccatcaccatttctgctgccaagaccactgcaatgaagtagggaaaagggaatggcatactgagatgagagccagtgggagtggcctgccccatggtaaggagtattttatcacttatatcgtttataattgtctgtgaaaagtgatttttaaaaaaactggcttttaatacagtttaaattccctacagataatgcatccctttattgactgtgccagtgaaactgtccgctcaccatatcctgccccatgcatcaccactgctctttatacagatgaagtctgagggccagagaatacaagcaagtagccaaagttacagaggatcattttcaagctgcttcttttcaaaaataattccacattttttcagttctttccagctcatttgccacttcctaacttcttttgactcatgtatcaggtccttagtttggttttcctccaaaatctaaactaacacaagcaaaatccattcattttcagaggttcctcatagaaaaggtagaaacaaatatagtgcattcactctaaaggatttttactatttctgtttctacctcttatgcagtattcctggtctctgctagtccagtcttacgaggctctgttaacaactggtgtgatgtactaaaatgtttgcctggaataaggcgacgacaaagtcgagccacctttatgccatgtcatattttaatagtgttttgtttcttaatccttcccaaaagggaaaaaatacatgatagctcttttcccccaactgtaaagaaaaaaagaaaagctaaacaatgttgggatttcttccagattctattgccccttcactgaagctattgtgagatgtttctttcagtgtgtgtattaagaatccactctgctagctaaagtcaggtaagtttccacttgtcaccactgaaggaagtaaaatgccaagaatggaacaaatgacacacacctttatttccaccatacacaatgtgcctttccacttggcaacacaaagcagaacagataaagtaatattctgctaaataattatgcacaccaaaacaatggctatttgtgcaactcaagaagaaatcgttatgttgtttactgttcacagttctcactgtcaaaggtcaatattgtgttttgtgccctgattgtcttaaattaataaacactattctcttgctgggttgagaaagaaaagagcaatctgtcaagagaagtatttctctttcattaaaagattttactcagtccagaaaactgctcctacctccaccttcctggctagtaatgagagaaaatccatggcaaccagtttcaagccacctaaataaagatgtcccaaagaaatcctatgatgaatatgatctttttccagaagagcatttctctccataattatgctataaaacagatttcacaccataggtataatgtataaaacataagctaaaatttagggcctaagatttgaaaagtctaaaacatttctatctcaacagtctctatttactctaatcacttttctataaataactatatccatgtggtctattccaaaagtcctctaagcatatcacatgtttctgctcagaaaagtttgatagtaccaattattacttacttcaggaaaaaggatatgcatttaataaaattaattggggaaatttattcataaatgaatataaagattgtggtgaggatccttaaaatgctcatttcacactcaactctaaagtttactcatgatttgactaaccgataaaagctctgcaataaaaaagcaacgtaataatacagtttctaaatgagcaagtattgaagccaattgaaacctagtaggtgaaaaggttttttttataaatgttaaaagctgaagcttgaagggataggaaataaaacattttaaaagcatcagtaagagacaatcttaggtataaacataattatttatttaggggattcctagagatagatgctgcagccagcaaagatatgatggcacgtaaaccacatcaacaagagaagttggaacagctgaaatgtgatgttcctcccagggaagcaatttggactcaaaccaggccaacagtgatgaaaaatcattatcattgagtgaccagttctttagttgtgtctcattatggtttgagaaaggtatttcaggtctggacttggaagctaatgcttttatcacaagcatcgaatgctaatttgttaatccagatctgccaggacaagcatagtttcttcttatttcaattacctacactgatggttagaaagcacaccagaatccaagcatctgtttcatttgagataaaaagtgtttaaagaaaacaaagttaataccatatgcattataattaaaattctgcttggacaataaaaatgttaatatataagtgaatttttttttttaatttttaagacagagtctcgctctgctgcccaggctggagtgcagtggcatgatctcagctcactgcaaactccggcttccaggttcacaccattctcctgcctcagcctcccaagtaactgggactacaggcacctgccaccacgcccggctatttttttgtatttttagtagagacggggtttcaccgtgttagccaggatggtctcgatctcttgaccttgtgatccacccacctcagcctcccaaagtgctgggataacaggtgtgagccatcacacctggcctataaagtgaattttttaagcaaggggaaaagctcaaattcaaattttaaataatctgttggttgattctctattaaatgagttcaagaaaaaagactaatcattcacatcctcactaccatcagagattgctaattaccatctttttccaacttttttggggctaattcagaaattcaatgtttatgacatttttcagttaaattcttcataatgtatactcaacaaaagacaaacatctcacatcagccagcaagtttcctcccaacacttaatatcttcatatttggtaaaggtaacaatccaaaataaaatcattttacttaacggaattaacagagaatgaaatcatcgcactgtttctttaaaataattgtctagaatatgaggtttttccaccaggaaatattatgaaaatacacattgaaattatttcctactcaatcagcagttctattaagcattttacaatcagatgcttcaatgcaagatgcaaattgttttatttctgaatcccctccctcacattgtgtgactcctgaaattgctttagaaggaagcacttgttttttaaaataatattgtaattctttaatagatacaaaactaacaaagaaactttgctttaacaaataagcaatcatttaggagcacatatatcccaaatataaaagattgtagatttaagctatttgtcttttttccaagatcatttggtttgaaagattcctctactcaaaggcaatgcgcatcatttccactttgctaggttatttgggaaacactacagaagtggtagagtttatatgccacaatggttacaattattggctttaaagtcaaacatgagtcagagtcccaggtctgctacataagattttgtgatcttgagcctcagtgttattatgggtaattggaataaaaatagtatcttacatgtttgctgtaaaattgcattaaataatgcttaatgcctatgtataataaacaacaaatgttatctatgataattgtgattaatagtataattaataaatggatatacatttttatttctataagtatggctgagtagataccctgaatcattgtctcaattgaatcaattaaaattccagttaaaatatagcattatttttcaaagcattgttgaactggcatgaaagttagaaattcaaaagccctaaacaaaattaaagcattactgcttactctaagaggtaaaaaaataataaatctggcattcacccgagggttcgagaccttgctattctaatcggcaggtttgtggagttagggacagaagacaaaggcagcactctgtttataggtggaatttaggatgagacactccagatagctggaaaatgtttactggagctttgttcttgcttttatttttgttgaatggcaaatcatgctttctataaaatttttaaatcctcaaaataaatttaatttagagtaattttgtttggtactggccacgggcaattgggagaagtaaatgcaacttttctgaaaaatatcacttttggcacaaccctcaaataattcccacagataaagttccaaggataaacaactcagaactgaatatcataaaacacacatacagaaacaagatattatatgtagaaatctgtagaaataatagcagaaacaagctgacaaacattaagaaaaggaattatttgaaacacactaagaaataactctatatgtctaaagaaacaaaaaaagtttgatattttgactagcaactaggagactataaaaatgaacgttcagatttgaaaaggaaccaaataaaatctcaggaaatactgtactaactaaacttaaaaagtcaataactgaattaaattcagcagcagagataaattatgaactggaagagatattgtccagaaaatagtctggagagacaaagagatggaagacaaaaaatgaagtgaaggggcacagacagaaaagggctgatcaatatgtaattgttgtttcaaagggagatagaaaaaaatgggaaataaacgatcacagaaagagataatagttgagaacgtcatagaatgttttaaaaaaaaccacaaattctcagttctaagaatatcagtgaatactaagaagggtaaataaatacatttgcaagacgacaaatcataactaaactgtgaaacacggaaaaaaaaagtctttattgaagccaaggagaataaacaaattacccacaaagaaaaggcaattatattggtagctgacttcacaaccacagaaagaaaaaaatagatgtcttgaatattattttcaagatgctgagatgaaataactataatcttaaaactttgtactgagcaaaaatatcaaccaagaataagggtggataaggatattttcagaccaagagagttaacacgagaattaaatatttaaagctatgcttcagaaagaaagataatgatcccagatagaaatctgagatgaaagaaaaataatggacaaagatactggtaaatatgtgaataaatcataaaataagaatgtctatacaagtatgatttatcaataatatttaaacattaaaacattaaaaaaagaatgtcttgggtgtaggtgggtgggaacagattcaaaataaattataggtctcatacagttacaagggaaatgatagaacttacaggattcttatattcaggtaaggttgccagatttaggaaatgaaaatatgcttttcattcattgtttacctaaaattcaaattcaactaagtgtcctgttttttagtctggcaaccctatgttaattgatatgtatgaaaaaaaattatgcttaaatttaagtatgcagttaatttaataatataaaatcaattagtgcattttgccatatttacagattgaaaagaaaaatcatatgacaacttcaataaatgtaaaaaaaattaatcaataaaattcaatattcattaaaggtaatcttcaaatggaaatatataatacacttttttagtctgcttatgagtattatgagaatccttagtaaatgtcttactttgtggtgacattataaagtaattttctttagaatcacggatgacacaagaatggttactatcactacatttattccacattgtgtttgaggttctgaccactggaataagagaagaaaataaaattataaattctcacaattggaaaggaataaagcaagtcattctctcagattatgtaattgtccacctaaaacaaagaaatctacgggtaattgtcaatatattattgatgtaattatggtgtgtgctaaactggctagataggtagtgataggtagtgattttggatttggactcccactaacttggaatatttctgagttaattttacaaaatcagcatatttcttgtttaaaaagagaaagaatcacaatgttgctggaaatcaatatatatattgatatatatatatgtcttgttctgttgtccaggctggtgtgcagtggcaaaattgtagcctcaacctccaggtactcaagcaatactcccacctcagcctcccaagtaaatatgaccacaagtgcacaccatctaactcggctaattttgttttgctttgttttgttttgtttgtagaaatgaggtctcactatgttgcgcaggctggtcttagactcctggactcaagcaatcctcccaccttggtctcccaaactgctaggattacaggcatgagccaccatgccgagccataaatatttttaaataaatataaaatactattgtatttttatatgtcaacattaacagaaaatgtaattttcaaaatgatatcatttttctatggcaacaaaaaagtaccaagtacctagaaataaatttaataaaaattggataagcattgtgaaaaaaattaacttttataaaggcaataaagaaaacataagtaaagggagaattatgccatgaatccataaacataattgcatgtgcacatgcatacatacccacaaggttggtaattgataatagaatggaagcttctgctgagtggggagaacatggactccaatacttaattgtgggccaattagttatcttatagaaggaaaataaaagtggattgctaacttgccacaaaaaaataaagttataatatttatgattggaagggaaatctataaaactagtagaataccatgaggaaaaacaggtttatgactttaggctaaatataaaaaacatataccataaaggaaattataaattaaactacagtaaaattaagaacttctgttcatcaaagtttaaaaggtaattcataaactagaagacattagcaacacatattagccacaaatgcatatgacctcaaaaatattttaaaaccctgtaaattgataagaaaaatataaacatttaaataaaaataaaaaaggtaaaaaacacagaaacactttttacagagtagaaaacacaaaattcttgtaaacatgaaaaattttcagcttcattagtaatcagaaaaaatttaaataacaatgaaaattcaataaataatgacaaaagttgtacaatttaagaaatgggacaataccacatgttggcagaataaaaggacatatattaatgaaaattctcttccactgctagtgggaagataaattgaaacaccttttgggaaagttgagcattacctggtaaagtggagtgtgtgtgaaatctgcaatccagaagctccatgtctacacgtaaagcttagagaaatccttgcacaagtgtttcagaagcattgcaagaatcaagaaaagaacatcagtggttaagaaccacgaacaacatagtcaggctcttagattgaaaactcctgtctgctactttataactctatcttagttaatttattagcattgttatgttcttgcatcctcaactgtaagttgaaaataacaatagtacctatttcataggcttgtgttgatatttaaatatttaaaagtgcttggaatagtgcctggcacacagtaagtattatactgttatctgttattattatttacaacagcattgttaatcatcaaaaaaaaaaaaacctggaaatactgcaaatatttgccactaggatatgtatgtataaaactatatgtatacacacacatatatattcatatatgtacacacataaacacaatggaatacaatataacagcaaaaataaaaactttagaataaacaagataagcaactcagactatacaatatgatgcaatttttgtgattttttaaaggcaaaatgttacattgtttaagaaggtatattttattaaacttggggaaaaagagagggaatgatttacatgaatttagaatttcagaatggttgtgtcctctttggagacaatgagtggaatgaaagctgggagtgtgacccaagggtttctatagtgctaataatattctctctcttagcctataagaagattgagatttatttagtcttaaactgtatgtatacctcttgtgcacattttatgttctgtattttgccaaatatagtgtgaagtattttaatgtgaagtattccacaaactcaaggtataaatatggcttctttgctttaactttaaaattaattgctttacttctcacttgccttgttgatatggtttggctctgtgttgccaacccaaatctcatgtgaaattgtaatccccgtgtgttgaaagtagggcctggttggaggtgattggatcatgggggtggtttccagtggttcagcaccatctccctagtgctgtctcatgatcgggttatcacgagatctaattatttaaaagtggctcttcccctttctcctgctgccatttaagatatgccttgcttcccctcaccttcagccatgattataagtttcctgagtcctcccgagccacatggaactgtaagtcaattaaacatctttataaatcaccagtctcaggtagctttttatagcagtgtgggaacagataatacacttgttaacaagaaaatcatttcctctctaaaataccacctcctttacaagttgtcctaaacatgggtttttttttttccacacctaaggaactaagatacacgagtcctggatattttctgtctctcattttcactgcttgtcacaattgtattgcaatgctagaagctaattcaaaacaattttactgacgatggggatgcaatatgacccagatggaaaatttatattatacacatctcatcagcagcaatttctgagatgaggttagagcagcagtagaaatacaaaagaaatagaaggaaacggagaatggaatcatagacagcagaaaaacatttaccccttaaatgtcaaattggggataacaaaaccaaattagcctcatacaaattttacctctccttagtaataatggtccctaaaactatacttcctgaaacagaaaacaagccctgattaacactaaggatgctgtatttcttttgaatttcctattttcttcatgcagagcaatgtgtcaaatccaagttgagcttcctgcacagggctgcttaggatctgttcatgatacacaaagtgagttactgggttggaggtttctagcagagagagtcagaataaagatgagaaaaaatagaagaatgccatttttaaatgcttattagatgcgacataaaaaaatgtattctaaggtctgtattaaaaagattttgcccataattccagggtaaaaaatgttaagcatgactgcacagaaatgataaggcactgatttatgtatagactaggggagacaacaattttttggttagactattccgtcacacattataaaatggcttttccttttttactgtttagttcaataaatcttcttgtctattaatctgaattgctggctcaagctacataccatgattttctcactgaaataaagtctgtgggagaggcccctggcataaactaaaatcttatatcaagtgcagaattcttctgtctcctgcaggcccattgcaagattttactgtgtttgcttactaatataagctagagaaattcccattaatgtttaaagcagttgtaagccccatgaggacccgaaatcacttaaaatcctttaagtgtttttcataacacacattaatcactatttcagtcaagacatatatgacaaggagtgatgagcaaataaaatgttataaataaaatgcctagaaaaatatttattagtattacattatagtatagtttatgaagttaaaaaaagaagataacaaatattagctaacaatgatataaacctgataaaacagtaattggaactaaagtgttctaatgtcctaaaattctaaagccaaggctttggtagctgggaacaagaacagctatactccagaggccaatgtggggaaagtggagacagtccttcaaagtcaaagatgcagcaagtaagaaagagtgagctgcctagacgtgtgacagtaggatgagccaaggaagctctgtggctgagtcttctggcaacacaattttggggatattgactcttgaaagacaagctgagtctgagttacctgctctgaacccaaaacacttaagagcacaaaaattctatagggttagttggcaaaatttccagagataaaaatgaaaatttatgaataacttcacaaagattgcacagacataagaaagtaacccacttggagtcaatccagccaaaacaagaaataaaagagtaataataaattaatacctgcaagacaaagattttgaaattgtcagtcctggcagtcagaagaaatatgtatgaaatatttagagaaataaaatgggcaatagcaaaaataagcataaatcaagaaaatatcagaagtgaacagacaaaattgaaaaacagaaattctagaaaaaaatttgaaataaataattcaacaaatgtttaaaacagccagaaagatatagttgaaatgagaattagagagctagagatacatagaaataatttatctggaatgaaaaaagagagataatgaaatgaaaaatgtgacataggttaggagatgtgggtgtgatgagtcttatctattgtgattacagaagagaaacatttgactttatcatggggctactacataatatattgttcagtcttaagtttttattaaaaaaacttaaggctaatcacttaaagaacagaatgtgtaaactgcaaaacaaatgttgggaggagtataataagagggaaaatatgttaataaatcaatcagtgtgaaaaaaagtaatgaaggagaacatgtataaagaaagaaaagcagaatagatagaaacaaaaacaccagaggaacttgagagtaaaaacaaatctaagcatataaatacccacgataaatataaataagctaaattttgcattgacagatactgtcagaaaagacataggagttagcatacttactatatatcaagtaattacagttagttttaatattgatgtttaacacacagaccttctatttttaactaatgagggcctctaaagttaagttctgagctcttgacatgacaacggaggtagctagaattgttctagatttaagttcccatttctccaagatgtgttggtttctaaaacgacagggaatggtatttagagaccatgatcaaggtattatggagattcaatcctagagaactgatgatagtttctaggccttttcagtagacaaagcaaggaaataggcatttcttaaaagggaatgcagcataaagcctgagttcatatcagtaattcctattcgaaattaaattgtttctatctcttttctcttgcactgaaaattttcagttcctaatgacattaacatattttacttattttattctactaataataaaataacaatcctaatgatacaggaattaaaaagaaattacttaggcagagagtgagggtatggaagtcctcgataaggttttccttttaatgaaaagcagccccaaattatttttccttctaacaaaaaaaagcagcctgtaaaatcgaactgcagacatagatgctggcagttgtgccaatcatgttcaagatggtggctctatcctaccttctttttgtcagtcacatgtacagtaagaagcagacaagatggcaccaatcaactgaaaagttcacttgcataataagattagggtggggtgaccagccttccccacacgctacataaacatcacacctgatccaaccaatctgtgagccctatgtaaatcagacactgcctacacaaggtggactataaaatctggcacatctgccaccagccagtcttttccactcagaagaccccatctctcaatagagaaagttgtttttctttctcttttcttctgcctattaaacctctgctcctaaactccttgtgtgtgtctgtgtcctaatttttcctggcatgagattacaaaccccaggtatataccccagacaacatagcagcttcatattgggggcttaactagaataccaaggtacaacattcattgaaacagtaagtaggggagtggactgcaactctgtcctttcattttggggctctcggtctccattttagaaccaaatcaaaccaaatactgggcctccttcaatcatttaaaaatgattagcttgggttccagatttacaaaacttggtggacaggattacatggagaatcccccagcactcgtgggttgttgggcatgttggccatgtttgaaccagctttgtttcatagagaacttagccatcatgtggggctagtggaagtcctggggcaactgaggatttctggctggggctacctcccactgttatccaaaggctctccaactttcctatcacaatttcctcatttcctggtcacaaccaccatatttcttattctctctgagtatgcaatgtgcaggaatttttatagttcagggaagtagtcttgtttggcaagatcagggaatgtcatagtaaccagggatatagctcaagggaaggcatctttgtgattttctaggaacagaaccccccaacccttccacagtaggcattactcttggcccttggtctggagagcacatggcatttccatgtcactctctgcccttggtctggagagcacatggcagttccaggtctctctctgcccttggtctggagagtacatggcagttccaggtctctctctgcccttggtctggagagcacatggcagttccaggtctctctctgcccttggtctggagaacacatggcatgttatggtcactctgctgttggtctagagagcacatagcagttgaaggttaaaagaggcacctagaggaatggggatcctctccatgaggcaaattgtcggtcctttacagaaacactctagcttcccaattctccctttttgcagccctcttgtagagaacaggctgcttctgtgaatgacaaaactctgccttcaacaactaggagtaaaatatccttcaaagctaaattttagcctccatactgtcccatcagcaggaaaacggccattcagtccctatattcttttaaggcacctatcctgcctctaattagaatggtacttaattagtaaggggattttaagttcagaagttaaatgtaaccattctctaagggtacatgctttagcacagaccataacagcaagatacagagctcaaactagcacactttctccattaaggagggaaatgcaactgtcacatagtctctcctgagatctgcagggagccaggcaggtcacacaaggccaggacatcaaagggaaatcacaggcagaggactagagctgcatgggtgagtgtgactaatcccaatctcttagttcctctggttccatggctggggttcacacctgcaaccatgagtagcacgttcaacaaggtgccaggatccaggaaccaagagggaaaaaaagcagaaaggacaccccccactgtcttcctctccaccctgggtcacaccaaaaggaaggagactaaaggcatgcctttttctcacttctcattctagaaaggtaccatcatcagcctgcactcgcctggagtccattctgaaacacaaagactcatttcaccctgagactttaaagaaaaagtggctcattttcttttgcacaggggcatgaccttcttactagacctttgcaggcattacaaaatcaacccagctcttttagtagtcatatcaggcaggcctatggagaatgattctcctaagttagagaagcaacttcaggggaagaatctgaggattccccttagttgggtccccctcaagttcccttctcattacaggaccttagggaaataaagggagacttaggccaattttctaacgaccctgatagatatacagttttccaaaatttaactcaagtgtttgacctttcatgaagggatgttatgctgcttctaaaccaaaccctaactgcagctgaaaaacagccagttctgcaggcagcagataattttgggtatgagtaatgtgtctcctgtgataggtaaaaagggaaaacagaaaacggagaaggtgaaaaatagtggtaacaactttgccaatagaaggaaagcagtatttcttgacaaccctaattggaaaatctagacttttctatggtgtttttccttctttcatgatttaaaatggcttctatctattcttttataatgttcctccaaaccgggaaaagttaatttccccaaatcttaaaaggcttggcttagagttcagcttgggaaaagggaacccagaagcctgacatgctagcaaaaaggtaaaagcacttttttaccagtcaggcttttggcttctctctccctgtgaaaatcagtaaacgaaatagtaaggagcaatgtttatattctctgtaaagttttaatcaatgaaagaggatttgtgaggttggtattacactgtagccaatctggtgtactttgtgtgtctttctgtatagttctgtcaaaagaaagagtaccttaggttaggatacaggcccaggatgccataagcctgctgttcaagccagctcaacaaaatggtccataataaactttacctccatcttgtttcatgtccttgggaacatgtcctataaccacatggcaatacttttttttagtctctgtcttcttgtgctaagtcagttcctgggtgagggccacaaattcagaaaagccagtttatcaatctgggtagggctagctaatacatcaagggcagggtttacagaatatcttaagcactgatcttgaatggatcagaatcttgtaatctccagctgtgtgactcctgagccatggtttctaatcttgtggctagtttcttggtctgatccgcaggctagagggaaatatatcttgggaaggggctgttattatctttgttttgggctatagtctgtagaccaggctcctcccaaagttggtttggcctacacccagggatgggcaaggacagcttgggggctgaaaacaaaatgaagttggatgagatctttttcactgtctctgtcaccactttgcaatgatggtttcaaaagctgcttgccacccctttaaaaatatcttgtacactcaaggttaagtcataacctaattaagccttgtttgtttcatctgtgaggttactctttgtaaagttcaagagccgaaaatcttaactgcttgacatggctaatgtcctttgaaaggatttaaaaagattttcttaaagagtgctcagcttaattaaaagtggaaattctagttataggtagatttaaaagacctttatgtatttttcttcttggatcttgtttttctggaaaaaaaaaaagggtggggggggttcttctcagttgactaaattacttattcccatttttttttctgtcttgccactcttaatgcacacatgagaggctctaagctaaagtctgatagcctaggactccttgaggaaaacagaggaaatgccacagatgccattttggggggaaaaaaaccctctgttttcctcatgaaacccagtaattaagagcagatagttccctctcaaagtcaaaggctctgttctgttttgcattgtgttatctgacatttttaagttttggggcatcagaaattacctcacattagagagttttgttgtataatagctaagaaggaaagatactttaagggatgcctaataatagttatggagggatatttaattctgcacatttgtatcagagaatcgtgctcttgaccacctgaaagatatggaaacatcctcatcccccactgagatgagactaccatgggggatggggtgtttacaaaataagctgattggctttgagttgccttgcaatgaaatgcatggaagaagcactgcactgtcttctcccatagtatctccctccttttggggatctaaaatctagtataaaaaggcacacttaattttgggatctgtgtattatatagtattttatagtgtattatatagtattatattatatatagtatatattgtattatagtatatatagtcttttcacaaattcagtgttgaaataaaagcatagaaagcttgtcttaaaatgctaatcggccctttagcaaaagggattataaaaggtttgtaaagagttcaactcatgatcaaattggttaaaattagatggaatcatctataaggttttttaaaaacaaactgaggttaacattaataaactaatgcaagggtaaaatttggctttcaacaggattttcatgtaatagtaaaggctaatgaaaggtttttgccttttgagtcatcattttggcaaaataaataatttatggcaatctggaattctattttataacatcaagtgttttaacactctaacatttaacagtctccccaaaatctaacttcaagtttcaaaattgtctttcctgatgcctggctttctggatggttcagagggcccctgaaacatccagagaagaggtaaacaggatcatttgaatatgtttagttacatgggattgccaaaatgatgttcaatcttctttaggttatattttagtgaataatactaatatatgttccaaaattgtatgggatttctaaaattctaatgtctaactatatgctatcaatcataattaaggttaaagttattgtaaaccacagagataactaaactcctttgtcagtaatgtttttaactgtaactaccctggatattttgtcatttgcagacaattgttgtcttgctttgttccttctcaaaagatggtttgtaatcaagctataggactttaacaggtgttctcaaatgcagttttctaacagcattgaaaactgtaacattggaatagagaaaaaacgtacaggacccatgaagagctaaaatgttcatgaatatcaagcaagagttaacttaagtggaatgaactcaggaaactgaagcaaatctttttgatttttggctggaatattgctaatttatgttttatttttcagagtcaatgaaacttattttgaactatttacagcctttaacaattaagtaaggtatactcctgtgaacaaaatttggagcatgtttgtttctctctgtgtggttcctctagaatttgtaaactatctgtgagtactcttaacttatgacaatatagttgtttgcatcaatgaataagaatccatttttcttttgcaacaggacacaattggaaaaactagttgttttatcaaggcttttactggaagggtatgcttccctttaaggagtgaatctcaacttgcagagccaataaaagccccatggggagaactggtctcatacacctgcctatacagtccccatacagggttcctgacttgtggtcagtaaattatgttactttcttacaggtccaggagctccaagtttatcttgagaccttaagaggagaggatcacccaactcacaggtatttgaggatacaaacccatggctgggcttggctttaaagagtcttatctgagattccttgtggaacagagttccatcaaagccaatccaaaaggcctatgtagaaacaaccattcttgctgcacgttatgcaagtaatcaggacaagtataagactaaagtttattctacaaacaacacagtcctatcataatttgtttttaccaaaaatgacactggaaagagaaattatgcaccaaagcttatcatgtatttgtcattaaagcctagtctcattaattgtttttaagctttttgcctaccttttagactaactctgctcatttctgtaaatcaagtggtgatctcctgcagcttggaagaaccaaaaagggatgggtaatgtaaaaatctggatcaatatgctagttctgggcaataaacccacaaattcggctaggtaatgaaagtgagtagggtgtccataacccagaggttttttgcttgagatattaaaaccaaggaacttcatagacccacagagggaaaatctatatcttggcaagtcaaattttatatggaaaaaatctactatgtcacctttgcaggaattgctatactcactctactatttccaatagagttatacacgatagcaccttctagctgaaatattggacagagagtttccactgctgtaatattttacttaattattatccttgtagcaaggataatagttaccaacaaaaaggaagcatgaaagttttactagcactgaatctgctagaactttttattgggtttggtaatatgtcacaccctagctatgcaaagaaggctataaagaaaagagattttatataagaaatgatcttgtatggtaaatacttgtcctaaagaaaatagctggttctttaaaagaggaatgtttaggacaagtcagaaggtctaagcatgtcttagatggtctgtggaaatcatgaagggattaatatttgcgggaaagatttagccaaggtttaaagttagccaaggttaactaaagttactctagctacccaattccaatgccacttatcctaaaaggaatgttacttctatattaacatttcaacaacatctgttggaggcaaagcagttttacaacccattggaatggctgacacaatcaaactccaaatggtgttgcagacaggaccacacatggacatgtctttcttccaaggaccttagatttaccccaggaggagccctagctactgttcccacacaacgtccctattcaggagaaagcagccagaaagggtcatcatccaacaccccctaaaagcagttagggttaccactccacaggggaaaataacacaggagttaagaagaaattgcttaggcagatagtgaggccatgaagtccccagtaaggttttccttttaatgaaaagcagcaattagtttcctttctaacaaagagcagcctgtaaaattgagctgcagacatagatgccggtagttgtgccaatcatgttcaagatggtggctccaactttccttctttttgtcagccacatgtgcagtaaggagcagacaagatggcaccaatcaactgaaaagttcacttgcataataagattagggtggggcaaccagccttccccacgtgctatgtaaacatcatactgaatcaaaccaatctgtgagccctacataaatcaaacactgcctcctcaagctggactataaattccagtgcatccaccaccagctggtctcttccactcggaagaccccgtctctcaatagagagagctgtttttctttctcatttcttctgcctattaaacctctgcccctaaactcctcgtgtgtgtctgtatcctaaatttcctggcacaagacaatgaaccccaggtatataccccagacaatatagccacttcaccaatattgtaatgaatataattattgaaaacaatatttaaaaattttaagtatatcatataatccttagagtatgtcacactagtgatctatggtaaatttactagaatttaggatcacttaaaataattctcctttgtatggtttatatcaccatattgaaccaaagtcagattcgttagctcattttttttattttagctcctgcttttgtgcttctctcttttttaattttagtttctattttttgagacagaatttgactctgttgcccaggctggagtgcagtggtgcaatcttggctcactgcaacctctgcctcccaggttttgagcaattttcatgccttagcctcccaagtagctgggattataggcatgcaccaccacacccagttaactttttttgtatttaggagagacgaggtttcgccatgttggtcaggctggttttgacctcctgacctcaaatgatccacctgcctcagcctcccaatgtgctgcgattacaggtgtgagccaccatgcctggcccttttgtgcttcttctactaattttcagaaattacataaaaacacatttacgtggtttcaaagtcaaacgcacaaaatgtggcatatttagtatagtttggtttctatttatgagccctccatatattctttttcttttaaaaagttcttatttattcattttttaaatttaggcaaatatatataagcaaatataatatatatataattatacaggaaaacaataatacgttatacacattctcgccaccttattattttattccatagcagtacatagagaatttcctcattcttttagaattgaataaaacttcattgtgtggatataatcatcttttacatagtcccaaacccaaacatccatgaaaggtcatggataaataaatatccctgcaatgaatagttccatgcaaacgtctttttgtgtttttactagagtatctttgagataaattccaatcagagagattgctgggtcaaaaagtaaaagcattcatagttttactacaaattgtaaagcttctattcataacagtttaccattttatattccctctagaaacatacttgtttccccacaggcttgaccaaagagtatgttgtcaaatacaaacttttgccaatataatagaaatggaatttcactgtagtttcaattcgcattttacttcttgggaaaaaaattgagaaacatttcatatgtttaagggtcatttatttctctttctccaagaactgctcatttttctccacagttataattcctgtctattttagaaggtctgtatcatattaactctttatttcctaaatgaattgcaaatattttttctagtttatcatttatctttgactttgtttatggttattttgccattcaattttttagtgttccaaagggtcagtcttttctttactgtttttgttttttaatcagagttaagaaagttttctctactcccagattacaaaggacctcactcagctttcctcctagtacttgtacatcttatttttaaaatttacatttctaattcatttttattttttcttgaagtatggtgtgaaaatgaatgtaattttatatttttctatatgtctaaccagttatcccaacatcagttattttgatatgattgacgtggaaaaactgtacacatagagtttgggaacaagtatacatccacgaaattatcacaccatcaaggtcataaatatatccatcactgcacttcccaaagttttctcccaccccactttattgttattgttataattctgtgtgtgtggtaggaacacaacataatatctacaatttttgcaaattttaaatacataatacagtaaggtgagctataggcactatgctatatggtacatctccagaacttgtgtattttgcataactgaaactttgtaccctttgccaacgtcacatattgaaaagtccatcttttcttcaccaatttgatatgctgacttcataatatagtaaattttcacagggattttaatctatttccagatattttccctttcttctctttagttaaatgtctatttggttttcaacactatgatatttcaatcactatatgttttaatatcagatagaaccagttcaccccatatgccactactctatcaggacattcagggctattcttgcttgtttttccaaatgaaatggctaatctatgtgtttatgtccggggtgggggggtgtggaatcttaatgataattacactgagattatattagatttatttattaatttgcaaaatattaacatataatattaaagcttcctataagttaatatggtatataaacacaacacaaacccaattagaggatatactgaaagagaagtccttgttatgttcataaatatttatatgcaagcctagatgtgtttaaaacctatatggagaaagctataaaaagctcctgaaaggcacaaaagtacctacaacaaaaggaaaagatatgccatatttttgcatacacaattcaatatcatatagatgttaatctttgcctgcacacgcataagctcagtttcctgcttattgtctgaaatccttctttcgacactttctagaaaaacatcatggaaaagtcaatgtcaaaacacactgtatgggtatcacagacatgaaaaaaatctgagactaccgtagagcatcctataaagaaatgctgtatcattaacactattgataataaagaacatcatgctatatggaaaacgacaaacatcaaaaactctaagagccagactctaaatgcaaagaaatttggaaaactttcaacacagatgttttcaaggggtctctgaagccttttagggatctgcagggttgaggtgattttcagtattattattattcttgagacagggttttgctttgtcacacaggccggaaggcagcagtgcaatcataggtcactgcagccttgaactcctggcctcaagtgatcctcctgcctcagcctcttgagtagctggggttacaggcatgagccaccatgcccagccattttgcataatttttaatgtgttatttgtcatctttcattatgttgaaatttgccttaatggttcaagaacaatcataggtaaaattattgacaacttttcatgaattaagtggtattcatgaaactgtgccagtggacatatttttcaccaccacacactcagagtactaaaaaataatggggaaagccaatttctcttaaaaatatcttaggtgaagtagaaattattgatattattacatctcaaccctttgagtacccatgttttaaatctgtgtgacaaaggaggaattatacatagagtacctggctgcataccgaagtataatagttgcctctaggaaaagcacttaggcagttgtttgactggtgagctgaactagctactttttcacagaatgctatttttagttgaaagagtggcagacaagaaaatgatgagtattcaaatttgggctaccttttagaaaatttcttaaccataaacaaagtcagcctgctgtttcaaggtaaagaactggctacatttgtcaacaatgataaaatttaagtttccaagtgaaaattagaattttggaaaactggcatctgccaccatgcattttccaatcttcaaagaatatgttttgtggggatatcagttgaggttttgacactacataataaacgtgttaatatttgaaagttccccaaactcagtgaatcagtattttccaaatacctaacgcatgatgttataaaatcatgcatggtaaaagaccattcagagtacaagataaactaataaattttaatgtaacactataggacaaggccattgatatgtgaagtgagctgaatggtggccctgaaaaagatatttccatgtcttaattctcagaacctgtaattattaaccttataggataaacaagtaaattacatgtaaaatatgtgattaagttacatattttgagacaagaggcatatcctggattatctggatgggacctaaatccaatgactagtatcctcataaaaatgagccagaggtggactatatagacagaagaggagaaggcaacgtgaccacagaggcagagattggagtgacagtcacgattcaagaaatactggcagccaccagaatataaaagagacagaaagggttgggcacggtggctcacgcctataatcccagcactttgggaggccaaggcaggtggatcacctgaggtcaggagttcaagaccagcctggccaacctggtgaaaccccgtctctattaaaaatacaaaaattagccaggcatggtgatgggcacctgtaaccccagctacttgggaggctgaggcaggagaatcgcttgaacctgggagatggaggttgcagtgagccgagatcaaggcattgcactccagcctgggtgacagagtgagactctatatacttttaccaaaacaatatatgggagcagattgatacagaagcagacataagaatgcagctgtcttctcttaagacagacatttaagaaatttacacaaacgcaaaacaatcccactctaataactgtatttattttggaaaatatagttaagttttcctaacaattgttatgttgacaaattatggttttagtattgtaattttaaaatgaattattacatatttttaaatttttcaagttgtaatttttaatacaataaatgatagctatgatccacataaacaaaagttctttgggatcctcagaatcttcagaaatatacagaggccctaagaccaacaaaagaatactgcattaactagtttattatacttataatttcatattttatgcattcataagaatgacatctgatgaaaaatctacacctctataaattcaaaagacttctttcattaagaataaaatattggaaaatgaattcagaggtctctatgaggtgtgcctggaggaggaagctaaatttcagtttctgaattgagtttattaaaggtttggaacttcttaataaaaagataaaaaaatcatttgacccctcaatgaaaaagcagaggaaaaatgcaaagcttgggggaaaactgtataaaaagtcatgatcataacattttaatattgcacagagaaaaatacttcttcatatttctatgaaatctatccaatcaccttacatgcaaaactatttttatttcttcttcccaaactccaccccaaattcctccccagccttaccccatcctttgaccttatgactccttccttttctcttaggctctacatcacaaaagctcccaaagtctactctggaaacactcaaatatccttcaggagtggaagaggaaaagaaattccatggacagtcagaaccaacttttaaaggtaaaggtggggatgagaaagaaactcaaaacattgatgattttggtcttgttccataggcttacattttcttctctatggaccaagtacctccgtttaacttaattattaaatggcattcattcatatttttaattaaaaatactttattgataaaaaatactaatacccatctgagccttcagcgagttgtaatctttttgctagtggagggtctgacctcagtgctgatggctgctgactgatcagggtggtagtcgctgaaggtaggggtagctatggtaatttctgaaaataatacaacaattaatctggccacattgacagattcttccttcaaaacagatttctgttgtgctgctgtttgacagcgttttacccgctatagaactttgaaaactagagccaatcgtctcaaaccctgatgctcatttatcaactaagtttatgtaatattctacattcatcatcatttcagcaatgttcacagcatcttcagcaggagtagattctatctcaaaaaaacactgctcatccataagaagaaaactcctcatccattcatgttttatcatgtgactgcagcagttatgtcacatcttcaggctccacttccatttctagttttgttaactatttctagcacatctgcagttatttcctccatggaagtctcgaacccttccacatcatccataagggctggattcaacttcttccaaactcctgctaatgttgatattttgacctcctcccaagaatcatgaatgttcttaatggcagctagaataatgaatcctttccagaaaattttcaatttactttattcagatccctcagaaaaaaacactttctatggtagctatatctcaaattaagactagaaagctgaaaggattccttcatccatgggctgcagaatggatgctgtgttagtaagcatgaaaattacattaatctccttgaacatctccattagagctcgtgggtgactagaaatctttttctgagcaaagtctcaatagtgggcttagaatatcaaggaaaccattctgtaaagagttgtgctgtcatttacacttgtcaatttccagatcacaggcagagtagatttattattatcttatgggtctctaggattttagaaatgataaaagagtatttagctttgactttgtcagcagctgcattagtcactaacaaaagacagcatgtcctttaagactttgaatccaggcattgaattgacttctctatgatagtcctagatggtatcttcttccaatataaggctatttttctcctatggaaaatctattgttcagtgtaaccactttcatcaatgatcttagctggatcttctggataacttgctgcatattctacatcagcacgtgttgcttcaccttgcacaatttttaattttaattttttttaaattttagcctttatgagcacatagtaggtgtatatatttatggagtacatgagatattttgataaaggtatacaatcagtaataatcacgtcagggtaaatcgggtatccatcacctcaagcatttatcatttgtgttaagaacattccaactggctaggcgcggtggctcacacctgtaatcccagcactttgggaggccaagttgggtggatcgcctaaggtcgggagtttgagaccagtctgaccaacatggagaaaccccgtccctactaaaaatacaaaattagccaggcatggtggtgcatgcctgcaatcccagctactcgggaggctgaggcaggagaatcacttgaacccaggaggcagaggctgtggtgatcaggccattgcattccagcctgggcaacaagagtgaaactccatctcaaaaaaaaaaaatccaattatactcttttacttatttttaaatgtgctataaataatcattgactgtagtcaccttgttgtgctatcaaatactagatcttattcattctatttaattacatttttgtacccattaaccattcccactcctctcagccccaccagtactcatgccagcccctggtaaccatcattctaatctccataaccatgaagtcaattgctttaatttttagctcccacaaataagggagaacatgcaaaatttgtctttctgtgcctgacttatttcacttaacctaatgtcttccagttccatccacgtggttgcacatgacaggatttcattcttttgtatagctaaatagtactccattttgtatatgactattgtgaatagtgttgcaataaacataggagtgcaggtatcaactcaatatactgatttctctcttttgggtatatacctggcagagagattgcttgattacatggagctctaattttaattttttgaggaatctgcaaactgttctccatagtggctatttttaatttacattcccaccaacattgtacaagggtttcctttcctctgcattcttaccagcaatcattgttacctgtcttttggataaaagtcctttttactggggtgacatagtatctcattgtagttttgatttgcatttctctgatgatcagtgatgttgaacacattttaataggactgtttaccatttatatgtctcttgagaaacgtctattcagatcttttgcccatttttaatcagaatattagacgtttttctattaacttgtttgagatccttatatatatgggtattaatcccttgtcagatgaatagtttgcaaatattttcacccaatctgtatggtgtctcttcactttgttggccatttcctttactgtgcagaagctttttaacttgatgtgatcccatttgtccatttagcttggttgcctatgcttgtaaagtattattcaagtaatttttgcccagaccaacatccttgagagtttatccaatgtattttttaatagtttcatggtttcaggtgttagatttaagtctttactccattttgatttggtgtttgaatatggtgagaaataggggtctagtttcattattctacataggaatatccagtattcccagcatcatttattgaagagactgtctttttcccaatgtatgttcttggcacctttgctgaaaatgagttcaccatagatgtgtatggatttctctgggttctctgttctcttcttttggtctaggtgtctgtttttattccagtaccatgatgttttggttactatagctttgtagtataattagaaatcaagtaaagtaattcctccaattttgttctttttgctcaagatggctttaactattctgggtcttttgtggttttatataagttttaggattgatttttctatttctggaaagaatgtcattggtattttgatagagattgcattaaatctgtagattactttgagtagtatgaacattttaacaatattgattcttccaatccttgtacgaggaatgtctttccattttatggtgtgtactcttcagtttccttcatcagtgtttcatagtcctcattgtagagatctttcacttctttggttaattcctatgtatttatttgtgaatattttatcccatttactaggatgtctatttactgtgttgatagtttcttttgctgtgcagaatctctttagttcaattaagtcccatttgtcaattttttttttttttttttttgcaattgcatttggaatcttcttcaaaaaatctttgccaaggcctatgtccagaatggtactttctaggttttcttctagggcttttatagttttgggttttgcacttaaatctttaatccatcttgagttgatttttgtgtatagtgaaagggagagttccagttttaatcttctgcatatggctagccagctgtccaagcaccacttattaaatagagtatccttttgtcattgcttattttagtagactttgttgaagatcacatatttgtaggtgtctagctttatttctgggttctttaactggttctattggtcaatatgcctgtttctgtaccagtaccatgctgttttggttaatgtagctttgtatttgtagtttgaagttaggcagtgtgatggttccagctttgctctttttgcttaggattgctttggctattcatgtgtttttagtttcacatgaattttagaatagctttttctaattctaagaagaatatcattggtagtttgataagaatagcttttggcagtatggccattttaatgatatggactctttcaatctttgtgtcatttctgattgtcagcattgttttgtaattctccttgtagagatatttcacctccctggttagctttattcctaggtattttactttttgtgtgtggctattataaatggcattgcagtcttgatttggctctcagtttggacactctatatagaaatgctactcatgtttatacattgattttataccctgaaattttgctgaagttgtttattagatcaaggagatttggggcagactatgggattttctatgtaaagaatcatgttgtctgcaaacggggatagtgtgacttcctcttttcctatttggatgctttttatttctttctcttgcctaattgctctggctgggacttgaggtaccgtgttgactaggagtagtgagagtgcacatccttttcttgttctcattctcaaggggaaagctgccagcttttgctttctgcatcaattgagatgatcacatggtttctgtttttagttctgtttatgtgatgaatcacatttattgatttgcgtatgttgaaccaaccttgcaccccaaggataaagcctactttattgtggtggattagcttcttgatattctactggatttggttggctaatattttcttgaagatttttgcatctattttcctcaaggatattggcctgatgttttctgtttcatgtgtctctgccacattttggtataggaatgatgctggcttcattgaaggagttagaaaggagtccctcatcctcaattatttttgaaaagtttcgataggattagtatcagctcttctttatacatctggtaaattaggtgcaaatctatctcatccaggactttttctggttggtaggctttttataactaatgcaatttcagaactcattattggtccattcagggtctgaatttcttcttgcttcaattttgggaatttatatgtttccagaaatttatcaatttcttttaggttttctagtatgtgtgcatagaggtattcatatagtctatgatttttttttgtatttctgtgaggtcagtggtaatcgtccctttgttatttctgattttgttattttgtatctcctctctcttttttctttattagtctagctagtggtctatcaatcttatttatgctttcaaaaaacaaacttctggtttgcttgtctttcgtacagtttttgcatctcaatttcattcagttcagctctgattttgattatttttttctcctgttaactttggtgttggtttgcttctgtttctctagttcctgaatgttttatgttattttgctaattgaagatctgtctaactttttgatgtgagcatttagtgataaaaaactttcctcttaacactgctttagctgtgacccagagattctgatatgttttatctttgttttcattagtttcaaagaatttcctagtttctgccttaatttcattgcttacccaaaagtcattcaggagctagttgtttaacttgcatgtaattgtgtggttttgaggtatcttcttagtattgatttctatttttattgcactgtgatcagtgagtgtggtggtatgattttgttttttttaatttgttgagaattgttctattgccaatcatgtgatctattttggagtaagtgccatgagcagatggaaataatgtatattctgttgtttttgaaggaatgttctgtagatgtctgttagagccatttggtcaagtgttgagtttaggtctcaaatagctgcgttacttatctgctttgatgatctgtctaatactgaaagtgggatattaaagtttcccactgtcattttttgcttctataagtctcttcataggtctctaagaacttattttatgaatctgagttctccagcattgggtgtgtatatatttaagagttaattcttcttgagttgagctttttatcatgatgtaatgcccttctttgtctttttcattactgtgggattcatgtctgttttatttgaaattaaaatagcaacctctccctttttacttttccatttgtttgtacatttttctccatttctttactgtgagcctattggtgtcactgcatgtgagaagagtcccttgaagacagcatatcattgggacttgcttctttatccaacttgccactctgtgccttttaagtagggcatttagctcatttacattcaagattaatattaatatatgcaaattcaatcctgtaattgtgttgtcagctggttgttatgcagacttgattgtgtggttgctttaatagtgtcaatgctgaatgtgcttaagtgtgtttttctcatggccagtaacaacattgccatggttggaactctcttaaggaactcttgtaatgcaggtctggtggcaatgaattacctagcacttgcttttctgaaaagaatcttatttctcattcacttatgaagcttagtttggctggatattaaattcttggctggaatttcttttctttaagaatgctgaatataggcagtcaatctctctggtttgcagggtttctgctgaaaggtcctctgttagcttcattgggttccctttgtaggtgaccaaccctttctctctagatgcctttaatattttttctttcacattgaccttggagaatctgatgactatgtgcgttatagatggtcatcttgcacagtatctcacaggggttctccaaatttcctgaatatgtgtgtcaacctctgcagtcagattggggaaatttttgtgaacaatatccttaaatatgttttccaaatggcttgctttctctccctcactttctggactgccaataagttttaagtttggtctctttgcataatcccatatgtcccagaagttttattttttatttatttttgtctgactgagttgatttccacaattggtctttgaactctgatatcctatcttcagcttggtctattctgctgttaaaatttctgattgttttacgaaattcttactgtgagtttttcagccctatcagatcagtttggttctttcttaaaatggctatttcatattttagctctcgtattattttattggattccttagattctatggtttgggttttgactttctcctgaatcttgatggtattcattcctattcagattctgaattctacgtctgtcatttcagccatttcagcctggttaagaaccattgctgggaagctagagtacttgtttggagatgagaacacactctggcctttttagttgctagagttcttgactgattctcgtctgtgtgggcagatgttcctttagtctttgaagttgctgggaagtgttgctttcatattctccaatgcccttgagggtttgaatttggtataagttggattcagttgactggctttgtttctgaatgatttcagtgggccaaggctcagcttagctctcctgggctgtgtgctgtaaccctgagggactggtatcatgcccacggctttgtcctctggcccctcaaggttaagcacccacttgctgtaggggccaaggtgttgccagtctgatgacaaaaacattttgatgagggttgctggccaaagcactttgatggcatggtggtgcaggatccacactcacagtggtaatgcagcagcattcaagtgcacacttgcactgacctgataggtttatcttttggtcttcctctactcgagatataagtagtttacacacaacaattagagtgttgtagtattctgtatttgtctgtgtacttatattaccagtgagttctgtaccttcagatgatttcttgtttctcattaatgtccttttcttacagattaaataactctctttagcatttcttataagacaggtctggtgttgacaaatcccttagcttttgtttgtctgggaaagtctttattttttccttcatgtctgaagaatattttcactgtatatactattctagggtaacagtttttttcttccagcactttatatatgtcatgctactgtctcctggcctgtacggttttgactgagaagtttgctgccggacatattagagctcctttatgtttcattttttttctcttaatgcttttaggatcctttctttatcctggacctttgggatttgattgttaaatgtcttgaggtaatcttctttatgttaaatctgattggtgttctataaccttcctgtacttgaatattgattcctcaccctaggtttggaaagttctctgttatctctttgaatctctttctaacccaacttctctctctctctatcttctatttaaggccaatgcctcttatatttgcccttttgagactattttctagatcttttaggcatgttttattcctttttattcttttttatcttctctatttattttcaaatgtgtgtgttaaagctctttcttcattcttttttctgcttgtttcattctgcttttgagagactcggatgcattcttcagtttgtcaattgaatttttcaactccaaaatttatgcttagatttttaaaaattatttcaatctctttgatatatttatctgatagaaattctgaattccctctctgtgttatcttgaattttatttagattccttaaaacagctattttgaattctctgtaagaaatgccatatatctcagtcactccaagattggttactggtgtcttatttagttcatttgatgaggcacccaccaccatgcccagcaatttttttgtatttttcagtagagatggggtttcaccatgttggccaggcaggtcataaactcctgacctgagatgatccacctaccttggcctcccagagtgctgggattacaggcgtgagccactgcacccggccatcaaagtcctctttactctaccttctcttttcatcaagtggaaggagtctctcctggagttgcgaattgtgctgtctgggtttgggggatgggtgacacaagcactaccttggccagcccagctggtatctcactgggtcacatgcatcccatgttcactggcttcaagcccagaacaacatcaggacttgcccaggaattgcagtccttgtggcctagactgcctttcaagtttatttaaaatcccagagcactgtagcccatggtggtggggctaggtggaatccagcttccaactgctgggacaaataattcctctttgactggggctagtctaaatgcttcctctgtgggtgctgactgaatttttatctgttcttttctgctgtgacaggacaacactgagttccaattaaaagtcccataatcacttctctttcctaccccaagcacacagattctctctccccataccacacagtactgctaggggatggggaaggagtggtgttagcaattcaagactgtctttcctaccttcttcagtgcctctttccttgatatgatgttaaactcagctactgtaattgctcacctgactttgatttttatgaaggtgcttccatgtgtggatagttgttcagtttggtgttcctgcaggggagataatcacttcaaagggaatgggaagatgttggtcaaagggtaccaagttgcagttatgaataaatctagtgtacactatgactatagattacaggcacagagccacaacctgtggctctgtgcctgtaatcctagcactttgggaggctgatgcaggctgattgcttgagctcaggagctcaagatcagcctgggtaacatgacgaaactccatctctacaaaaaaaaaaaaaaatacaaaaattagccagatgtggtggcatgtgcctgtggtctcagctactcaggaggctgaggtgggaggattccttgagcccaggaggccaaggtggcagcaagccataatcgagccactacactccagcctgaatgacagagcaagactgtctcaaaaatttaaaaaaaaagtatgtattgtatttattttggttatctccatatttttggagatatcacaagtacaactgtgtgaggagatggatatgctactttgcttgactatagtaataattttactatacgtttatcaaacattttgtgtacctcaaatataaacaattttttctacagttaaccatgaaggaagactttactcagtctattgcaataagggacggagactgaaatcaactctgctgaaacaaaaggcaggaaggtttctaaggtgagctagtggaaaagcactgaagtacattaaggggaaggttgatcaatgagatttgtccagcacattgggttattcctgttattccacaattcacaaatgtttttctctgtgatcaggccacctttgtttgctaatcagtgcccatctaaattaggcctgtatggaaccacagagactggaagatgaggtgctgtcttatttgacattaatacttcaaaaagatgtttctagattcttcagaaaggcatttcctgggtggtaaaactggcaggatggccagttccagatatctgactggagatgtctagcactcacttccttcacaaaaaagagtcaaaacggtgaatagataactactcatctgagaacattaaggttgtcttggtcactagtaacaatattttagatgctaaaatgctgcttgtaaattcatgtcagaatgctaacatacttccatttcttcatcccatcccaaaaagcactctaagaagatcacaataaccatgtgaggcattcagggcacaaacacacttttgttctgctatcttttctctgacactcagaccacccttgcctatagcaatcatgtttgactataagctacttgaggaaagactctttttaaattaaattttatagctcttagaggtgttaatacagtaatgtacaaatgattatgttctaataatattgactgatgcattaaataaatgaacattcccctccctggagatacgtatcaaagagctcatagcagaatctgaacatatctatggtcaaaatcagtttacatgccaaatctatgtaatctcacatccactgcaatccaaccttctttattacaataacaaccaagtcaaccttttagaatacagccacaagaccaaaaatccattagacctgagtgacaaataggaaccacagagttcatgcagatagctccctgataccataataagtataaatgagtttttttaaaggttcctgtagaaaaatatgtagataaccaaaaataaaagtactcattttattataaagtgttacatgtgcatttaatacatgcacatttaatgcatttcctaccaggtgccaggtccttttgagaaatgaaattaattattgaaaatattggaatattgaaatattgaaattattgaaaatattgaaattaatattttcactgtttgtctccatcaaatgtcttattaaaggtaagtagaccttctgctagcctatttaggtaagaatataaaaatgtagggttatgggcctggcgcggtggctcacgcctgtaatcccagactttgggaggccgaggtgggcggatcacgaggtcaggagatcaaaaccatcctggctaacatggtgaaagtccgtctctattaaaaatacaaaaaattagccgggcgtggtggcgggcgcctgtagtcccagctactcaggaggctgaggcaggagaatggcatgaacccgggaggcggagcttgcagtgagccgagatcgcgccactgcactccagcctgggcagcagagtgagactccgtctcaaaaaataataataatatagagttatgtacatgtggagtatttactaaattgatctgatcttatatgaattatttcaggcactctcgtcttcatcttaaaatggaatgggaatctacatcatttgggacttcccattactctcagaaaatagcccacctctgctttttgaaaataattctcggccgggcgcagtggctcacgcctatcatcccagcactttgggagtctgaggcgggcggatcacgaggtcaggagatcgagaccacggtgaaactccgtctctactaaaaatacaaaaaattagccaggtgctgtggcgggcacctgtagtcccagctactcgggaggctgaggcaggagaatggcatcaacccgggaggcggagcttgcagtgagccaagattgcgccactgcactccagcctggacgacagagcaagactccaactcaaaaaaaaaaaaaaaaaaaaaagaaaaagaaaataattctcctcagctgtattttggttcccctagttttccagctactcagagtttagtattacaattatcttattattgttctcatcttgaatcatttcaataatccttaaaacatattcaggttttcataaactaaaaaaaaagataagcatatataaaagaaaacatctaaagaaatctgtattagttgtctaacatcacataacaaattacccaagatcttagtgacttaaaacaataaacacttattaattcacagtttctgtgggtaaggaactcagttgtggcttacctgggggttctgccttaggatcacttaagatcttagtgacttaaaacaataaacacttattaattcacagtttctgtgggaaaggaactcagttgtggcttacctgggtggttctgccataggatcacttaagatgttgcagtcaggatgtcagccatttctgcaggcatcagaagacttgacttggtctggaaaatctgcacataagacagctctctgccatggtgctggttggaaaagttcctctttatgagttacttgagtgtcggcatgacgtgatggctagcttcccccagcatgagcaacctatgaaagggcatgacagaacctataacacttttatgatctagaatcagaaatcatacagcattattttttcaatttactatggcttacacaagtcagcactattccatgtgaaagggaattacagaggggcatgaataccaggagactaagatcattggatgccatattggaggatagctatcataacatttttctcttgttcccacctatctattatatttgctaaacaatgttcctctctggttttgctgccaagctcctaaaatatttgatctacatctttcacgtcctctctttaaggattctaattccttcttatcctttttgtcatctacttcagtgcatacaactccatgaaactatttcctcaaaggttactagttatctctttctgctaaatgtatgacgtttgcctttcctcagacttgtcattcaacattttaaagtgtttgctactatgaacaaccccctagtgacatttcctcattctttggcatctttggcactttatgggcttcttccatctctttgatgccacttagcttctccactgtgtttctatctatggagtgttctctaagttcacacctccatttttctccctatagtttggtctcatatatcctcactgctttggctgtgacatttagtatctggccattagtaaatatgtatctccttccctactcaatcatggtatgttcttgccagctgcctactagcatcttcattctctaatctctaagaaattcccactgattcttccttcaatacctctttgaagaatctgccttatctctttcgttccaactaccactactgtagtccaagccctctctatctcacaaccagatcaacacagcactattttagctgatatatttactggactcgagggctgaccttgccttttctttaataaaactgtcatacgcttttccactacatcttctttaaaaattccttttatctttttatttttaatcatgaaaagattcattatcatctgatttcaaatctaaactccttagactagtttctgaaacacttaatgtgttttggaaccacaccatttggctaccatacttaattccttattttctttatttcttactcttatttaccttatttttccttaatgaggttaatctactcattgtcctgcaaatacacaaatttccacatttcctttctttaattctattctccaccacacacacagaaaaatatgctcttatttatgtcctccattttatgaattttccagtctcagtttccacaatctcaatgaaatcttctctgactactttgtttcatactaaactgtttgattttttggttcctgatgccctattagtcacccacatctctgattcttcatatgttagttttatttccacagctcagttgtcggcttctaaatgctggatttatttatttcttctcatatttcttttaaaacatctaaaatagtctacaagtaccatgctgagcacataataggccatgaataaatatttattggttaactaaatgaggaaaacaactagaaaattcccatggcatttggcagaatgactacaggcaaaaggctccttctcaaaatatattatctaaaagtgcattttccccatgtgtcaatgaaaaaacaaatgactttcttctagcatagccaaagttagctcttaaagcatgtgtaaaatccaaaagacagaatttctgaaggcacaactgtttaactaaaaagacagatacgcaaaagaattgcttcatttaacaagtacagaggaaatagatcacattccaaaagtaatttgataattttggcagctggaaaataattttataaaaatttaagcaataaggctgttgtcttggatttgttaagggaaaggaaattttcataaagccaaaaaagtaaaagaagaacttacatatgtgagtatcaggaaaagaaatagtgaggataattgtatcactgaagaaacatctttttttctaattcaagcatataaaaaattaatgtgactattaacaactatgacctctctatagaaagaaaatatatccgtacttcccccagagtctcacagttgttgtgtcctcctttggaagcaatattatgtcttggaacctgtttgaggctctgcagtcagtggaactgttcattactagctgagtgaccttaggcaagttactgaatctggaggaaacttaccaacctcacagagctgttgggaaaattaaatgagattatgtatctgaaggaacctggcatggtgtctgactcatgctggccaatacatcttagtctctttccattctgattagcagagataaagagatattgggagacagaaccacactagagtaggaaggaggaaactgggactattttccaggttgagctgctacttagatattatggcaggaacagcaaattttcttacagattccattttcttcacttaaaaagattttttagttttaatttttgtgggaacagggtgggtatatatatttatggggtacatgagatattttgatgcaggcatccaatgtataataatcacattatggagatggggtatccatctccttaagcttttaacctttgtgttacaaaaaacatccaattgtaattgtttagctatttttaaatatacaactaaattattttcattatagtcacagtgttgtgctatcaaatactaggtattcatttttctaaatattttttatgctcattaaacatccccatctaccctcagtgtccccactactttttcaagtctctggtaaacatccttctactctctatctccatatgttcaattgttttgattgttgcatctcacaaataagtgaaaacaggtgatgtttgtcattctgtgcctgagcctgacttatttcacttaacataatggcctccagtcccatccatgttgttgtaattggcagcatctcattttttatggttaaatagcactccatcatgcataaggaccacattttctttatcctttcatctgttgatggtcacttaggttgcttccaaatcttggcaattgtaaacagtgctatagcaaacatgggagtgcagatatctcttctacatactgatttcctctcttttgggtatatacctgggagtgagattgcaggatcacatggtagctctatttttagtgttttgaggacgctccaaactgttctccatagtgattatactaatttacattcccaccaacagtgtaaaagggttcccttttctccacacccttactagcatttgctattgcctgtcttttggataaaagccatttttactgggatgagatgagatctcattgtagtcttgatttgcatttctctgatgattaataatatggaacaccttatcatatgcctgtttgtcattagcatgtgttcttctgataaatgtctattcagagctcttgcccagttttaaaaatcttttaagttcaggggtacatatgcaggtttgttacataagtaaacgtgtgccatgggggttggctgtatagattattttatcacccagatattaagcctagtacccattagttatttttctggtcctctccctcctcccaccctccacccaccgataggtcctagtgtgtgttgttcccctctatgtgtctcagcatttagctcccacttataagtgagaacaggaggtatttggttttctgttcctgcattaatttgctaaggataatggcctccagctccatccatgtccatacaaataaggtgatttcgttctttcttatggctacagagtagtccatggtgtatatataccaccttttctttatccagtctatcattgatgggcatttaggttggtttcatgcctttgctattgtaaatagtactgcagtgaacatacacatgcatgtgtcttcttaacagaacaatttatattcttttgggcatatacccagtaatgggattgctgagtcgaatgttatttctatcttgaggtctttgaggaatcaccacactgttttccataatggttgaactaacttacactcccaccaacaatgtataagcatttctttttctctacagtctcaccagcatctgttttttgacttttaataatagccattagactggtgttagatggtatttcattgtggttttgatttgcatttcgctaatgatcagtgatgtttgtgcccatccttcttgaggatttccaggtatttgaagggacttgggccccaagtccaatatcactgtggctttggcagactgaaagagataccaccttggttgtcttggataagatctgcaagaattctctgggtaaccaggcagagactcttgttcttttcccttactttctcccaaacagagtttctctctgtgctgagctgtctggaactaggggtgtggtcatgaaagcaccatgctagtgttagcacggccactaggtcttgcctaaggcccgctgtaacaaccacctggctaccacctttgttcactcaaggccctagggctctacaatcagcaagtgaagccagtgcagtttgtgtccttcccttcaggatgttgagttcccccaggcgggtccagagatgctgcttgggagccagggattggagtcaagaatcttaaaaatttgccttatgttctattcttctgtggctaagctggcattcaaaccacaatatatatttctccccattcttccctctcctttccataggcgaggagcctccctgtgagcactgccaccaccactggcctatcatggggttctgccaggtcaccactgatgttcacttaatgcccaagggctcctcattcatcttgtggtgaatgctgccagtcctgaaactcagccttcagggccatgggctctgctctggccccagggcagatccagaaaggctgttcaagagcctagttctggaatcgggaaccccacacttttgcttacggctctaccccactgttgtggagctggtaccttaggtgaaagacaaagtcccatttacttttctctctgcttttctcaaacagaaaggtctttcactgtagccaccacagctgggaatgtgctgagtcacgtctacagtcagcatgtttcagagtccaaggaccacagcatactacttggttatctctgctggttattcaggcaccaaggactctttagtcattaggtgatgtatcctgccaggactgggtccttccttcaaggcaatgggttccctttgactcaacatgtgtctagaaatgtcatatgggagacagggcttgaaaaggggacatcataaccctgactggtgccatatcctactgtggctaagctggtaaccaagatgcaagacaactcctctttactctttgctctcctcaccttaattagaagaaataggacacttttgttgtcacaagctgctctgcctagggttggagtcgaattggctcaagcacttcttcagccactccagctggtgtctccctaggtcatgtgccccctagtcctctggctctgagcccagcccagcactaggatttgcctaggaattgcggtccttctggactgcctttcaagtttacctaagactccagagtactttggcctatggtgccaaagctttccaagaagctgaagttctgaccgatgggatgagtgattccccttttgctaggtctggtccaaatgctttctccatgtgctggcactagctgagtccaggctggcttttctctctgctatgacagagtagcaatgagttcagtgtatgcctcccagtcactgtgctctccctaccctaaatgcacaggctctctgcactacagagccattgccaggaaattgggaaggggtgatgtcgctgattcaagactgtctctccaacccttctctatgcctctttcaatgatacaaagttaaaaccaagtactatgattgctcacctgagttttggtacctgtgatggttcttttctgtatccagttgttaaaatttggtgtttctgcagggaatatgaatggtgtaggcttctattctgccatcttgctccatccctcctcttcttatagaagcccctgagttttaatgggtagccaaataaagatatatttcttttggcttcctggagtttctaactgatttatttgcaatgccgtttggtagaccagatactactttactaccattcaccactaacttcagtcctacgctcagccaaatgacaacattcatgactcttttttgatacctatgggctcttctgtgtatgaccactggaccagatgatctctaagaaatcttccagcaatcagtggttctgggaaaacacatgggatgatgttcatttctcttagtcgatattgcaattacttagtgggttttctctttttctcaaaatttaacaggaaatttgaaatgatcttggttttaaaattctcagatgtcttctgcatgttaaacctatcaaatatttatttaggagacggatggcatattgtggttgctgtaacaaaataccataaacctgatggcttaaaacgatagatttttttattctttcacagctctggaggccaaaagtccaaattccatgtgtcagcagggccacaaagactctaggggagaatcattcctttcctcctccagtttctggtggctccaggccttagtgggttggtggttgcatcacttcaatacttgtttacatcttcatatggccttatctatatctttgtctgctgtctcttaccaggacacttgtcattagatcttggtctcatctcaagaactttagtcccatctgcaaatattttatttgtaaataatatcacatccacaagttctggggattaggacttggatatatgttttggggagtcaccattgaactcactacagatggctacataaacaatcacttataaaatacatgcagtagagctatctcatactctaacaaggaaataatcatatttccctttttaactatttacaaaaaaatgaaaaatttgttttaagatattttcatatgaattgtgaagctacacatttaaatagcaatcttttcaatctatcaatatcttctacattatcatagcattttcattattgtgaattttgttctaattttggaatttactacttcttaaatagataacaattatttagaaagaagtcttggaaaaaccaatttttttcttctgtttaaagaaacaagtacacataaatacaatcttaaaattcaacataaaagtatggagaaaaaaattattctccttcaatattcctttcttaatccctctctcttccttagacaaataacagtttaaaatttctttccgaaacttttgggcatacataaaggacagttgtttgtgggtttttttgtttattataaatgagattatggtcagtgaattgcattttctctttaccaatacctcttgaagatatctgtctacatggacatctatactattatttttgtaactgcacaatattgatagaaataatgcgccataatttgttgatgaacatctaatttactttcaaattttttatatcacaaaaatgttttaatgtcatatatctttaagaacgtgcaaatatttctataggatagatatttagaggtaaaattctttggtcaaagttatgcacatgtccactttgatttatcctgctcatttgtcttgcaaaatgctctgtgaaagggacaattatggctaaagaataatccttatgtggtcaattaaccagctatattcttctataatagctggacagatcatgtgggcaaaaggatatacatgtatatgtttatatgcatctgtatatttttatgtacatatgtgtgtgtgtgtgtgtgtgtgtgtgtataatatactgtttgttttttctatctaggtgttatagaaagccacttagcatcagctggataaattagaaaaaaagtcacttatgctaatatccccccatccacccaaataggctaagcatcatacactcaaataaggaaaaagagagccatttttttcagtgtagtaaacaaaccacaataaaaaaaaaaaaacctaaaagaaaaaagtagcatctgttctgctttatggaccagtgccatggtcccaaggcagaacactctctcagttcaagaattcgccctgagaatggaggcagctccaaaatatctaatggaggcatcttaaatcaacacaagagctcaattcaacaatgccatcacaactctgtacttttttcccaacagttctagcagaagaaaacttgctaaaagttatatgtaacttgaattccaaggtgatctgaataaaatgagtgcagcaccacaaattatgtatttagatgcttttcagctaatctaggaaagaaagaatatcttttcctcaggcaaaaggttaaactggagtgacagtagcataaaaaaacttattgtggtgcctcaatagctgtcactcctgacttcggcactcagcataattatatcaacatagtaataaaaataattccaaagtatttgaacatggtatgtccttaaaacaggttgacaactaaggatgcacatattttgaaggtagcagacttacagctctttaaaatgcagcaggaaactgcatttctaaaatacaggaatacatagaattatttatcaagtcattatagaatatttacagccttagaaaatttatcatgttccattaagtagagtttgcttccatcaagctattccttatgcagagcttcaaatacccttcatctaacctcactgaagtccagtgtacactttctgcctctgaaatatctccacatatatccttatcacatatttggcaaaatagggggtcaagcaataaaaacctgataggttgtattgcatggaattgctttctgatcaaaatctaagatgcataaaatgttgggttgttgcagagtttgttgtatttacaacaaagcagaaaagttagtcaatttaaacatatgaaatcggctgcgctaaagattagaacaccctggggatcagagacacagttcaggatggctgagcactgacagtgtgacatatttcaggacaaaaggattttgtactgggggaatgattccattctaccgacgagcaaatggagcaaatgattatttttgcattctttatgtgttattctttgacttctcttttcaccatttggagatcaaactgtttttggctgttctgtgacttttttaaccaacgatcggatacctttttctctgcttgttttcacttgttttttatttatttattttgagatataattaacactcagtagtatgcacagccaggcacagtggctcatgcctataatcccagccctttggtaggccgaggtgggtggatcacttcaggtcaggagttcgagaccagcctggccaacacggtgaaaccccatctctactaaaaatccaaaaactaataataattagctaggcacggggcatgtgcctgtaatcccagctactccagaggctgaggcaggagaatcactagaacctgggaggcagaggttgcagtgagccgagatcacgccattgcactccagtctgggcaacagagcaagactctatcccaaaaaaaaaaaacaaaaacagtatgcacaaacttcaactgttcagtatgatgagctttaataattatatacagctatgtaaccaacactgaaaaaatacatttaaaaaaatcccttgtgctctgttccagtcgatttctgtccccatccccacattaactatgagatttctatcagcatagattacttttccctgtattcagatttcatacaaatgaaatcctacagtatatgctttttatcacttaatataatgttgttggttatcctttctatcacttaatataacgctgttggttatcctccatgttgttctgtatatcaatagttttaactgctaaatagtggtcaattgtatgaatatactacaatctatctatcaagtctcccattgtttgatatctgggtttgttctagtttttgttattataaatctggttgctatatctttttacatgtcacgttaatacctatgagtagtattgctaggtcatagggactgccagttttcctaagcatttttatcactttacactccaccagcaacatatgagaggttcttcactccacattctcaccaaaataagatgttttcagttttttttttaaatttcagccactcctgtggatgtttagtatagcatctcattgttgctttagtttgcagagccttatatctagtaatgttaaagactttttaaatgtatttattgttcattcatagattttcttttgtgaagtgtttaagtctattgcacatatttcaattgggttgtctttttgtagttgattggtaggaaatttttatctattctgtatacaagtctgttgtcagaaattctttgaattttatttatcattttgagatttacttattaatttttaatggagtcttttgatgagcagaattttaaatttagcctaattttagtaattaacttattgtctcttatggttgatgctttttgtgttctatcaaatacatctttgcctaacctgaggtcatgaagatatgtttcttttttcttctagaagctttataagtgtcattttatgtttaggtctgggatccattttgaattaatttttgtatatggaataagagtgaaattacattttcttccatatagatatctagttgttccagcaacatttgttgaaaagactttggccaaagaattgctttggcacttctttgaaaatcacttgactacatatttgaagttgaaaatcactttactgagtatttgtggtttgtttgtgttctattaatttatttgcctatgcttatgccaataccacagttccctgattactatacgtttatagtaaattttgaagtcaggtagtcttaagtcctccaattttgttctttttcaatataggttttgcaattctattttcttttcattaccatatataatttagaactatcttgtctatttcttcagaatagcctgttgacattttgatagagattgcattgagtctatctatcagtttaggaagcctagacattttaacaatgttgcattttcctatcgaggaacatgctatacttctccatttatttagatctttaatttctctcccaaatattttataattttcagtgtagaggtgttacatatcttttattagatttactctttcttctccaaggttttttgatgctattacatatttttaactgctattttccaactggtggtgggatggcaatttgctctatggctggggcccttgtaattccaatctattacaagagcccacacacggttattaaacatgcattagcaggtcagctggtttctgcctatcctgtctgtgattaattcttctagaaaggagaacagtgataaatctcttctatcctataaagagtttctcactctctgatgtcttgttcatttgggtttctttatgtgctcagctttatgatgttttttaaaatatcatttttataccttatctggtttgtttgggttattaatttaagactaacggtcttttgtgactttttacatccaaactagaaatcaatcaattatgtggttttttaaaatagttttaaggtaaccttcctctttactatgtctgaaagtacaaaaaggaaatgaatcaaatagtggtcaggacaacaaaatcataaagaaatctgttgacttatggcttgctatgtgctaggtcctagatttacaagtatcaccaaattcagttcttagaacaaccctatgagggaggcatgacagtcattatccccatttcacagctgagtaagctgaaatacagagtacataactagtttgtctgatgaaacacagctcttaaatgaaaaaactgggatttaaacacaagtagtatgggtttcgagcctacattctcaccaccttctcttcaatttccctctaacaaatcttatcatttctacatttaccctcatttcccaagtacgatagctatctggaatttttaactgtaagtgctcatttctttattgagttgtgccgcttctgcaattttcatctgcaattttcatctatacaatctcttacactcacttagtatttttatataatagatacaacttattaagtgctcatataaaagatattgtgtgttattaacagtagttttgtatatattattcacaaatatcacaaaaattcttaaagatagatgatgttgttctcactctatttgggggtccaaattaagttccaaagcaagcaattgtcttaattcacataaaaattagtcaaagggtgaaattggaatctgaccaatcttgggtttaaagcccatgttccctttaccactccacacagcctctctctcatgaatgactctccgagtcttctgaactcatcgtcacaactccctttcctcatattttattaggtactctaactgggtatttatttaaatgctacttctttgtgtatcattactttatttttgcttctgctattttaaattcatttgtttgaagttaaggcctcaatgtctactggagcctcctttggaggatattcttaaaactgaaatttagattaaaaaatataaatgacgagttaatgggtgcagcacaccaatatggcacatgtatacatatgtaactaacctgcacgttgtgcccatgtaccctaaaacttaaagtataataaaaaatatgtatatataaggaaataatcattaatggaaatgagtgaaagaagtcaaccaagcagactttcagatgtgtacagtagattggggtctggggcccatactatgggcaggacctggttctcagctactagagttaggagaaataatgcagaatctctctgctcattctcataaaggtatgaaattacatatgattccacattaccattattaccattttttttcaaacaacccctcataccaactttatctacttcaaaatacaatacacaattaatgtccattttaacatggattcaacagaatgaaaggagatcaaaaaggctcccaaactcctcagggctgactctgatacttgcactccaccaccattactgccagtaaaacttgtccaattctagcctcatatatcaaaaatctcatgcatagcttccacatgcatatagtttcttgaatcatttagataaaagaagaaaaactctataataagggcttgcaatcggagagactgtcacttgatctactaatactcaatttatggtaggccctatgcaaaaatctataattcgtaattttgcacctatttctgaaatttaatggcacttaacaagatttaaaaatactgaacgcttatcttcattctcagtacagaaacccttcagagaaaaaattctgctactctcttaggactgaatctcatttcagacacatgttcctttctatagctcaggtgtaattatttaaatgtcattaaatccttcaaatctgtttgataaagtaattgaaattaattcatgtaatttattttactttcaatgatagaaacgtgtgcacataaatgtcactgcactgccaaacccagtggatcgcaactgagttttctttctgaggatttctagtcagcagggattttaacttccaaatgcaaaaatttctctcttgcagcacataagtgggctgaggcactaattagcaagtttcattagtaagaaattctctcattcaggcctatgaccaaagagatgaagctaggacgttattgagaccaagttcctgctctaaagcgatccctgtaatactatcacaaattataatagtgctttttatttttttcttttattatactttaagttttagggtacatgtgcacaatgtgcaggttagttacatatgtatatatgtgccatgtcagtgtgctgcacccagtaactcgtcatttaacattaggtatatctcctaatgttatccctcccccatcccccctgcccccaccccacaataggccccgctgtgtgatgttccccttcctgtgtccatgtgttctcattgttctattcccacctatgagtgagaacatgcggtgtttggttttatgtccttgtgatagtttgcagagaatgatggtttccagcttcatccatgtccctacaaaggacatgaactcatccttttttatagctgcatagtattccatggtgtatatgtgccacattttctttttttttaggtttacttttattattattattattattattatcattattattatactttaagttttagggtacatgtgcacaatgtgcaggttagttacatatgtatacatgtgccatactggtgcgctgcacccactaactcgtcatctagcattagatatatctcccagtgctatccctcccccctccccccaccccacaacagtccccagagtgtgatgttccccttcctgtgtccatgtgttctcattgttcaattcccacctataagtgagaatatgtgttgtttggttttttgttcttgcaatagtttactgagaatgatgatttccaatttcatccatgtccctacaaaggacatgaactcatcattttttatggctgcatagtattccatggtgtatatatgccacattttcttaatccagtctatcattcttggacacttgggttggttccaagtatttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgctcctatttctccacatcctctccagcacctgttgtttcctgacatttaatgattgccattctaactggtgtgagatgatatctcattgtggttttgatttgcgtttctctgatggccagtgatggtgagcattttttcatgtgttttttggctgcataaatgtcttcttttgagaagtgtctgttcatgtactttgcccactttttgatggggttgtttttttcttgtaaatttgtttgagttcatcgtagattctggatattagccctttgtcagatgagtaggttgcaaaaattttctcccattttgtaggttgcctgttcactctgatggcagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaattctttaatacatcttgaattgatttttgtataaggtgtaaggaagggatccagtttcagctttctacatatggctagccagttttcccagcaccatttattaaatagggaatcctttccccattgcttctttttctcaggtttgtcaaagatcagatagttgtagatatgcggtgttatttctgagggctctgttctgttccattgatctatatctctgttttggtaccagtaccatgctgttttggttactgtagccttgtactgtagtttgaagtcaggtagtgtgatgcctccagctttgttcttttggcctaggattgacttggtgatgtgggttcttttttggttccatatgaactttaaagtagttttttccaattctgtgaagaaaggcattggtagcttgatggggatggcattgaatctataaattaccttgggcagtagggccattttcatgatattgattcttcctacacatgagcatggaatgtttttccatttgtttgtatcctcttttattttcctgagcagtgttttgtagttctcctggaagaggtccttcacatcccttgtaagctaggtattttattctctttgaagcaattgtgaatgggagttcactcatgatttggctctctgtttctctgttgttggtgtataagaatggttgtgattttcgtacattgattttgtatcctgagactgctgaatttgcttatcagcttaaggagattttgggctgagacaatggggttttctaggtatacaatcatgtcgtctgcaaacagggacaatttgacttcctcttttcctaattgaatacactttatttccttctcctgcctaattgtcctggtcagaacttccaacactatgttgaataggagtggtgagagagggcatccctgtcttgtgcccgttttcagagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatattttgaaccagccttgcatcccagggatgaagcccacttgatcatagtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatgtatccatttcttctagattttctagtttgtttgcatagaggtgtttgtagtattctctgatggtagtttgtatttctgtgggatcagtggtgatatcccctttatcattttttattgtgtctatttgattcttccctcttttcttcgttattggtcttgctagcggtctatcaattttgttgatcctttcaaaaaaccagctcctggattcattgattttttgaagggttttttgtgtctctatttccttcagttctgctctgattttagttgtttcttgccttctgctagcttttgaatgtgtttgctcttgcttttctagtttttttaattgtgatgttaggctgtcaattttacatctttcctgctttctcttgtgggcatttagtgctataaatttccctctacacactgctttgaatgcgtcccacaggttctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtccgcttggtacagagctgagttcaattcctgggtatccttgttgactttctgtctcgttgatctgtctaatgttgacagtgggatgttaaagtctcccattattaatgtgtgggagtctaagtctctttgtaggtcacttaggacttgccttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttctccatttgcttggtagatcttcctccatctttttattttgagcctatgtgtgtctctgcacgtgagatgggtttcctgaatacagcacactgatgggtcttgactctttatccaatttgccagtctgtgtcttctaattggagcatttagtccgtttacatttaaagttaatattgttatgtgtgaatttgatcctatcattatgatgttagctggttattttgctcgttagttgatgcagtttcttcctagtctggatggtctttacattttggcatgattttgcagtggctggtaccggttgttcctttccatgttttgcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaattttggcccccactctcttctggcttgtagagtttctgccgagagatcagctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctaccttgctagattggggaagttctcctggatatatcctgcagagtgttttccaacttggttccattctccccatcactttcaggtacaccaatcagacgtagatttggtcttttcacatagtcccatatttcttggaggctttgttcatttctttttattcttttttctccaaacttcccttctcacttcatttcattcatttcatcctccatagctgataccctttgttctagttgatcgcatcagctcctaaggcttctgcattcttcacatagttctcgagccttggttttcagctccatcagctcctttaagcgcttctctgtattggttattctagttatacattcttctaaattttttcaaagttttcaacttctttgcttttggtttgaatgtcctcccgtagctcggagtaatttgatcgtctgaagccttcttctctcagcttgtcaaagtcgttctccgtccagctttgttccgttgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgtcggagtacccgccttgtgaggtgtcagtatgcccctgctggggggtgcctcccagttaggctgctcaggggtcaggggtcaggggtcagggacccacttgaggaggcagtctgcccgttctcagatctccagctgcgtgctgggagaaccactgctctcttcaaagctcagatggaaatgcagaaatcacccatcttctgagtcgctcacgctaggagctgtagaccagagctgttcctattcggccatcttggctccttcccctgccacattttcttaatccagtctatcgttgttggacatttatcttggttccaagtctttgctattgggaatagtgacacaataaacatacgtgtgcatgtgtcttatagcagcatgatttataatcctttgggtatatacccagtaatgggatggctcggtcaaatggtatttctagttctagatcactgaggaatcaccacactgacttccacaatggttgaactagtttacagtcccaccaacagtgtaaaattgtccctatttctccacatcctctccagcacctgttgtttcctgactttttaatgatcgccattctaactcgtgtgagatggtatctcattgtggttttgatttgcatctgacaaaaggctaatatccagaatctacaatgaactcaaacaaatttacaagaaaaaaacaaacaaccccatcaaaaagtgggcgaaggatatgaatagacacttctcaaaagaagacatttatgcagccaaaagacacatgaaaaaatgctcatcaccactggacaagcgcttttgaaaaaccaggaaagaccatagcagcaaatagaatccctttagaaactgattttggcatgcctggaacagatgctacaatcacttctagtcagtaagcactcatgaacaacaaaactgctacaggcaaaatgagctaatatctgacccaaactcatgttcacaaagtcgcttcaagatctcacttcatacatttccctacatattttttcaggtgaaactacaacctgccttttcttgagtaacccgcccttttgtccgcttacaaagcacaacagtgtagatagtgtttggctggcctgttagaaagttgatttgtcattgccatttgtctaacgcatgcttgttacagaacaaggaatatgctttcaaataagggtatgaaatgtggtttgatgaaacacagtgagtgaaggaaaacttagtccttgcctgtgtacttgtaacatactagtcagtctggtgtggaatataataatctacaactgatctgagcaaatatttctctctgattagaggacagtgatgatagaatattccagcaaagttaaaaaggaagaatgtggtttctccctatggtgtaatcccaggaggagttcactgttcttcctatttcagaattgctgacagttgaaaattatcttcagttactttattatctgtttagatttgaagataaatgaatcaaacatctaatttaatgcagtcatttaattctactggttacctattctcttctatacaattgagttttgtatttcatatcaaagggtatctttatagcagattaatatctaaaccactagaaaaaacctttataagtgaagatgtttatatgctcatacatatttaaaaaatacttgcattctgtgaaaactacaaatgtcaagtgacttacagacaacaggaaatcatattgaatttgtgattaacattatagtaataactacatcgcacaaatacacagatgtatatttgttgccatgataaaagtttccttaaattatgtgatttgtaacatatcttagcacaagtcatattttccttggtgacccatgttacctctaaaatatccactggtaaatatatggacagaatgtttattttctgtttggactacaaaatctacatagacgcatgcaacctttaaagcaatgcaaccattaagtaaagcaaatgactaaatttctgtgttgtactttcagcagtgccatgtaaacatgaggcctgagggcacgctttagcagtttgctcttgcccttcttcaggtctgcccctccacatgggtaagggaactgcaaggccaaggctctgggagcttggaactctggaattactaagtgggaagctatggatgaagcttgcctatgaggaccaaagtgtacacacatatgtacaaaaggcaccaagcatcttgtaatgcaaaactgatcttggcaaaagaactaagaagccataggcctacatctcggtatacctgtgaagatctaagttttctaagaatcttcaattctgacatggtcttccagttcattccaaatgcatattcacattttgtatcaaaatatgaggatagctcatattttgtaatcattttcttaccttgatttataacttttaaatatttagatatatgatatttaattactatttttagttataccttcatcctaacacagttaggaccaggttttatctttaataaagaccccaatcttcctaagcatgactcacttttccacttcactgcagaatggtttgattacaggctctaaaaaaataaacagaactaattgcctatacataatacatcataagtgccacaatatgcaagcaaaagaggaaacatgctgcacacatatattatcagataaagtgcaacaaagaacataaatgtattattcatgacatgaagtgaaatgactaatgtctttaaaactacattgctccctacccatggacataaaatgaattgttttaaatgtgtacatgatgacattacaagcgttactaaataaatttaaacacttcaacgggagctatgaaaaaaaaaaaacggtcaactataaaattacccaaattacattttctcaatttttaacaaaattataatcatgtttttgtcttgcttattaaaaatttcataaagtcaaaagatatgcagaaaataaagaatacatgtgtataactccagaaaatacatggaaagagaaggagtttatcattaaagtctttgccacaatacacttctcttcataatgcttgaaagaaatcttcatagcagagtgaatcaaatggaatatggtagactggtaacagaggcagaatctatctgcattagtgcatggaatgcatcaaggacctgactttttaacttattaaacatatctgtaccagattttaggacaataagaaactcgctttaagtcaaaggattgagaaatctcatattgatgggaattacacattctttttagctagtatcccaagtgttatacccaaaatggctcactaaagtaacatgaaaatgctttaaaaatagaatacttgatgattcataaaaataattaaggactgtgttggaccaaaattttatcatgatgaagaataattttgctaccaacagaaaaataatgcagcatattttgcaaattcttatgcatattttgctcttttgaaagtctatataaacatcgacttacattctttaatttttattataatcacataactacaataaacagaagctcagatttgcttctgactgtcactgacagaatcaacatatattgtctgaaatttccaaagtcagaggcagtaacattaattaatgaaaattacaatggttttgctttgaaattgtgaacttttactttttttctttttaattattatggatacataatagttatatgcatttatgaggtactttgatacaagcatacgaggtgcaatgattaagtggggataattgagatatccatcacctcaaacatttatcatttctctgtgctaggaacatttcatatccactcctctagttatttttaaaacatacaataaattgttgttatagttgccctgttgtgctacagaacactagctcttattctatctaactgtatttttgtacccattgaccatcctctctctatccccctcctcaccaccctccccagactccagtaactatcattctactctctatctccatgaatttaatttttttagttcccacatatgcatgagaacatgcaatgcttctccttatctgcctggctaattttacttaatataatgtcttccagttctatttatgtagttgaagatgacaagatctcattctttattatgggtgaataatattccactgtgtatatgcaccacattttttttaatccagtcatctatcaaaggacacttggaatgatttcacatcttgactattgtgaatagtgctacaataaacatgggagtgcagatatctcttcaatatattgattttatttcttttggatataactcagcagtgggattgctggattttatggtagttccatttttagttttttgaggaaactccatactgttctccatagtggctgtactaatttaccttcccatcaatagagtacgagggttccactttctccaacatcctcactggcatccattattgcctgtctttttttataaaagccattttaactggggagaagtatctcatatagttttgacttgcatttctctgatggttagagatgttgaatattttttcatgtaactgttggctatttgtatgtcttcttttgagagatatctgttcagatattttgtccatttttaattggattaatttgcttttttttctgttgtgatgttgaatcttgtctttttcttgtacttttctaaaacgcttggtaatgtaagaacagaatatcaacaatgtagaattttactagtatgttcatacaaatgcacttcagaaacaaaaaaagagccaaaagcattactacaaaataaaagaaaatcattgtcaatattcagttatgattttgcaaaatctgtatccatagcaaaaactgttctttggttaatttgaactattccctctgatatattcaattttctgtattaaactaaacaagaaatatgatcctaaactaacagggaatgagtataggaaggaagaaataaaataatatcccactgtaatcagagtagaagaatgtattagttacatggaaaggcatttgtgcagtattcttctcaggttcctttacatttatccaatgattgaaaagacagcatctactgtagtaaaatgacgcctccaatttcacagaaatacaagggaacaggaaaaagttttaagttgcagtaagattattttagcttaaagtacaaagaaattgttgaaaaaataatactctacacagaaagtttttggaaggaaacacattataactggtctgttgtacatatatttcttgctagcaaaacaaggtctcttttctaacccactatataatttgctctgatgtaagttgaaccttatgtagttcatcaatgttagaaacataaactagggcactgagattgtataaaactaagatgtacttctttgctaacacagacattattccataatcatttacaacaatgtatcatttatctttaattctagattttccttttgaaattttgaaatatatgactctagctgccttctgcatgaatatagaattttttaagagtcagtgtactttttaaagaataaattgactccttttcacacataagtcaaaaatggcagaaaatattttgctttgatttaaaaaaaatgacaccagctgaaacccaaaaatgtcaagtagatactcattccatttttaatggggtttcctttcaaaaaataatttcaatattgtttaggtattcttaacgcccccaagacacaaggaagagtagaagaaagacgagtgccatgaagtgagaagaatccaaaattaatgatatataataaaaatcaaaaaagcaaagaatagtcccattttattaatcagtttgattcctgaatatctactgtgtcgtcacaactggtctagctatatattatctaggaatgtataaagaaaccaagtaaatacacatgcagcagaaaacaattgtttactacacagtttagtagtggctttgtaagcaataggagtttcaagtatcaagaaatctatgtttatagggaatgttcagcaattattttcaggatggagaggacaaaaggaaatagacaatgaaagcaccaggaagtggaaggagactggaactcaaattcattgaaaatgtccaacaaaacaagcactgtcctttgtgtttttgttgtatgacagaatttccctcgattatggttattcatgtgggagggagtcatgatatattcaaaagaagacaaacaatgtcacccccttgaagtggctctttacaagacacagtgaacttaggtatcaaagagaaaataagagaatatttaaactaattacttgtaaaatgagtgaaggaggaagagctgaataaaacaatatgtagacagtaataaaattcatattgaaggtgtcttctggaaaagataatgcattcaggatcaatgagtatattttccaattccacaactcagaaaccagttgtgatgattcaaaagaaatgagaataacactaaaaacaaagaagggtgccaaacgccaacacaggaatacctgcaagatataatgcagactgaaaaaaaatatggattaatacacaactcctgttttacaagaaatcaaaatagttctgcaagaagtacaaagaaaatttcagcaactggttttaatttgaaacagtaaaggctagaggaatcgtgttgtcacgggaaagacaaaagatatgtcactttaagttttactcctcacaacactctaaggccatgaagtagtacctatgatgaaagcatttggctacaaccccagagagatgcaggatgtagcattcccacactgagcaagctaaaatccagacaaaaggattatatacagccaaactttcttggattaaaagcaggctggagagaaaacaaaataaggaaaatcagcctgaattcagtagtttcaaaagataataagaattaactttacaggaaataattcaccataaatgcagatatcagtatacttcctcagcctagttaataattaaagtcataacatttaactgtaaatcttgcctttcaattgcattttgaagggctaattatgagacctttatagacaaagaggagaaccaaggagaattcacgtttagtgtttttgagcagatggaatacctggttagagctgccccaatacaaagtcagtcttataaaaactcatgaagaaactctgcaacataaacatgaaactaaacataatatgcaaagtacaggtacaaaagtatgcttttgaagatgtactaaaggcagcaaaagaaaatcattttaaaaactgctttcctctctcaagaaaattaaataaaatagattcaaacgtgataagcaaatatgcttacatgaaaaggaagattatggggttaagctaaaatattttgtttaaatctctgaagagcttaaaatggcattagaggacatataagcttagaagctattgaaaaataaaagtagaatcaaaagtgtcaaaaaatcaaatcactgctttggataagaggctttaaaaatcactcagaatatgatgtaaagaaaagtaagagacattgagaatagacagcagaaatccacatttaggaataggatttcctggcaaatcctatttgaaaacagaacagatggaataaaaataatatccaaagtatattaaaagagtatttccctagtcaaatataaactgcattcacctcaaaataaaaatcaaacattaacttgaggcaagcaaaaattgaaacacagcatgctaaaagttatagggtacggcaaaagcagttcaaagaggggattttatattggcaaatacctacatcagagaaaaaataaatatctcaaataaacaacccaactttacacctcaaggaactggaaaaagaacaaactgaccccaaagttattataaggaaggagataataaagatcagagcagaaataagttaaatagagtcaagaaaaacaatggaaaagatcaactgaaataagagttgattttttgaaaagataaacaaaattgacaagactttacctagactaagaaaaaaagagaagattcaaataaataaaatctaggtgaagttatttaatgagaattgtcatctcaattgaatctgggtttattcaatttttgaggacaaagaaagaacgcttcaagcatccaaagagaagagacatttcacccacaaagaaaaaaggatttgatcacatcattttttctacttgactttattaaatgctagataatctctaccaatgtttgcaaatattaaaaggaaatggttctgactcatgaaatctgtagtctactaaatcacgattctggaaaattagcaagggatagaaattttttattgaaaaaatgatgtaggaactacatcatttatgtgacatttcaaggggaaagaaactgtttgaagatatacaccagtgaacgaacacataaatcaaaatctacagcccacaaatgattaatttgttagtgagcattaaatatatattcatttatttttaaaacacacacacacgcacacacacatatatatattatgtatacagagagagagagggagagagacagagagacagagaaagagagagagcatgcacgaaagagagaggcaagtatagtaatggtggaaaatccagttacaaaatataaattaataagagagattaaagaaattgaaagttttccaagtctccatcttatagagaagaagtcagttatcatagttgatatttttaataatacagaatcctgaaagttttttaaagtgttagaataaatctctagcaatttgaaggccttccaaattaaaaaagaaaaaaaaaaatcagagaaactcaggccataaaagaaaacaaaacaaagagataagaagtattaaacaaagttgcaatatcagtaagaggcaaattcagatttatcatacaaacttcaaaggaagaaagaatgatacttctatggataaaaggacaatgttcaaaggctattaaattgtcatcacttttctgcatcaaataaagcaaaaaaaaacaaagcaaaaaggattggaaatgaaagttgacattaatggaaatgagataatgcagtaaaagcttgtttaactgactttctagattaattgacatcgtctagtcctctgtcaaatataaaacatatccatagccgtttaaacactaaccactgacaggttccttctactgtatgtgcatactcttctgttcacatcagttgagttgtatgcttaccaagagtcagttatgtttttccagaacatgcttacatttgttacacttgatatctatattaggcatgatatcgtatataaaatattatgtattcaatgaaataaatgtgtaaaatgtttgtacttaattgaaactaaatgaaacactttgtgaggctttaatgtggttcccttaaaatgttctgtcaagttaggtgtaagctaaaaaacataaattattgagagatgaactatcaactgcaaaaacctagacatattattgtacactcagatcactttcaaaaatgtttctaaattctcactccacttaaaaatccacaatcaaaaataacagaccttacataatgggtatgatttaagccagaaaaataatagaactccagtttagggcccatattcctagaaaggccgtgtatcacagaattaccaaacaaatatgtaatctgtatgttttcagccaaaataaaaggttttcaataagtacagatattcttctttatctactaccttagcagacattttttgattaattgatttactccagtcctgatcattttagatggagtgcttctattgttgtgaaaattttaacactcctctctcagtatttgacattaaatagtttaaataaagtgaggttatggaggtgactaataataataaataatatagtatctaaatttggttttatagatttatgcctagacctattccctgcaaaaaaaaaaatactcctttttaaacttcccttgaccatttataaaaactgaccacatattagaccatttgctataaaacgtacatttttacagtagtgatattagagtttacattacttggctatggtgaaaatatcctgaagccagagaatatcttctgtgtttcaggacacaagggattcagtataactaaagcagaatggccttataggccagttataaggactttaactcaaactttgaagacttaaagtaaaattatctatattttatggttttctttttaaaattttcatagagtaaaatgtattttgtatggattttactaaatgcacagaatcatgtatctaccacctcagtatcatataaaatagttttaacagtctgacaacttcaacaaaaataggatgaaagaatcaaggacatgaatagaggaaccagttaggaggcaatggcgaaaatcagaaataacgtatggcttgaaccaaaatggtggcagcagaggtggtttaaagtttttagattcaataggtaatttttaagggtaaagcctgcttgatatcctgccagaatggatgttaattaaaagcgaaagaggattcaaggatgaatctaagttcattttaaaaagcaaataaaaggacgattttgagatggggatgatagaagggtgagttcaagttgaaatattaattttgaattgtctataagatgtctaaataatgaaagaatcagtatttgaatatatgactatgaagcaaagaaaaaggtcttgacccaatatataaatttgagagttgtcagtatatagatggcatttaaagtcatgaaataggataatatcaacaacgaactatgtgtagacaggaaggaggtccaatgccttagcttaggatgttagagaggttggagagattaagaagaaccagcaaaggagactcaaaagaagcagtcattgtaaacaaagtgagtaataatttgtgagccaaagcaagaaaatgttccaaggataaaggaataatcaactgtttcaaattctgtagataggtcagttaagaaaaggactaagaaatgccattggatttcgcaacttggaggccattggtgacccccaaggacacccttaaaaaagttctgtgtatacagtctgattgaagtaggctcaatccaaaagagaaaagaagaattggagccaatgcaaacagccaaatcttttgaaaagctttattataaaagaaaagagagaaataatggtggtgatagtaggaagaaaaagtagaagcagttgggtttgttttgataagataataaaaaatcactacatgctcattcacaagtttaatggaaaggaagaattgataatacaagaaagagaaagaactgctagagtgaatttcttaagaggatgagagagaatgagagagaatgtgtatgagtatgggggttttctttgctgggaatttagacagttcatttataaaaaaggagtctgggcataacacatgagcatggatacaggtaggtagagagaaaagaatggatagactcaggcaaatcctctgattgttttcattttatcatcaacagcagagagtgagaatgagggaggagatgacagaagttttatacgaaacaaaagaatctgaaaggttatgtgaaaaatgaatatatgagggaaatataatataatcgttagtcatcattagggcacacttgagtttagatgtcataaatttaaagtgagataatgacagtgagggtattgataagattttctccagccatgttcaactttgcaggcacagtcacaaggtaggcagacagatggatttaactgagattgtgatttctccaggaagtataatgaaataagagagacacaatgaagttgtggatttatggcaaaggaatgattaggatgatgaaacatggaattatcactgaataagaaagggtgtaaagacatgtgctgagttagggacaaggagaaggtggtagacccattaatttcaggtctctatgatgggtaaaaggattattggaattagagtactggggagagtcgactaaaataacagaaggtgatagagaatgagaggctttgaaatcaaaattatagaatggatattgttaacaataatggcaaaatctaggctataaacaggagtgagttgtagaaataggactaatagcagcggagagtataaggtcaagaggatgagagaccaaaatatcagatagatgatttcatagatcttgactgcaccaggaattatgacaggcagtgctggtgttggaggaagaaacaacaatacaagagtttaatttttcaggaaatgaagagaaatgaaatacagactgtacacaactacaaaaagaaggaatagtgggtggtagagtatactaacaggagattcaaaattggaaattctcttaggggagaaagaaaattatagtcatcagtgaggagctaagaaaactcctaccccacctccattctcggtagctcagaagggctttttctgagcttggccttggcagtcgctgaggaaaccagtcactctaaggaagcagtttcagaaaaaagcaaagccattgcagaattaagcagagaaagggcctgagctagctcttcagcttggctatcatggcatggaaggaatccagaaactctcacatgccctcaggagggtcatgcaaggtaattgatgggatgattagcagggggccaacacctgtaactgtgggcagccgaccatgcaggctggagatcaaaaggaaatcacagccagacttcagggacagctgctgaattttgaagagctgaaatagggtcaagacagcagaaagcatcacagtttccatccaagccaagagaggagagtatcacatattcttcagtctcaaatttcagcagaggtggccaacaaagcaaaagctgcgacagactagtaagggacatcattgctgcagaattcagtaccaatacagagagcagtacaaggacacacagaaagcagagaccccttctctgaaatgaagagagacaatgaacacccttgcatactcactctaccttgggaagaaatatgagaaggaggtagtatttgaaaatctgaacatattcccaaagggaactgttttaacacagtcagtagcttgtgatgaaggttagatcatttatcacaaatgaacaagctgtttcttcacagatctgaatgcaaagacccttgtaacacatgcattgagtaaataaaaataaaagtaaaataaagaactatctcatagatagttatagattcttttatagatagacaggctatcttcaactaagctctaaaatcagcctcaaatgttgaatcaaaaactgaattatgatattgtggtctgtttggaagaagatttaggtcaggagtatgaaacagatgaaaccacactgcagtaatgaaggtcaaacatgaaatgattacagtgtatctaagaagaattaggagatcaaatgctggaacattacaatgctgcaattctaggtcactacttctgggaattggattctatcttagccaagtgtccaggttctcacaggtccagtggcgaaaaatgtgctggggacagggatggagatagaacaagtacatcatcttctatgctcctgcatccaacaaccccagttcccctgacatagtagtgcttactctacaggttgacagaacaaataggtaatcctttttaatctattggtcggcttcagattataagcttttaaggtagcaaagaaagctatatttacatgtgaaaagaacagttcataaagcctggatttaaaaataaaaagcaaaacaaacaaacaaaaaaaatcacctcaaatcttgtgagatgtctgtagaataaaatcacaaattgataagaacaatctcaattaaacctggctgatattagcaaatattcttatccagtttcccaattcttgttaagacacttaataatcctaacaataactaatgtctatgagtgcttaacattttccaggcactaggctgtaatacttacacatacatattatctccttttattcttacaacaaccctatgagggagctgttggttttatccctattttacagagaaactaatgtttagagaggttaagtaatttgtagaaggacaaataccaaataagtagtgaaacagcaatttaagcccaataatgttcatttcagggcccatatgttttacaagtgaagagtacctcccatatgattagcatttatagaagacttataaagtcttactattaaagacttaaagtttatagttgttttgctcatctcactttgtgtcccttaaaacatccctgtgaaacagggactggtattatcctcatttttcaggagagaaaattaaggttaagagaggtactgagcccaaggttatctccagctatagagaaatgaagcaggaagtgtggagagagaagttaaaacagggaacactcactcaggtttaatgtggatttttttgtataattttacagaacacaaaataacatgtgaatccagtaacaaaaatacaccttccaaatctggccaaattattgtctaatctaatgactagggcactgatcctttctcttcctaattagcaagtaaatatctggagagatgctgtacttgcctaacttattggggtggtgttactaatcttctacaaatgcctcttcttccccagatgccattgccaaacttgactagtcacattgttgaaagaatatacccaaatgcccagaaaaaagcgtctacttcttcagttaccaagtgactcagaggcagtttaaaagaaagggaaacaagaagtatcttaggtagggaccacatattcattgctcatgagtgccccagctatagctgccaccccagtagcctgttttgttcagcatttgtccaggaaaaaagcctcatgatttgtaggatatatgatataatcatcctaaccatagctgagattgtcttatctatgattaggtccccttgtttagaaaacttgtcagccacatccttatcagcttgtgacccagacagccttgctgcagaggttcaggccaggatgtgacagaaggcacgggaggcgaaaggctgtacagaagcagcagcattgaaggaccaagttctcattactgaggcacttctgcacaacccacaacttccaaatctatttctccctatgttctagattttttgaatgggttcaaaagggaaaacagaactgcataggtgaacattcattttattggaaaaattttagaatccgctctgcctaaaatgtgaggaatgtgtgtatttaaattttaatactggaagattgatactgtcacaactaagaaacatacaatggctatggtaatacagtattaaaatgctctattttcctctttttaatactacttaagtaataataaacaatacatgtagaatgaatgttcaaccttttaaaactccttttattttcatcattttatctgttctctatagtatcttgtaggtaatagggatgataagatcttattttcctgatatattttcaaaattatatttttgccttattctcaataaaaggatacaaagctgtagttagacaggggaataaattttttgaggccatcatacaacatggtaactacagttaatagtaatgtattgtatatttcaaaatttctatgagtaaattttaaatgttttcaccacaaaaaaagataaatatttgaggtgatatgtatgttaatgagctttacttgattattccatatttttaaatatatcacaacatcactttgtactccaaaaatatatacaattatatatttttataattgtcaatttacaccaaaataagaaaacatatttcagaaatcagaaatatgccctttaaaaaaattatgacatgtttgagtaagatgataatactgatgtcatgttttttggattttcccaatcctccttaaaaagctaacagaaatgagaagcaactgctaatcagtggagggtttctttttgcaatcatgtgattgtgcaaggttgcacaatctgtgtatatactaaaaagcattgaattgtgaccattaaatggaagaattgtataatatatgaattgtgttcaataaagttgttacttttggcaggaattaaacaacagacatatttctcacagttatggcggctgagaagtccaagatcaagatgccagtaggtttggttcctgctgggggctctcttcttgatttgcaaatggccaccttctcactgtgttctcatgtggtaaagaaagagagtaagcttggccaggtgctgtggctcaaacctgtaatcccagcacttggggaggccaaggtgggtggatcaggaggtcaggaaattgagatcatcctagccaacatggtgaaaccctgtctctactaaaaatacaaaaattagctgggcttggtggcacatgcctgtaatcccagctactcgggaggctgaggcaggagaatggcttgaaccagggagtcggaggttgcagtgagctaagattacgccactgcactccagcctgctgacagtgaggctccgtcaaagagagaaagagagaaagagggaaagagggaaagagagaaaagaaggaaggaaggaaggaaggaaggaaggaaggaaggaaggaaggaaggaaggaaggaaggatggttaaaaaagctcttatttttaaaaagctaacagagtaactaggatatcatgatgggttaaaggaggccacagacattcctgtcattaagagggaaagtctgttttccttgcccttgtgtctgggctgtcttatggctgctttgaataatggagtatgtgaaagtgatgctatgccagttccaggcctagtctctcttaagagagctggctgactccatcttggtctcttggagacttcactgctatgttagaatgttatcttgaagtcactccagtctaaggaaacttaagttagccatgtggagagagaaagagaaaaaaaggatggttggccagtccccaggtgttacaactctcaactattcaagccatttcacccaggttgaggttgcaacattgtaaaacagagacaagacaccggtgccatgccatgcctgcatctatgacccaaaaacattctgagatataataattgtccttctaaggcaataagctcttggtatgtttgttatgcagcaacaaacagaatagattgcaaaacaaggtgatgaagtatcctgtacatcccaggaaaagagcaagagagtttgaaacactgagcacagcaagattctaggaagaatagcagctgtgcaggaataaataaagaggatacaaacggaattctgacaagttcttaagggcaagaaacccaggcatttccaaaaagcattcattcccaaaggaggaggtttccactcagggtggagtgtttaaatgaccaaacttagcacagtcataacttcagggagacttcacaggttcctgcttatagattagtacaaggggattgcagaaagttctgagggtgttgggacagactgggccctctgggatctcaagaataaccaaagccctacaatgaagagaaattgctcaaagcagaacaccacttgttcaggataaaaagctcccgggtgtcagagggacagaagatttagattccagtgaaaaaggagagtagaagaggtggatctcagaaaatattagagattcatctatgctgataaatttctttcttttgtttttaagcatgtcacagtgaaacctaagaggaaacctggaattatgaagctggaaaagcaatcttgactttcatttctgctaagcaaacacttgcttctaaaatacaggaaactgcttttcacttaaaatgaacaattaaaaggattgcagcaaaattcaactaaaaaaattgcaagttatcaaggagaaaaaaaaacctaaatcatacactaatagaaaataattcacataagaaaaatatggctacaaaacagagttggaatccaatataaccaaaaaacactacaaaattatagaagctattaaataaaagacaaatccaaattttaaaacattgtaaatgttgatggacttagggatcattaagcaacagatgtagatgaaagtaaatgaggattaaactagacaaaccaataaatagaaattaatatcacagaatgtaccactgtggaagcagagagaaaagaaaaatgaaaaaaagaaattaataattttttaagttagataaaatagtaaattaacaaaaggcaaaaacaatgcaacatagatacataaagaattcctaaaataagtggaataagtggaacaggaaaaatactggaaatatataattcaaggaaacatttcttaaataaaagaattaaattgcataattaaagcacatacaataggaaactaataaaaattttgtttttctttttcttgagatggggtcttactctgttgcccaggctagagtgcagtggagtgatgatggctcactgtagcctttatcttccaggctcaagtaatcctcccacttcagcttcccaagtagctgagaccacaggcatgcacagcataccagactaattttttattattatttgtagagacaaactctcactatgttgcccaggctggtctcaaaattctgggctcaagcaatcctcccacctcgccctcccaaagtgctgggattataggcatgagccaccatgcccagccaaatataaattttagaactgaaagatacaatagctcaattttttaaactcaataaattggctcaacagcagaatggaggggacagagaaaagaatcaatgaaccagaagataaaacaatagaaattacccaacctgaataacaaagaaaaaattcttttaaaaagtgacattcagggagctgtggagctataataaaacattcactcaagaaatcagagtctcagaagaataggagaaagaggatgaggataaaaaattactcaaggaaataatagctgaacactttctgaatgttgcaaaagacataaacctataattaaagtagccaagtgatgaaaaacagaagattttaaagaaatctgcatcagaagacagagtaaatcttctaaaaatgaaaggcaaattttaaaaatcttcaaagcggcaaaagagaaatgtattccttttctataggagaaaaatatttaaatgacagtggattttttatcagaaatcatggaagccagaacagagtagcacatttttcaaatacttaaagaaatgaatttccaacccagaatcctatacctaatgaaaatagctttcaggggtgaaaaagaaatcaaaacatcctcagatgaaaaattattactagaataatttatcaccagcatacctaccttacaagaattactaaagaaagttgaatttataattttaaaattcccccaaaaaggaatattcaggcccacatgatttccttctgtaattctaacaaatgtttaaaaaattaattctacacaatctcttccagaaaatggaggacgaaggtacgcttttcaattaactttatgaagttagtactaccaaaatgcaaaccagcaaaggattttaaacaatggattgacacactgatttatacagtaaaaaaatgataacttgggtgaaaataatttagcagatataataatttagcaatataaaaggcagataattcaattaagaaggaagtatactggtccaagaaacagactgtgaacgtcagagttatggctctattgatatatatggatagaagagaacagatcaaaagagactcaagagaaagaagccatggaatttggagaattgtcattaatgggaattgggaatacaggaggagaaatcgttttgtaatgaaaatagtaagttcacgtttgacactctgtggacactctaatggtcatgaacttacaaccctgagtctcaggagacagatacgtattctggagacttcgatatattagcagtatagccatagaggcagatggaattcactcaataatcctatgcagagggccgggtgtggtggttcacacctgcaatcccagcactttgggaggctgaggcaggaggactgctttaggccaggagctcgtaaccagcctgggcaacatagggagaccccatctctacaaaaaaaagaaaattagccaggcatggtggctcactctgtagtcctagttactctgaaggctgaggtaggaggatcactagagctgaagagttcaagactgcagtaagctgattgtgccattatactgcagcctgggcaacagagcaagcccctgtttctaaatttaaaaaaaaaaattaaaataatttttaaattaaaaacaacaagaatcctatgcagagtaaaaacaaatttgtcttttaaaaatcagtgtttttagaaccttatttattcaagtaccactttcagaacttttgacatctagcacaccatatcacccacactattgtatatttaataattttcttggactctcatatcttctacttaaatttattttaaaacaaaaccttttatcagcactgtaaaataaaatcaatgttacctctcataataaatgggaaatgaccataaaaataaatgtggttctaattgtttatattttaatccaatattattacctgtgatactccagtgcctgcttcagctcctggcagctgttctctttgttaaaataaagggttttttaagaaagacttaccacaacctaatataataagacaaactttccacaatctaaaataataaaaattaaaaataatttaaaaggagaacaattgaatttttactatatgattggatatgatttaacccactgtgatattggatactggatattatttcatgccctgtgagccacctaaaattatttcctgtgctacctttggaatgtgatctccaattggggaaaatattgctttgaaggatagacagaggaagagggtcagagatgtactcagagtgtcagaaagggtcagagttccaaggtggactagagtaaaggaggagaaatgaatcagtagacatagaatcaacagggtcaagttatatagaatagtgtcaaatagcatagaaagattagctctggggatttatagaggcacattcaggatggctctcaagagtccagataatgattaaacaaacaagtaaacacctacttgctcctgagctatagcttaaggaactgagtgaagctaaaagatcttacacttgctccccatcaggtgaccaatttgaacctacacctaacattagctctcctccagcatctcttcctctcctctctgtcccctctcccaagcccaccatcctcttgctgtacctgatgcgttagtaaagaagtatgccaagagcatgtagtgtaggacccctcacctgtgaggaccatttgcaactgaccacattctcccactcagcagtgtctcccgcaataaaagctttgtgcccagactaatcacctttcagaagaagtcaaaagcgaggcagtcagcataagatgtaggagtgaaatgaaaaatcatataggagataataaaaatatacaggagctttaacttgctacaactccacactgctctacttactttcaaataaatgtgagccttaaatcattatgcagactctgtgatgagtatgcactgcataaaaaatgttagcttcctttactcttccaaaatgtgattgatcatcttccactccatccgctctgcacacttgactcgttttaatatgtggtcaaaaataatttttatttgcaaagtgtggtcaacaagtaacactttggggaaaaaaatgtttgtttagcaaatctgaaggtcttcatttgcatttttctcttttgttcactgatctctgacaaaatgatatttttcaacctttcctttttgccaaacccatgaaaccttacgtgtcacctacattaaatatacacaatttccttttaaatgtattcacacaactagtttagaaacagacttgtgtataatctgagaagttataacttcttatactcaatagttttcattctaaatagttttagtatttttaagcctcattcccactgaaaaacatcctcaagttaatgacataaaatagatgataaacagatgtgaatagagcaactcaaattctgtaaaatattatatctcccaaatgtccaaatttcaatttaaaacttaaatacaaatttagacaactattttcataaagacttgaacactgtgcataatcaacagagaaaaataatttttgtttcaccaaactacaataaaggaccagagtagtgtgaacatttgcattgaaatgaaaatgcaatgttcattccaatatagagcagaacctctaaaatgttgtacagcttatatattctatggtatttttgtaatctaaactaagacaaacaagcacaaacttagtataattataagtagtcaaagaagagttaaaagaaactcagaaccaccattctcctgaatagctccaagagagaaagcgggcaagagggagaggcaaaaagaaggaaggaagggaagaagggaggctgaggagaaagagggagagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggccaacagggagggaaggagggaggaagaggtggggccaacagggagggaaggagggaggaagaggtggggccaacagggagggaaggagggaggaagaggtggggacaacagggagggaaggagggaggaagaggtggggccaacagggagggaaggagggaggaagaggtggggacaacagggagggaaggagggaggaagaggtggggacaacagggagggaaggagacttcaatctgtgactttgtcatttggctgtgtgtgtgtgttccttcctcaccactgcctcttgactacaagtgatttcttaattatcctataaaacaagggtcagcaaactatggcccacaggccaaattcagcctgctgtctgttttggtataataacattttactgaaatataaccccactcatatgtttacacaatagagttaagtaactgcaacaaaaagacacatagcctgcaaagcctaaaatatctggccgtttgcaaaagaactttaacaacctctgctctaaaacattacccaaatggcatttcatcccctgtgaaattttcctgactctcattaatattatagtcctgcatttcctgatagaagatggcaaatgttatttgcattgcacgattacagtccattataggttttggggtgaagggattatatgtatcttctccctacactgtgagctgctcaggagcagaggctctgccattttaacgtcacctacctctggcccaatacctgccataaatagaaagctcaattcatgtttctgcatgaatagcataaccttttacatgatggaaaaacatcatagtacctccagaattaaaagaaacatattaccatgttatgattagtcattctcggggtgtgactgagaaataggctcagaattagtagatgacatgatgttcgtggctgttttgttttttgtttttgtttccaaagtggcttatttgatttggattccagaagcaaattctgagaaggagatgtgtgtgtgtgggaaatgtaccgggtactgttctagggaaataccatctgtgatggagtaaaggtggtaggaatgggcagaagttgaattgcaatgcagttgccaccaaggcctcagccaatcccatacagaacgttggaactaggatagtcctgcagagttttccaggattgaggcaaaaaactaggcctctgcaccactgcttagcataatcaatggttatgggaacatctggaagagatagcatagaagagtggtctgcatagaagcagttcccttctgccaaggaagctgaaagcaagtccttctggaggaagatccagctgtgagccatcagcaggcaaaaacttagtgaatgtgtgtgtgcccatgttggctgtgaagaaaaatctgggagggggtctatagcagccaacatgagcaggcggagacactccctcagaagctcatacctcagaagttatgagaataatatagaaccctgagcccccagccgtgatctttctaaaataggctaaatattcacaaaagcaccaacagggttcaagcccaagtaatcagttctccagcctctgtggctgtcaatctgccatgatctgtcccttcagtcttaataaaattactgcagacaggggaaattgccctcctatggaactatgggaaatcacaatcggtaatagtcttttaggccaaactgtgagatttcttataacttgcacagcctaaagttgatcggtccacttagaattaggaagcctagcaggaatgattaaaaagcatccattcagaaaacattcccagactcatcaccatctggtcagatctgattattacacagtcaaggaaactcccaccggagacaccacagggagaattcttctgaggctgccacttagcatttgttaacggcagcagggaataagtgtgatgtacgacaggcactgtatgccaggtacctgcacatcatgctgcactccactgactcgtctttcagcaagtccagagataaggagatgcatggtgatattttaaagtgctttaatgattttttaaaaagagtggaagatacatacttttgaaaacaagaaagaaaacaaaacaaaaaaaaaatatgctgaatgcagagcagcatgcccgtctcattccatactggtcagcagcctccgcgctccaactaggaacacgaatgccatttttcaaacaccccagatgcttccctgcatgcaagactttctaaccaatttttcaaactaagtacaaccctgaaatgtgactgctttctcaatctgctttgaaagagtttcagcagttttgatttctgccagtaggtttaggatccccacagaacacagctacaaataaaagctaaagataaatagaaaggagaaagtaggttttgccagggtgctaactcttctgaacttcacataggagaggagacctgctgtgatgagactgttggttagaaaaaaagacatatcaacaagattcaccaaaaaatcccaactgcaactcagaaaagcttccaaaagttgacattctatactaataacaagtgaaaaacatcaattacatttacattattgaagctgagcataaagagaactggataaatcaaagagattcctcgggtttttccaaccttcagagattctacccaggacatttagtaaactacaagcaagaggacatgtcaaataggctaatctgacaattcttaggcattcatttgcagtcatgaatggtacacagataatcttcctattgaaagtttttcaataaaattcaagggccagaagttgggaaagaattggtcatttgttgttgtagctgtcttccataacttggctagtgattgaaaaacttctcaaatgtaactgcagcaacttcgctggagtacagcctggagtacagctgtgatcagcaaagctgactaggctcatggcatttgaatcaaatcctcttgatgtgtaatttgtctaaaatattttcttcattatgttgtgttaagaactcttactctgcagaccaagtctaccttgcatgtgacaaacatgatttaaaccagtggttctcaaacaggagtgaatttgtccccatgggacatttggcaatgtctggagacattgctggctgactcaactagagtgtggggagtgttaataacatctaatgcagggttgaccaatcttttggcttccctgggccacactgaaacaagaattgtcttgggccacacataaaatacactaacattaacaatagctgatgagctaaaaaaataaaaaaataaaaaaaactcataatattttaagaaagtttacaaatttgtgttgagccacattcaaagccttcctgagccacatgcagcctgtgggccacaggttggacaagcttgagctagtgggtagaggtcaggaatgctattaatcattctacaatgcatagagcagcctctttccccccaaaaaattcaatagtgtcaagggtgagaaattctgacttagatcttgctcaggttgagactatagaagccctgtggaagaaaatgctgcaaagcagttcagttgtgcgcaatatgcacatgaagtatatgcagtatgcacaagaagggcaacagagctttgcttcaatggaaatctactgagcagatctattttaggatcttgtactgtccatcacagtttgcatcaatctaatcagtctataaagcagaagaataaaaaaattaagtgcctacattctgctttctctgattcctgcccaggattttgactcttcaaagacaggagcaattttacaacctcatcctcagtttagtgactagttaatgctgactgctttgccttgttacacaagaggtttacaaacagaaaagcacagatgacttttaaccattaaaaattgtgcctatatgtttagtgaagaggacactagctattttccaatccaagatttacatgattaataacacatgccattcctcaacccttccttatttggggaactccttcattatgaattcaaacctttttaacctgaacccaggcctctatttaactgttattggatagttctccataaattcataatgaccagattttaactcatctgtttgctaaaaaactgatatctttccaatgtattttcctcttccactattgtctgttgaccagatcaagcatttataccttctttctctaatcactcctatttagttaggctctatagattttttactttgagttatctcttctactctcccttccactttatttataatatcatactccacttctaggtctcccagagccttttttcaggtgttcctgctgactcgaggctttccttttccttcctacaccatcccaactacatcttttatataatagtcatcttcatcaaacctcacccattttaatccatttgtgttatatttatttaagacttaaggagatacagcaaggtagttggttgaataggttctcacagaaattcatatccacccagaacctcagaatgtgacttattttaaaatagagtcttttcagatgtaatttggttgtactagattagggctggccctaaatccaatgactgttatccttataagaatgtgcgtggacacccagagaaaaagggcagcctaaagatggggggcagatattagagttatgtgtctacaagccaaagaatgctaagaattgccagcaaacaccagaagctaggtgagtagcatggcatggttcttagagtctccaagaggagtaaaccttgccaatgtcaatgccttaattttggacttctggccttctaaattgtgagagggtaaatttccattgttttcaacattgagtttgtgttaattagttctggtagtcctaggaaactattacagcggtcataacaaaatgcttcagtcttccaactacaggtagcataattgtccaaagaccccaggtgctgctctaatacccacttggcgtttgctccaaggccacgtttcccataggctgctccctgccagtgactaagagcagcatacacacaaagcagaacaattcctgggaggcacagactactttgttggccagtttgactccaagactctttcaaagccttgttacactattcttagactgaatactgtctgaaatgctctcatcctgccttcttttcctctcttcttttggaataagtctgcctcctggtctgatgatcctctaaccttccccaactcccctcctaatttttcccgtaagtgtatccctaataaaatgcatacatattaaattgtaccttgctatctacctcctggaaaacctgaactgacccagaagagaatgacagactctggtttctatttgaaaaatagaaaatagattgctctgcctggtttgtggaaagtaaattagaatttggcaagattgaaagggaaagaccaaatagaaatataatgcagtagctaaaggagagaggcttgtggcttgcagtatactagtgatagcagtagatgcagtggtcagattccagatatacttcggcagtaagacttataaaacctggtgatgcatttatgtgagggtgtaggaaaaatcagtatcaagttgattccttaatttctagcaagagcaaatgcaaggatgttggtgacattcactgagatgtagaatgctggaagagtaaatccaaaactaaaaaattaaaattttagtttatatatgttaagatcaaaattatttgcagatatctaaacagagacgtcaaagagagaattgattcttaagaagctcaaaagagtggaccagacttctacatgaagttggcagatataagaatccagtgtttaaagcagagggagtaattcaaatcttttaggaaataatgtagagttagcaacaaaagggcagtcatgaggccttccaaaatgtaaaggtcaagaccagaaaaggaagtggacaatggagactgagacagaatgaaaagaggggtaggaggaaagtgtgaacatggtatccacaaagggaagggaagagtgcattttgaggatgagtggagggttcactggtcaaatgctgttgcaaatacaagaaagatcatttaaaattgtccattggcttcggagacagttaatcttcatgttggtggaatggtgatgatggacgcaagatgggaggggtctgagaagagaataggacttcagatcaagttgcctctgtcagtatgtaaaccgttatgccccaaacacacatcactgatagaaaagcttgcattcataacaaaaaaaatatagccaaggggatttccactttggtatttttgaatgtaaactttaagcactttcccaccaccacttatcaatgttttcttttcatatttataaccataataaaaaagataaacttttgtgtagccagaaggccaacagaaacaaacagcaataatagaagctaaaacaatgtgtttctggataaggagtcacaagagacaaaggcagagcagagatatcgactctctgtgttgtgtcatgtgccgcattttgagctctctgcattgaaggatatctgctacttgaaggcaggacaactgtttatttggaatttacctctttactgtttggtcaatagtctctattccaatatactcacaaagtattgttttaagcataaaatcatattaagattaaatatacaaattcttagattatcatcatcatctgatctctctgaacttctttttcattttactacattctttagtccttcctggcaaaacccaactcctccattttccttccaataccactgttataacctctttgacgtcattagagacaacattattcaaaatatttgggctactggtgatcattgcccataatctcagtctctactgtcacatcagtaaaagcctgatgactcttatttaagagaaaataaggaggttctagacatcagaaagactacctgatgactcttatttaagagaaaataaggaggttctagacatcagaaagactatcagtctattgtagcctaaaggaatactattcaagtttaaagtcaatggaagccttaaaaggttgatatggtattcaaagtgcaatcactcaatataatcaagtgtcttactctttacagataaaagaccagaaacaaaaatgtaatataaagtttactaggatattacttggcatttattgcaggtaatataaagatattttaagaaaaaatgcatattttgcatctatgtgagatttacaagcacatatctccaagtcaaaattaacactgaagtccacatggccagagactagtacacaagtacacatgaaatgagtttggtagtgatctcccagataaaaccacagcaaagaagcatcaaagcagcagcattgtgaactctacttcaattctttaatgtaccatctaagtttggatagtttggaggtccatacaaaggcattggttaccctggcccacatcaagagtgctggatatttttgcttgcagtaatgaagtatttacacacatattacatgttgcagaaacactccagctacctgaagaaagggctagcatactaaagaggagaaaaataaaacagaacaaattttgatatgaataactatgccttaatagcaataccaagggccatgtagctttctggacaaggtttaagatggcagtggtggccctctacacccggcagaagaataaatcttaaggatattcaaaaggcacatgtcctgttttcagtatatgtaataggggaggtttctcccctggacctccaggtgcagttaggctgccaacaagtcagaataatgagtaggctcaccccacacatgccctgctctctgtaccccaggcaggcatttgtcagagtataaattatctacagtggtctccaaaggctctggaaagttagtgtatatccttgaaaaaaggagagaaaccctagaactaatattatagaaaataggggctaagtaaaggtatattctaagtagaaaatgttgctctggttagaaaacacacacacaaatgcattcttgccaacaccaagtgaaacatcagatgctagttattcaattctatattccttcctagtcactttaaaatctaaggacatgaatagcaatgtttaaatgtcagcattgaatcttgacaacagcttaaggcctcattattttaacgtatcttcactgagtgataacagacaccaaagaaatacataattagataattactttgtattggctcaatctttttaaggactccaaagaatattaaaaactttgaaagatcaaggatgcagcaaatttaactcttcaatgaaatgcaaatttaaaatagcactgcagtaatgctgacattctgccttacggaggagggtagggaaggaaggaaaccaatcatctatattaaccaacaaatcagtgaccagaacattttccacagaaagtaacaaaatatctgatcatttgaagcttaaatgataaagttactccatttcctcgtgtaacaaaaagcttgaagtagtaattcagaagtggttcaatagtgcaactatgccaaaccactggactgtgagactgatttgctcagccttcttatagcctcaaggtgcctgtggccttccccattgagagttgaggtgtgagtagatgaagtacctaagggagcactaagacagggaaagtaccttgcatgatcacatccaaagaaggaagagaaaaaagagcggaagagtattttcccttcatacaattctctcttatcaagaagaaaagtaccttccagcagatttcccattacttctcatcggttaaaactaaatcatatgttcatattgagactaatcaatgcctaaggaaatgggattgccacattggattagatatatcagcccggcctccgaggacttggtaattgaggtctgaataaaatcggagcattgctagcaaagaaaaagggagaacattagtagacaacaagcagtgtcagccacaactctacattttatactagaggtcaaaatatttggctctattggatgttttaagtaaagtagtttctctttctttccaaagtaatgcagagtttcaactttataaatataagaaccagttccctggatgacctccctgctggtataataaagcactaggagataggtgcttgcatgctttccaaggaatttagaccccagtcacgtgagactccatggattacaatcatcactgaacttcccccaaagcaaataagtaattagtgcagtctccagaacatagagttattgtggaaaaatacagctaaatacagcaaatgctctattactggcttccacttctgtgcagtcttccagctctaagtacaagtcattgcaataatctgatcaaatggtatcaaaggtgaggctaactgcagcaaagaatttctgtgctggccagttaaatattgattattccccaaaatggaatggccactttagatcatatcacagaactaataaacattatctccttgaactcaaaagggacccagaaataagctcagcttgagacttaaccaatttattctttgttactttgattctctcttatttcaacttggatgctttgctagaattagtattatgagaatacagtgttatttccagtaggtccttcagttgtaaatctgaaattccaagtatagttctgatctctctatattgagctaattcattcagtgtcactgatggagggtgaagcatcttatgtgcctgagataagagataaatgaaagaattcttcacagtctattgggaacacagagaggtaaacagttacaaggtggtatgcaagaagaaacaatctggaaaaaagggagcatgtcacacatgatgtggtaaaacagtgctatgtactcagggtgagctttggaggcagggaggaggttgttcagatctatccagggccacttactagctgtgtgacagagcatacattgctctctctctaaaacacagaaaaatgtgttattactaccagagaggttttaagcattaaatgagatgaaaactgcaagtgcatggcaccctgcccccacacagaagaaaagctagataaatgtttttccgttccccttcttgttcctatcccttcctcagggagagaccaggtcagattattctggagagcagaaagctccaggatggggcacagtggaccagggctcaactgccagagatgagtgctgtaagcactgaataagtctttgagtaaattcaaactgaggtcagaaggaagagttgggaaataagcattgcctattttcttttttcacaattagttttataaagttttatttattttttaacatgtttattgtggtatcatttatatgcaaagaacagcacacatttaatatgtacaatttgatgagtttggacatatgtgaacactcatgaaaccatcaccataatcaaggtaatagacatatccatcaccttctaagtttccttgtatccgtttgcttttttgggtttttttttttttttttttttttttttggtttgggagagggggttgtttgtttttgctaaaaacacttaacatgagatctaccctcttaacaaattttgaagtgtacaataccgtattgttaactatgggcactatactgtgcagcagacctctagaacttatctagcataactgaaactttatacctatttaacaactccccatttacctcagcccctggcaacctaggggctagagtagtctttgcttctgtgagtttgactgacctcatacaagtggaattgtgcagtatttgtccttttgtgactagctcatttcacttagcataatgtctttaatgtccagctatgttgtcccaaatggcaggatttccttcttttttaaggtggagtaatattctattgtgtatataaaccacattttctttatacagatattttaagagctagtgtgaggaaccaaaggcccctgtgtttgctgattggtttcactcaaaagtaaaattttttgtatgccttcatcacaggaggtagttttagaacttgaagcaagcaacccaccaaagttaagctcctaccctccacagagaatagcagattgggatgctatcttctttgatgactacatttctaagggatggctcctaggtcctaaagacagtcctgtgttgtaaaaggagctaggagcttttaaaaatatgtacatctcaaaggggcagagtaagaatttggaagtataagttttctaaaataaactccctaagaaaggaaggggaggtacttctgcagttaggccatcaggattctgtcagggctggggttgacaggggggtcagagccctaaaaggataaggaaatctgtctaaaatttattaaggtggaggaaaatgttacactcatttttgtcaataacaaagggccaaaatttttaactttgattaagtctaagttatcaataattatcctatatggcttgtgctttctgtgtcttgtccaaaaaacaaaaataaaaacaaaaacaaaaaacttagtttatcctaaggtcacaaaacttgtcttctatctttcctctggggatataacagttttaactctgatatttaaatcattgagcactttgtaattaattttgttatgtggtataaaataagggttaaaatttttttctttccgtatgcctattctaatgtaggcatactatttatagaaaataaaaggtattctttcctcattgaattacctggccacttttatcattgatcaattgaacacctatgtttgaggaaatttcagatatctctattaagttccattcccaataggaatctatcttgattaatgtagctttatatatagtaaattatgaattcaggcaacataagtcatccaatatttttctttttaaaaattgttttggctatactaggtctctagcatttcaatataaatcaaagcatctgctttttttttcctgccaaaaagcctactggaattttgattgagattgcattgaatctatagatcaatgtggggagatttgatatcttaacaacattgagtctaccaatctaagaacctggtatatctctccatttatttaggtcttctttaatttcagcaagctttggcagatttctgtgtagaggacttgtacatctgttattgaatttatccttaattgctattacaatttttttatttttcaattattcatagttagtatatagaaatgcagttaagttttggataatgattgtagtgatttgaatagtggcccctaaaatctgtgtgtatccagaatctcagaatgtgaacttatttggaaatagtctttgcagatatgaatacttaagaatatcaagatgaaattatcttggatttagggttggccctaaatacaataaccagtgtccttataagaagaagagaggacatacagaggcacacacacacacacacacacacacacacacacacacagacaagcacacacacaaagtccatatgaagatggaggcagagcctggaattacgcctggagccaccagaagctgaaagaagcaataaaagattatttcctgaagttatctgggaaggttgttctacattttatccagttttctagttggttatgtggataagtctcatacagtatcttggtgtacattttgcaactagtttattttgacttgtatgtcagctatcaatttattacttcttagcttgaaatccatatttctttatcttgcattgtcagaatgaagtggatcttactttttttatttttatagactttgtggctacaaatgtagtttgtttctttgtttgttttttttttctttgagacggagtcttgctctgtcgcccaggctggagtgcagtggcacgatagctcactgcaagctccgcctcccgggtacatgccattctcctgcctctgcctcctgagtagctgggactacaggcgcccgccaccatgcccgcctgattttttttgtatttttagtagagatggggtttcaccgtgttaaccaggatggtctcgatctcctgacctcgtgatccgcccagctcggccccccaaagtgctgggattacaggcgtgagccaccatgcccggcctacaaatgtagttttgttacatggatatattgcagtggggaagtctgaggttttagtgtaactatcacctgaattgtgtatatagtatccattaatttctcatccagcacccccctcctaccctcccatcctctcactcttccaagtctccaaagtctattattctactctctatgaccacgtgtacaaatttttagctcccacttataagtgagaacatgcaatattgactttctgtttctgagttattttacttgagaatggcctccagttccatctatgttgctgtaagaggcatgacttcattcttctttatggctgaatagtattccaaggtatatacataccacattttcttcatccaatcatccgctgatggacacttaggttgattccctatcttagctatcgtgaatactgctgcaataaacacacaaagcagacatcttttttttgagacagagtttcactctttttgcccggactggagtgcaatggcaggatctcggctcactgcaacctccacctcctgggttcaagcgattatcctgcctcagcctctcaagtagctgcgattacaagcatgcaccaccaaccccagctaattttgtatttttagtagagatggggttttgccatgttggtcaggctcatctcaaactcctaacctcaggtgatccgcccacctcggcctcccaaagtgctgggattacaggcatgagccagcgtgcccagccagacatctttttgatataatgatgaactttcctttgggtagaaactcagaagtagaattgctggattaaatggtagttctattttcaatcttttgagaaatctccattttgtttttcatagaggttgggtcaacaaaattaagacagaaatcaaaaattttttgaaattagtgaaagtggagacacaatatacccagacttcttggatacagcaaaagcagtgctaagaggtaagttcatagcatcaaatgcccacattaaaaaaaaaaatagaaagctcaaaaatcagcaacccaacatgatacctcaaggaactataaaaacaagaacaaaccaaacccaaagctgacagaagaaaagaaataacaaagattgcagcagaacaaaatgaaattgagactaaaaaaaaaaatacagaagatctatgaaacaaaaagttggttcgttgaaaagataaacaaaatcaatagactgttagctagagtaaccaagaaaaggaaagagagaatccaaataaatacaatcagaatggagaaaggagactttacaattgaagtggaccttgtaaacatttctccttagttaagtggaacacattaggctttgtcaatagagggaactggagaaactggaaagggggttctttctctcctcagtcctagtgtgatttttttccccttcccctgatgtggctgctggtggcgtggagaaggcccagcagtgctcacctttcaacgtttctctgacacctcggatggcagcttcctgcagaccagcttcatcccctgatgccatagagaacttctccaccacccagcaatcctcagccacactgtatcctatggggtctcaatattagccttatgatgggaggggacatctaaattctttctttcttccttggctatgctccgtcatccatggagatagtacttactcccatattctttagagtcaatgcttatcctttttggcagttacccacttttgcaagttaatgattttttcattaaatattgcccactcaatggagtgacaactttaaagtactaaaggaaaataaactgtcaacagaattgtgtatgcaatgttatcttacaaatcatacaatatcacttacaaaatgaaggggaaagacttttcaaataaacaaaaacagaatgtatttttagcagacctgaatataagaaagattgaagaaatttcttcagggaaaagtaataatactagaaagaaacttcaatctacacaaggaaataaaagcaccaaaaatggcaatgaatttcatataaaactcaagctttaaatgttcttaaaggtctattgattgccaaaagcaaaaatgacagcaatgtcttgggaaataatagcataggtaaaattataataggtgataagtcacatattatcagtagcatgaaaggtggtggtgaaattgggaatacaatgtggaaacgtcttcacatcacacataacggggtatagtattatttgaaggtagaatgtaattaattttaataccatatagcaattcccacaacaagctctatggtaagagaaacaaaacttattttcatgccaaaacctgtaaaaaaatacattatatggctttattcatgataaatagaagtaatctgaccgcatctcacctgcagaatggagaaacaagggggcacatcattaccatgggacactagtaaacaataaggaagaacaaattgcttatatatgaaataaaaaggatgaatatcaaattgaatatgctaagcgaaagcaaccagtctcaaaagattaaatactgtgtgatgctatttacatcacattctaaaaaaggtgaaattacaaggacagaaagcaattcagtggtggccagggctgggggtaagaagagagattgactacaaaggggtttgtggaaactttttgaggtgatggaggtattctatatactggttatggtggtgattacatgcctggatgcatttatttatcaaaaatcagagctgcacactaaaaacaataaatcttattgcatgtaaatttaccttaatttaaaagaaaatgaaaaaaatttccgttttcctgttcaaattactagtgtcatatctgtctcctgactgaactttgcatgtatatcagaaagtttactatattttattgagaatatttttgataatctgggtgttcaattatacatgtttaagtttaaattcctttggccattgtttatgacataaatttcaaggcttctactgaccaactgtttgttagaagagttcctaaggtaccccctggagtaaaaccctggctgctataatttcatctcagtccacaatgcaaaaaaaaaaaaaaaaaaggtgtattgccttctcttcaggaatgtgcccttggtaagcatctcatttttttacagtaagatatcaaccttgtcttcagtgtgactgactgtacaagcacacgtccatgtacataatcagcaaagtcaaagaacatcactccaacacctgttaggagcataacctcaaattcactgtagccaatatccatcaaaagcttgaatgtaaaacaatatttatggaggattgcctaaacacatgctatctatcctctcatctggtctttaaaatttatccctaagttaaactagaccatcctagggagtaacctacctacacaacaccactgtggcctctacaaattgatgtgactgacatgctattaaagacctatattaagggaggttgtaagaaagagcttaatgaagctcattgtttttgtcaaggacattgttcactgtggtacatagtgtttcttttctcagtataatatatagtcctgtctctcttggtcaatatttatgatacagaaaccaagactagccctattctcattttttttcactcactactagaaactttaaagagaagtcttgctcagcatcaatgatattgcacggaggatgtaggagtatgcatttttaagcctgaagaacatacatgaactaacctacctgtagtcactttacttttactcctttgttttcaccatgtctcagttttcttactcttgctaattcaattcatcatgctattttatataattgctacttcagaaatgataaaatataaatagattcaaaattaatacatgtccatagactagtgattggttttcttctaagttaaataaagcaaacatgctttctgtccactggccataataaagctcagtgctaagcatagagaaaagaatgaaatagacatctgctttaggctatacttttaccatcattctgtagaatttttgcctaaatctcaagtctcaaaaattaaaaacagagattccctttaagaaaactttctttttctggtagttcagattattggtacttattttgtcttacttgcagtggaagatccaccacagtttttaatacaagaaaactatttgatgatactgtcactaaaataatatccaagggagctattagactaacagcaaaatggaacttggaaaaaagatcacaccatttgttttacatggctactatatacaagaatatgcaaaagtgagctaataacattacaatattctttctcctgatggctgtaaaagtgtcatagtaattacttcttatagtgtgttgttacttaaagaaacttaaatgtagttttacggcatgatttttgctttctcaagacagagataacagtagagacaagactgaagtgagtgttcagaagttcatttcaagagacctgggttctaattctgtgtcttctatgtcaccctgagtaggttacagcttctctagacttcagttctatgacagcagatgagagtggccttgaacataaatgaggtcccttgagctaacaacatccatacattcaacaaaaaaattattgaaaacctgccatgtttctggttagcactaataaaacacctgtcccatcttcatggatatcatccatgaaacacaatatctaacacaacctattactgcaacaaacaccaaaaatcatgcactaacgcctacatcggtacattgaagtacctacttcaatgactcttatcctgtaaagggctttccaaccccaaagtgctacctttcctccccgagtaaacttcctgtcagttgcctcctgttttcttttcccttttggtggggaataaagatagattcttagtgcttaggttaatacatctttctgcctgtgaagtgatttgaatcctaaagaggtagtaaaccctagtactctctctcagtccatgtattttgatcttgtattcaagaagactgcacacatgaagagtttgcaatgcttgcttttgaggaaaaaagtgtgtgtgcgtgtgtgtgtaaaacaaagagaatccctgtgtaaaatggttactataagaaaaaaaaagagtgactatttgaatatagatacaactaagggaaactgagccatattttgttaagattgaaatgaaaaaataaatgaaacaagattttcattttcttctcatcattttgcggcttcaattgatgaagaggagtgcaagaaactgtctggaaactcaaccatatttttacagtcttagtgagtccagataggataaagcccagaatgtgcaatttgaaaaatgatttttatattagtgaaatatattttagcacatgagacgacatctttttaatgcttcctgcaatacatagcctcatcctgtcctataaagccttcattttccccagaatgacctggcagccagctgaaaggacacagtggactgcctgactgattacacccttggaatatttatgtaacttttcgatggcagcaaaatgctgaaaagaggatacagcagataaggtaatggaagccggcctgacttaagcctcatgtaatccctgacatctcctaaatcactaggtaagattagtcagtgataaaaattctccaacagtgggcagctctctgaaagcctgcatcttcctgttgagtggaatgtcaaatttagagaatgtattatctgacctaccaaagatactacttttaagtccttgaccagttaagtaaacagtgcagacaactattatgtggtttttattttactgttgttgttttatagctgagttatatcccagccagattcacattgtgaatgtttagttgaatgctgcaccaaatgatagttgcacctattcaggccaaacctcaagaaatgtttttcctctttacttctgtctttgaatgacttctattccaaatgtgaaaaggacacattttcctttcctactgtgtggcaaaaataaggcaatctcagatctcttcaaaattgtctcaatttttaccttttacaaagaaagaaggagtcacctacctctttctgtagactaagaagaatgctatataaaaatccatacagtacaatgtaattttttaatcatttcatataaacagggaagattcatagagatactcagaaaacaaagtattgggattttatgcaaatatatcattatagtatacatttttatataattttgatcattgttaatattttctgcattataacatttatttgacaacttctatctaacccagttattttattgcaaggtaatatggatatattagtcttaagtcaaaggtagattctactatcatgaatttaagtggtattctctatccagaacccaaatggtcttatttgttaggtttcttgctaggtgcaagatacagtgaagggagcattactctttgttaaatttaagaagcttgtaatatataaagccatatacagtatataaaactagagaaattctctctcttcacttttttttctaatgtgtggtccatggcctaccaaaaatactatgcatcagacataacgaggatgcatatgtttaggagcattactaacatttaaatatgttgtaacaattcaggcacaaaaatccggcgcagaaaagctaatactttttccccatgattctgaaatactggaatcaatgtcaactctcaaacacatgcacatgagttataggttcacccaaaagtcaacaacatagctaaacagaaaatcacaacccacagttggctccaatgagtaagaattaaagagaaaaagcctgtttctatcttgaattttgttcagaagtgttttttttgttttttttggtttttttattatcattatactttaagttttagggtacatgtgcacaatgtgcaggttctgttttgactcagcaggtgagggatgaaaaaacagtaaaaaattaacttcaagagctaggtgcggtggctcacgcctgtaatcccagcactttgggaggccgaggcaggtggatcacaagatcaggagattgagaccaccctgactaacacgctgaaaccccatctttattaaaaatacaaaaaattagccgggcatggtagcgggcgcctgtagtcccagctactcgggaggctgaggcaggagaatggcgtgaacctgggaggcggagcttgcagtgagccgagatctcaccactgcactccagcctgagtgacagagtgagactccgtctcaaaaaaaaacaaaaaaaaaactaatttcaattttcaagttttaaaacagccattgttaatagtttagaattcagatctagaagaaattaaacagtaaacaacactgccaatatggtaaatgttaatattaatgtaaatattaaggattaggataattgctgtgttatggttccagaaatctgagtgctatggattaagggatttattatagagattagaccttatgcaactgtgggagaagaagaggaaataaaagtacagaggacaaaagttggaggatcagttccactgaataggatggggcctgattaagaagtctattgacagctgttgactctgcatttgttgatgaactcaaagtcactgtaggtcagtcagcagaggtgacaaagaagaagaaaagctgaatgtaaaaaggggtagagcaataaaaactgaaacctgcaaagacaaagttaaaccagtgaactcactagaacgtgtgtttatctctcagtatttccaatctcaatcacatccataacctacagacaaagctggtacccttcgtcacagagctgaacaagtatctggcctgggacttgaagtagctaaaatcggaaatctagataaaccagcagatcagcatcatacccctcatttaatgttctgtaatatacattaagcacttatcactacatcttatgttagtaaagaaatggaaaagaattgatatataaatatacatatatatacacacacacatatctacatatacacacatatgtttatatatgtaaaaataaattcatatcaaaataagaaattatcataacaattatagttctcatttctaatcggtcatgttgttgcagctggtatctagaacttctctatttcactacccatcacacattctctttgctctctaaagcaatttggttactaaagttttcttgcctggtaaggtgacccaaaccctcaattctaaaatatttggcctatttatattctatcactatagtttttcattaacctttttttttctgtagagatagcatcttgctatgttgcacaagctgatctcaaacttctggcctcaagggatcctaccaaagtgctgggattataggcaggagccactgtgctcagccatttctttattaacttttatcacaggtgatgaatgtactaagaggcaccccaaggatgtctgcattcctgacatattccttctaaccttccacagcataacagcaatacaattatcctcttgataatcaagagaaacaacctgagccagcacagttgtcttctttgcctgttgattaacaagcataagaagcccagagtggtcagtctcaacttccaaattaagggaaccaatccagtgtcccctggtggaaacataactccctcaatagttaagatctctaaactagaaaagcgtaaagtcactgggtcaggaatccaacattttgctagtggatcactagggaaattatgagaggaccgtctcctatttttattccttaattccaggagtcatgaatcccagttatgagagaaaaaggaccctgtgttggacactaacctagagcatgtaccacatcctagacaacattgtcctaaacccaaattgcgttgtcatctagctggtgctgtaataaaatatttgaaagaccattttaccactctctctggtctttgctagctatcattcatggttgtttttaaaaaggcattttccaggtaaatagctacataccaagttatgggggtaagtcaatttgcttcaaaaacaaaaccacatctgaaccagctgctagaattggagttagcacatgattaactgtatgataatccactgacattctccaaggtccatctttctgctatacaagccaaaaggcaaactgaatggagatttacatcaccatttttcaagtctacagtggtgattataatctctacaatgatccaagtttgtggtattgcctttgacttattagttggtagacagaagttccagaggctaccacttggcctttcttacaataacagccactattccatggattagggaactaatgtggaaactatgccagttgctgaatatgcctgatacaactatgcattcctgaactgaagaaatcatcacataatggattcaggtacccattggtccactcaaatccaagtcaaaactccattgattgctttacatctacaactttactctgtctagaagaccacattgcatttagggtttctaggaataggtgtcaactataagactattgtccagtaattctcaaaaacactggttatttttccttcttcaatttaccaccctggtaaatagcaatagatccctttgaggaatgttaagatttccattatagaattatggctgtgtcaaaggactgttcatcctcaaagggacctggcctcctcttcactcaagggactctggttctgaaaactgaatcatgtttggaaattgattgacagggaatgactctattgttgtgattcaaatcagacttttgttccaagacctagagtttgccacttaaacaattaaagtaagactagaagaggctgaataaggcttccagttttacagataccatgatcatcaatgtcctctctccataggtcaaatctgatgactgctttgctctgctatccagtatgttaactgtgcccaccttacttctggcaacgacgtgccaggttttggtccctgccacccagggatcccctcatctcctttgaattcagggactatagtttgatgacagctttttttcactgtcaatcctgaactatagagaatgacaaccacagagctctccaaggacactgactttttttttttttttttttttttttttacaaatatttcttacagctttgttcaagagcatcttccttccttctttcttacagttttgatgagggagtgttctctggtcccttctgagggacagaattcagaactgggtacacaactcttacataacaaatctacttttacattccaacctttctgaccctttgcatatcttcctctatggtaaagcaaggaactcctgaaatttcaaattcaattagtgtaggccacctctgggcccatgtttcagtaaactcaccaagaaaactcagagccatgctaactgtctaagctacaaaactaaacccagaatctctccttagttcatccatatcaacaaattcagcccaatccaatatttcatttcttcttcaccgttccaacttctgtattatccatttccatacatgtaccccaggattctatccatgtaaattcgtaaaatcttgcagttatcttggcatgtctggtacctttcatgtgtcacattttgtacctaacatccagggctggcctgaggattttagtctggatatagatctagaagacaatatctaggggtagattctaaggaggatcagcagggccttgcaatgattttaccttaaaggaagcttcatgttcttcagacaaggggagactaacacccatcggcaagggatgaagagctgcttctcctggcaaaggagactcagcagaattttggtttcccatgtcccccactttatgaggatctgttcgtatgtccccatctcaattattttggttttcacttctcccaactcaaattactaacttttaacatatgaaactctgaaggattgtgaattcaatttgtgttgaatttcaggcaattttaggactagactttggatttaactttcagaaatctcatccctgtgattacagtaggtaaaagcgtattttaagatagtcataaaagcattctagtccattccttgaatcttgagacttgaagccaccatttctttctttttttttttttccttttctttttgagacaaagtctcactctgttgcccagactagagtgtagtggtatgatcatggctcactgtagcctcaaattcctgggttcaagtggacctcctgccttagcctcccaaagcactgggattataggtgagagccaccatgtgtggcccatttccttattcatgcttcccgaacacttagaaagagctgagcagcagcattatggcctgtgttttgaacaaaatttcaatggcagcaagtatctggccatgcaaagccttgccttctatagtcacttgattgcagttgtccacagttgatcatttaagatcctattttgccatggcatggcatgctactagtatcccctttgtcactggagactaggtcattaatgcatctaaattttatcagatcagaaaaacatttgcagattattcagaaccaatacaaagaccccattctcaaggttctgttcctatggaagctcaaaaaacaggctacatttggtaccaccgagtgagaattaaagcgaaaaagcctgcttccatttgggattgtgtttagaatgatctatttgactaagcaggtcaaagattaataaaaacaagcaaaaacgaatttaaacctcaaagttgtacatgttgaacacatttttgatgcccaaaaatttccgttcaattaagcaaaaatatagacaatgttcaaaaccgccaatgttttctacatcatatgttttaactctaaaacaaactacagaggcctggcacgatggctcatgcattgtaatcccagcactttgggaggccaaggcaggtggatcacgaggtcaggagttcaagaccagcctggccaatatggtgaaaccccatctctactaaaaatacaaaaattagccgggagtggtggcatatgcctgtagtcccaggtactcaggaggctgaggcagagcaatcgcttgaacccgggggtggaggttgcagtgagccaagatcatgccactgcattccagcctgggcaacagagtgagactccgtcaaaaaaaaaaaaaaaaactagaaaatgacagtgttttcaatatattaaatgttagtattactgattagcttgagtgcctagactaaatcctaggggaaaaaatgaaagatagctatactagatttattagggaaagcaattttcataaaggcaatgtatttgataaagcaaagcatatggtctagctggcaattaatacaagccctgtggtgtgatatttgcctgtacgtgtgtggcaaaacatctttctcatatcaccctattacaataaaatgcattcgcagcaaaagtaagtgcactgtcagcctggaaaaagccaatgattggtatctctgaatccctttatgtatagaaaatatcttctctctccttccccttgagcttttagagtcagggttttaaaaacagcagaaaagaaatcctctttgaaatttcttttaagctgattagctgacacttaatgagtattagatattgcactggacgacaataggcatatatatatgtagacataactttcaggtactaaaaaactccaccttcaaaaccagctcttaaagtatttaaatatttaacagaactgagtacatttgtccaaatgatgctttccttaatatcacacaaggcactagcatccaacttgtccctccaagtgccctagacatggtgccaagcaaatgctggcaggctcttctaagcatactctttctaggtatagatccatgaaatagtgccagttcaatgtgatgtggcttcttgcaaatgctcttttaatgcattgtattccccaacaaataatgtctcatgtctggtatgtcaatttctttctacaacatgggaatctttcaatctattcattcttgtttataaatgcaaactttgcattattctattcacacatacacaccaaaaagaaacatatactagtgcattccaaaatatgttccaattatactaatttagtcttttggatctattcaagtttttcaaacattagctcttactgaactccttcaaaatacagtcacattttaagactgcaggattagttaagtgcaaggtcacattgcaaagtcagtagtacagagagcaaagattctcagaatcactgatctctcttcccttttagtgaccttagacttgcccccttcttccttctcaccaagcaaaagacactctcacttccacaagggtctcaatcccactatgtccaatactaatgaggagggagagaccttcatcttagtaacctcatcacaaaagaacagaggggaacaagttcgttattatagcaaaggtcaacataggtctttatagaaaactaacatatataaagatgtagctcatcaggggttggaaaggaaagagaaccaaatgtttataatcacctgcattatcctgcagctattgaagaagagaaagttgtcaccaatgcatctacatttttaaattcctttagtctcctttaaaggtgcctacctcattttacatagaagtgtaaattaatacagagaagtgctgaaatcatgaatgtaagacttaatggattctacaagctaaatacacctgacattattgtccatatcaagaatcaaaacaataccagaatctctgtgcctttttttccctgttttgaaccatcacagctgtcctgggtacaaaggagtcagtgccaggacatttctcatatttcatttatacaagctacttattacagagcagcatacagaacttttagggaatgtaacttatacaacactgagcacagaatatatctaaaatttctccacttctcaccaccagatactgctaccatttctagcccggaattttgcaataacctcccaatttataatccctgctcttgtctttccccttcagaaaatcttcaaactagcagctagagggaactttttaaagtaggcactccatcatggcattcagatcgtatcattcccccacttatagtaacatttcttgctcttggctgcacattgggtagcttcaaaacctaccattgtctggagccacccgccagaaattctggtttaattggtctagagtatgtactgagctccacaggtgattctaatatccagactttgctatgacctcaaggcccaacatgaaggcaagttacctttttaatttcagctcttactgtgctccctcatttagactatctcaaatacactgacctcctctctgttccatgaagtcaacgggcccacctctgaaccactacacttgatgttccatatttttcttcattgcttcttttcctgtgacagctagctccttcacttcctttacatctttttaacttttaagttcagggtacaagtgcaggcttgttccataggtaaacttgcattatgcaggtttgttgcatagattgtttcatcacacaggtattaagcctggcacccactagttgtttttgtttatcctttccctctttccaccctccaccttccagaaggccccagtgtgtgttgttcccctttgtgtgcccatgtgttctcatcatttagcccccacttataagggagaacatgcaatatttggttttctcttcctgtgttagtttgctaaggataatggtctccagctccatccatgtccctgcaaaggatggctgcatagtattccatgctgtatatttaccacattttctttataattctcgttctcagtgacaccttcactggctacccctgacattttataccccccgtcctgattcatattttcagcaataatcactatccaacatacaatatatcttctttatttattttgttccacctgaagaagcctgttggttcaggatggtgcccctaactcatggagcaatgctattacacagccggagctcaagaaatgtttattaaataaacaaatggcattttcaagtaatgaaaaccctgctaaagaactttgagacagcatctaacagccaacattggaatattcattgtgatcataagccttaagcacattctcaaccaaaactggctaaatgaaaacaacctagataagaagttgccatgtacagcaaaatacagatacactgtctgcacttcatccttcagacaaaagaaacccctagagcaaaggttatttcttcttttgtggagcattcagagctttcaggactaccagacatctaaaagcctacagaaattaaaaaaaaaaaatcaaatgggaaatagaccatgtttatcctctcccttgcatatatatttttttcatatttcctttgtaattcactcatttggggtctgagaaatttctttatatgtcattgtggaggtgcactcattcacaatgattgctttcaagcacatgacatggcatccacttcacccccaactctctgctgcctcaagaagactgtcctagagaaagttaacatcctgattccttttatttttttttggtcaagaaataaatcttgaaataaaaactcctgaactttctaccctgcctaaaattttgggctaaataaaatatcttctgaattaccaatccaacaagagagagattttttaaaagagagaaaaagagaacaactcatcagcagagcagaaaaatcacaaatcactaaacacagggctatttccagttgcacccataagcagtgctgctaaaaactaggtctcaattccactgggtctaagccttcctcttgctcgaagaagcagctaaaacattgttcgttccccacttgcctcagagacagtgagattcttgaggcttctgtttagaaaaattgttacagtctctcaatacgtctgtgtttttattatcactgttaataatgaaaaacaaactgtggtccttcgtagctccgatacacatgctgataaccaatctacctgaacactataaaattcctggtagtctcaataaatatttgataaaataataaaactctcacagttctgaattcttttctacttcctatatgttcaacttcatatagggatttctgattatagaactagcataaaaagagccttctaaaatttggatttatatttaaattctgttctagtgatgaaatttcattcctaagctacaaaccagcaagataaaccaggcaaatcattttgcttcattttttcttttcatgctcccatccttagacttaaaataatcccagcagaaaatgataaaccctatttcctagtattctatcattagacagactgttctaataagtaatattttaagaaacaaaataaccaagagttcattgattaaacaaacaactagtttgttcaacaaatagttatagaatgctatttactatactcatatttttggcaatacagcaataaacaaatacacacaatcctttacctcatgcacattatcatctaaagggggagagaaacatttattacataaacttaaatatatctatctacattcaaaaagtatttatcaagctcctttacggcataggagttgggtaaaaatggtgcacaaaatacatatgaccaatgttttcatggagtctaatgaagaagactgtattagcctattttcatgctgctgataaagacatacccgagactgggcaattcacaaagaaaagaaggtttaatggagaatcacagatccacatggctggggaagcctcacaatcatggcagaaggcaaggaggagcaagtcacatcttatatgcatggccacaggcaaagagagagcttgtgcggggagactcctatttttaaatccatcagatctcttgagaaccattcactatcatgagaacagcacaggaaagacccacccgcatgattcagtcatctcccactgggtccctcccacaacacgtggaaattatgggaactacaaaatgagatttgggtgaaaacacaaagcaaaaccatatctttctgtccctggcccctcccaaatttcatatcttcacatttcaaaaccaattatgtcttcttaacagtccccccaaagtctcaactcttttcagtattaactcaaaagtccacagtccaaagtttcatctgagacaaggcaagtcctttccacctatgagcctgtaaaatcaaaaccaagtcagttaattcctagatacaatgggggtacaggtatcgtgtaaatacacccattccaaatgggagaaattggccaaaacaaaggggccacaggccccatgcaagtccaaaatccagtgaggcaatcaaatcttaaagctccaaaatgatctcctttgactccatgtctcacatccaggtcacacctatgaaagaggtgggtttccatggttcaggcagctccacccctgtggtttttcagggtagtacttccctcccagctgctttcatggactggcatggagggtctgtggctttttccggcacacagtgcaagctgtcagtggatctatcattctggggtctggaggatggtggccctcttctcacagctccattaggtggtgccctggtaggactctgtgtgggggccccaaacccacatttcccttctgcaccaccctagcagaagttctccatgaagaccccgcccctgcggcaaacttctacctggcatccagggatttccatacatcttctgaaatctaggcagaggttcccaaacaccagttcttgacttctgtgcactggcagtctcaacaccatgtggaagttgccaaggcttgaggcttgcaccctctgaagccatggcccaagctctacattggcccctttcagccatagctggagcagctgtgacacagggctccaagtccctaggctgcacacagcacggggaccctggacctagcccctgaaaccactttttcctcctaggcctctgggcctgtgataggaggggctgccatgaagacctctgatatgccctggagacatttttcccattattttggggattaacattcagctcattacctaggcaaatctctgcagtcagcttgaactgcaccccagaaaatgaaattttcttttctatcacatggttaggctgcaaattttctgaacttttatgctctgcttccttaataaaactgaatgcctttaacagcacctaagtcacaccatgaatgctttgctgcttagaaatttcatctgccaaatactgtaaatcatctctttcaagttcaaagctccacaaatctctagggcaaaggaaaaatgtcagcagtctctttgctaaaacataacaagagtcacctttactccagttcccaaaaagttcctcatctccatctgagaccacctcagcctagactttattgtccatattgctatcagcattttgggaaaagccaaagtctttaggaagttccaaactttcccatatttttccatcttcttctgacctatccaaactgttccaacctctgcctgttacccagttccaaagttgcttccacattttcaggtatcttttcagcagggacccactcctggtaccaacttactgtttcagtccattttcatgctgctgataaagatatacccaagacggggcaatttacaaaggaaagaggtttgatggagaactcacagtttctcttgtctggggaagcctcacaatcatggcagaaggcaaggaggagcaagtcacatcttatgtgcatggcagcaggcaaagagagagcttgtgcaggaagactcacatttttaaaaccaccagatcttgtgagacccattcactatcatgagaacagcatgggaaggacccaccccatgattcagtcatctcccaccaggtccctcccacaacacatgggaattatgggagctacaagatgagatttgggtggagacatggagccaaaccatatcaaagacaaacattaaataaagccagcaacagcaataagttctataaaggaaactaacaaggttctacgagagaaaataacgaattttttcaggaagtgacatatcagcagagaaatgaaaaatgagtaggtgttaaatgtgtgtttagcaaagagcagtctgagaagataggaaggtttgcacaaagaccctgccagaaaatacttgccagtttgagaagaactgtgaaactacactaataatgcctggagtgaagataatatttgaagatgagttaaacaagctgggtgcagtggctcatgcctgtaattccagcactttgggaggcagaggcgagcggatcacttgaggtcaagagtttgagaccagcctggccaacacggtgaacccccttctctactaaatataccaaaaaaaaattagccaggtgcagtaatgcgtgcctgtaatcccagccactagggagattgagacaggagaattgcttgaacccagaaggcggaggctgcagtaagccaagatcaggccccccatctccagcttgaatgacagagcaagactctatctcaaaaaaaaaaaaagacttaaacagagttcatatcagaacttttatattaaatttctgaagaacattaatttttttcaaaatttccgaagttcgcatgtaacagaattttatgcgtcactcactaatgtactgcttcacaaagcatccttcatgaaccatcattttcattttaaacagttttatagcccagtgcatttagaattgcagctgaaacaaaattaaatcaataccttttgtgcagaacttctcaaatatttagaatgataaattgtaaatattcatatggagaaagaggggcagcacttaacaaacattatattatggaactcttttggagtatttcagcagactactgcataaacagaacacattctgaaaaatagtgcattaatgcatttttccaaaaagtatttattgaagacctaccacattacagttcctattctggattccagagatacggtgattaatgaggtagaccacctgccctagggaaacagtgtacctagtaggaaggagtgatacccatacatcagattactatgagtgttattccagacatatgtgcaagtaggtatggtaacacataacacaagtgggagcatctagcacttatctactaggcttaaaggaggataaatgttgatactaattcttgaaaatagtaatcaatatacagtatactttaaaacttcttatttttacaactgtggaattatacaatttaaaacctgaatgagatcttagaataaactatctcaagtttctcttttatccataggtagaaactaaaactcaaacaaaacatctttttacataataatttcatgatagagttaagatgaaaatttgatttctagtatacagtaatgagggcattttattaattgtattgcatcatagtaacaacattcagaatattagagcattttctctccatgctttcaagaccctaaaagacattttcatgtcttagccatagactctcacacttattgggctacatttccaaccaaccagccccaaaaatttggtatgacaaagtttaggccacatggcatgaaaatgtctttttttaatatgtatatataatatatattaaattataatatatatttttaatttaaatatatatttaatttaatttaaatatatatttaattttaaatatatatttaatttaaatatatttaattttaaatatatatttaatttaaatatatttaattttaatatatatttaaatatatacaatatataatatatattaatatataataaaatatatattatatatttataatatataattatattataaattatatatattatataattatatattataaattatatatattatataatatatattataaatatatataatatgtatatattatattttgatatatataaaatataatatataataaaaatataatatatatattttaatttaaatatatatttaatttaatttaaaaatatatatttaatttaaatgttctatatattatacataatgtatatataatatatatacattacattatatatacacatttatatgtagagaacaggcagatgctgtttaatatgcatattaaatgtatatatacatttaatatatattatatatacattacattatatataatatatattatatatacatacattacattatatatattatatgtatatataaaatctatcctagagatatagataaatgatagatagatagatatagagatagagatatatatcctatacatatacgcacacacagagatggtatattttctatttttctattcaagctgaaggcctaagaactaagagagccaatagtatagttttatcccaagagccagccaactgagatcaaagaaaggccagtgtttctgttcaagtgtgaaggctggaagagacccatgtccagctcaatgtcaggctgaatgggatcccccttactcagtgcagagtctgcctgtttgttatctacgggtcttcgactgattagatgagaaccgctcacattagggagggaaacctgctttactcattctaccaattcaaatgttaatctcatccagatacaccttcacagacaggctcagaatgttggccaaatgtctgggcaccccacagcccagtcaaattgacacataatgttagccatcacaagtcaaccccttatcaatttaatgcccatactcacctccttaaaccacacttaatctccaaataaaagcaataacaaggtcataattccacctaacataatacaattattctatgtacaattacaaacacactaactttttccccagaagacaagataaggtctttgagtgagattcactcaaagattcacccataagattattaccatttttactgtacattttctatgtttagatatgtttaggtacacaaatatttgccagtgtgtaacaattcccaacagtattcagtacagaatgtgctgtacaggtttgcaatctaggagaaacaggctgtaccacatagcctagttgtgcggtaggctgtaccatccaggtttctgtaagtacactatgatgttcgcacaacaacagaatcacctaaggacacatttcccacaacttatctttgtcattaagtgatacatggctgtactacgatgtaaaattaataatacttaagaactgcagtatcaaatcaattcatcttatgttacgtggttagaaaataagggagaaaagaaaacaaagatatttgtactttttcattattcattctgtattccttttgccctcagcaagcacatctgctagtaatggttttttacctggtgggagtgacccaatctttcatttctggagggtctgggccattagtagtcctgcctggactgggttgttgtagttttcctttaacctcaatcacagggtatagtgatattaagagatgccctaggcagggcacagtggctcacacttgtaatcccagcaccttgggaggccaaggcaggtggatcacctgagatgaggagttcaagaccagcctggccaacattgtgaaaccccatctctactaaaaattcaaaaattagccgggcatggtggtgcatgcctgtaatcccaattactagggaggctgaggcaggaggatcacttgaacccgggaggcggaggttgcagtgagctaagatcatgccactgcactccagcctgggcaacagagcgagactccgtctcaaaaaacaacaacaacaacaacaacaaaaaagatgccctaagggatcacctgtattcctgatacattcttccttacctccattgtgaagtagcagtccaatttccccttggtagtcaagatcaatcaccccaacaagcacagtagcttgcttctttgaatgttcacttggaggcatgaggagctgaaagtaccctgctgtagtcttaacttccagttcagtggaatcattgttgtatctcctggtagaagcatttctgtatttggaactaaggcctctaggccagcagagcataaggtcatggaataaggtcatggaatcagaaagcaaacttttgctagtgaatcactaagggcaatagtgagtggtgccacttccatttccatcccttcattcctagacccatgaatcctgactatgggagaaacagcaccatatattgtatgctcattcggataatatatagttggccctctgtatccataggtttcacatcgagagattcaactaactacggatcaaaaatatttggaaaccaaatttcaccttgatatggtttggctgtgttccccactcaaatcttctcttgaatcatagttcccataatccccacgtcatgggagtgacctggtgggaggtaattgaatcatgggagcagttactcccatgctgttctcatgatagtgagagagttcatgagatctcatggttttataagggccttttccccctttgctcagcacatctctctcctgccaccatgtgaagaaggatgtgtttgcttccccttctaccatgattgtaagtttacagaggcattcccagtcatgtagctctgtgagtcaattaaacctatttcctttataaattacccagtcttggatatttctttatagcaggatgagaatggactaatacattttctgaacaagtacagacttatttttcatgtcattctctaaacaatgcagtacaatagcaatttacatagcatttacattgtattaggtatcataaataatctagagatgtttaaaggatacaggaagatgtgcatagtttatatgcgaataacacaccattttacatcaggaacttgagtttccatgaattttggtatatgcagggggtcctggaaccaatgcatggctactgactaacaactgtacagccttctgtagaaccttgcccaaatcctgcaaggtattaccatctagataacaatgtaactgagtcttcaaaaagtcattccccagttctatcaaaccagctgcttcaggatggtagggaatatagcaagactgttgaattccatcatgatgggccaattgccacacttcttttctgtaaattgagttatatgatcagaagcaatgttgggatatcatgatggtgaataagacattctttaagtctttggatggtagatttagaagaagcattatgtgccagaaaggcaaattcatgtccagagtaagcgtctattacagtaagaacaaaatgtttccccatccatgatggatggaagtggttcaatgtaatcaacctgccatcaggtagctgatcaacctggggaatggtatcaaactgggtactcaatgttgggctctgctgctggcagattgggcactctgtggcagtcatagctcaagtggctttggtgaatggcatccatgttgctgagcccaggcatgatctccatccatgctaccatggccactttgttcatgaaccaacgaggtgataacaggctatctggagaaagaggctggctggtttcccgagaactggtcaacctatgcagttaattattaaagtgcttctctgctgaggataccatttggtaagcattcacatgggatacaaataatttcacatttttgcccattcacagagttctgtcttcatacctcttccctaaattttcttgtaaccaatttcccaatcatgttacttccaagtccctaaccatccagccaaaccattggccaccgcccatagtcagcatgcaatcacatgtctagtcatttctctttgcaagcaaaatgaacaactaggtgcactgcttgaagttctgccaatggatcacaggaaattccctatgaagccataggtgcaaggctgggagagagaagggagtgtaacagcagtggggaccactggcatttgaaccactttttcatttaatttacttgtgttttcagtacctcctctggcctgatcatgtacaaactacttccatttgatgatgtagcactgctaaacatgcccaacgttatgccttggtgggtctctttactactgtaaatgtgtcattagcatgtttaaatcaaatcatattagcgatcaaacttcagaaacctcacaacgaattcagaaaacttacccttaaaattctgtttctctagaaccactgtcagtaccaaaatctacgggttagagttcctcagagaaacagaaccaacagtatttgatttatatccaacttattgtaaaaatttggttcatatgattatggaggctgagaagtcctaaaatctgtagttggcaagctagaggcccaggagaaccagtggtatacttccaatctgagtcagaaggcctgagaaccaggagcactgatgttataaatttagtctgaaatatggcaggctcaaaacccaagaagagccatttttcagtttgaatccaaagacaggaaaagactaatgtctcaattcagatggtgaggcaagagttctctcttactaaagatatggtcagcctttttgttcttttcattcctttaactgattggatgagggccacccacattaaggagggcaatttgtttaactctgtctatgaattcaaatggtaatttcattcagaaacacccttgcagacacacccaggatgtttgaccaaagatctaggcctactcaggttgacacataccattagccatcacaacaccttaaataatagacttaaacagttccttactaaagcctaaaattttgagtgtggtttggggtagtaataaatttaggactctcatctttctgtaaactttactaaatattaaataaatgttaatactgttacagtaggtagttaggcataagtggggcaggagagggctctcccaacccacaagaaatgttgggtgatcgttcggcagttatcacattgcctctgtaaaagtgataaattgggagccagtgccagggagaagccatttcctgatggtccacaactactgcactaaagtgttcattgaaagcagaagccagggagaaggaacttcctgggcatgcacgttaagagacaaaatggcagagtatgatattccagggtcactctactggaaaaaggaagaaagcctcagatgggcatatgtacaacttcctaaacacaatgcacttgttcacttcccaagggtaaggagggcactgtgcatgtgggcagcccaccgtaagggaagaatcatgggaaggaggccagtctataaagtcctagaatcaaggttaaatgtcacacttgaacttctctctctttaaccttcacatgtcatcttgggtctctgtcaagtgaattttccttcctttcctgttctaagatcttttaaataaacttccactcctgctgtgaaacttgcctcagtctctttttctgcttcatgcccctcagtcaaatttcttctgaggaggaggaaaaaaaattgaagttgccacagatgcatatggattcatcaccagtaacttggggtaactcagatctcttccatcggtaacaatactggtattttctagttcacagaataaaggggaaaatgtagaaggatgacaaatttgtaagagaaaaaaatgctgttatcaagtcaaacctcaattgcttgacttcaggctgctggagagaagttttaatgcgtaaattctagtttgaaaccttagtaatttggggaggagttggtggtgctgataaaatattcgtgaagagtaaaatgaacagaataatgtaaaaggggggcaatctggttgaccaattgggaaacataaactaccatttgcatggtgataaaggccagtaacctacttaaacactgtctcaggagtcccagagctttgtagtgtcttgaagttgcttgtttgtttgtttgttttgagatggagtctcactcagccactcaggctggagtgcagtggcacaatctcagctcgctacaaccctcacctcccgggttcaagcaattttcctgcctcagcctcccaagtacctgggactacaggcatggctaatttcatttaatataccacacctggctaatttttttttgtatttttattttcatcgtgttagccaagctggtcttgaactcctgacctcaggtgatccacctgcctcggactcccaaggtgctgggattacaggtgtaagccaccgtgctggccatgccttgaagttctctaagctctctttggttgtcagggactggctgatgctagcaggaacatcaaagcaggaggccacccagattagacaaggaactatgggaaccctagtccttgcttctcttctttgggactcttgtcccctctacagcctggagttgaccagaggacctctgggactcatacatttagtgtcatctcacatctctatggatggcctctgtttcagaattcctcccagtgactgccatggcacatgatttgggatgtcttgctcagattttaaaatagacaagttctggaatataggatacctacagtctataccaagcttcagatttgagcaactcctgccttctgtacatccattcttaccagcatgttccaatgatgttgccacctctatctgtagtacccaggggcgatagaggtggtggcaggcattacttactctgtgccccccacacccacatggcaacaaaggtggacacgtcaccctctcctcagcctgcagcacaaatgttgtgtctatccccactgaagctttttgagactgttgctccccatccctaacaaaaccttattaatgtcttctcttacttccaatcacagtgatgttatctcctgcaggtcttaagtcatgccagatgaaggacaaacatttcttacatctgggactgctctttatagcacctcagctattctttcgctggtggcagtgtagggaagacaggagtgaggtcatcattgacaaagatcacactctaggaatgttgtgattgccacctaaagagttggagagaagatatggttggaggatgcgttgttctatgtttactctacaagctcttgaaagataaatttagcatgtccagaaaatgaatgacatatgtttcacattttcctgcacaatctgagtgagccttgcatttatggtaattaccaaggaagcacagtgtcaaccttcagagaatcgtgggaagtcagtatttataggtggaatgatgaatggtgcagcatcatgagtgatgatgtaaccagcattaaatagatggcatcaggaaattacagaggcaaaaagatctctaatgtttcgaagtaaacagagccatgacattgtgagtaacaacaactttgctacctctttctcctggtaagaaatgaaagtaaccaggaacactacatttcatctgaagagatggttcataacaaatatttgcctactgtctcagtttgcacaggttgccctaacaaaaatatgacacactgggtatccgaaacaacagaaatttattttctcacagatgtggaagctggaattccaagaccaaggtgttggcatgtttggtttctcctaaggcctctctcctctgcttgcagatggccttcggctgtgtcctcacccagcctttctctgggtgtgtatgggacaggtgtctctgtctcttcttataaagatatctgtcttactggattagggcctcatcctactgactcatttaatcttaatcacctctttaaaagttctatctccaaaggcagccacactggaggttaggtcttcaaaatatgaattttggagaacaacaattcagtccataacacataaagccctacacaacctaaggatagctctattaaaaatgttccttttataacacctcaaaacacctcactgctacctattaattataatttggcagccatggatattattttagggtgtgtctgaggaattaaaaaaaacagctttttcaagttaaaagtacatgtgaataacaagacatatgtttctcaaagcttaagatggtctccaccagcagttcagcaactagcagcacaaagtatgagcaaacactcaaacacaagcatgagctaaagtaaaacttagggtcaaatgtacctctcaaagtatatgattggagctaacttttttattttaagttacagaaaaaaaaacaggagaactgaagagaaatcttcatctaatatgttgtttaaaatctggaaacatattttctgtactcttgcatcattttttttttctaccaagtaacaaatggatgtgtcttcttgcaggaccaaaaacaaaaagaaaagtaaaacacagagttctcaaaagcaccataatccctttaaatttgtgtttgagatgtcattagttaacgtactgttcaatgtactaataaaccacataggcctgaaagaatccatacaacttgaaatttgtggagatatttaagaaaaagacttgacttatcgaaagcattataaagcattctcattcacagaaaggcttatattaggattgattctcagatctcaaatttatcggaccacctatcactaaataaatacctttatcaataaattatactgcaaagcctttgctgaaagtgctgagattaatatcataaaagatcaaaaaacttcttaagaaagacattatagtttcatgtacatctgatgcaaaaagaaataaagctctttaacctgaattctaaatttcatgtttggcataattcatagaagaagcataaatatttgacagattgagaaggagacaatatggcttttatccaaataattttctaataatttatctgaagcaatcatttacaatgaggcacactaactagattaataaatagtaaatctttagaacataaaaaaagttatctctatattatcaaatgaataaatcaaagttaaaatttaaaatgtgagcatctactgcatctactatacagtcccatttaatatggagcactcaagacactgacaactggttctgtaaaatttaaaatagcacctatgttaaggctctgttttcacagatacctgctttcccctgccctccattccaaaaaaagatcaaattttaaagagcactttatattcatgtggcatctgtacacaagttctccagagagaaagaaccaataggatatcataggtaaataagatagatagatagatagatagatagatagatagatagatagatagatagcttttataatgaattggttcacatgattatggaggctaagtcacaagacttgtggtcaagaagctgaagaaccaggagggtcaatagtgcagtttctgtctgaaagccagcaaggttgaaacccaagcagagctgatttcagttcaaatccaaaggaaggaaaagacccaatgtctcagctcaaacgatcaggcagagctctctcttactccctcatcactcttacagctaataatctagttaaaggcacaaaatcacctttggaagaatatcatcaaaggcacggaaggaacaagtctttcgacttaagccccataactgtctgttaaaaaaaataaaaaatatttattaccatgaaatactatattcttaaaattatacttatatttcagcagaccctatctcatatcctgttttatattgatgcaatttgatcattctcctaaatcttaaattttaatacatatttctactattggcaaagaaaggagaaaaatagttattaaatgctaaattgatctttaattcattcaaatttttattgagcacctacctcacaccattcttggttaggagaatctgtgctccttgtcatcagattgttctaacttgtaagtagagctagaaatgtagagtgtgtgtgtgtgtgtgtgtgtgtgtgtgtgtgtgtgtgcaaactcacatattttcattatggtcatttaatctaacttttaaaacacagtgcgggccaaataaaagacactggtgatccagtttttgaccccaggctgtcacttgtttcactttgtattataccatcatttttctctccaattctgtgcatcctttaactgcctggcaactttctcttatacaataaaaatttgagacttaagatctcagtcttcctctatgtctcaagcattgccatcattctcggtggatctaacaaggaaaggatttcttagtcaatcactttagtaacttcatttcttaacatcttcagttccagtgacataaacttcatcttaactccaacagccacatcctggaccttattctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggccgaccttattcttaatctggttcactcactcaatactgacccaccatagacttcctgaatcaaaacattcatttctccacacacaaactctttcctccagaatctctcatatagctatgtccacagcatttattcttttacctttctgagaccactagtccttaatcctttcaaagggagcctctctaatcttcagccttcacttcctgttctattttccctagactccgtggtcccccatatcaaccactctcttgccagtgtctgtaaaacatcttttgtttttcttccatcagtttttcttaactaaatgccagtacaggatcaattcacaaactcttattttctctatgcctgcacccagactaagagacacctcaagcaaaaattacgcaaattggcacattgatatcacaacacattttatatctccattgttggcaaactgctacttgctgcttgatctttttttccccaactttactgagctatagttggcaatttagaatgtatctatttaaggtttacaacttcgtgatttttatatacacatatattatgaaatgtttgccacagtcaagcaaatgaacatatcacctcacatagttataattttgtgtgttgagaacacttaagatctaccctcttagcaaatttcaaggatacaatagtattaactatagttcacattgttatacattagctatccagagcttatttaactagcataagtgaaattctgtaccccttgaccaacatctccccatatcctcctccccccatcctctggcaccaccattctactctctgtttctatgggtgtgacatttttggagtctacatacaagtgagatcatacaatatttgtccttctgtgtctggcttactttacttagcatcatgtcctcaaggttcatctatatttttgaaaatgacaagatttccttcttttttaaggttgaataatattccataggggtgtgcgtgtgtgcatgcatgtgcatgcaggtatatcacatttatttacccattcatccatagtagacattaggttgtttccatatcttgactattatgaataatgcagaaatgagcatgagagtgcacatatctttaagatcttgatttctttttcctttttaaaatatatacccagaagtgggattactggatcataaagtatttctatttttaattctttgaggaaccttcatactgctttccaagaagatataatagggaaaagatagtctcttcaataacagtgttgggaaaactggatatttacctacaaaggaataaaattgaaccgtatttcacactatctacaaaaataaactcaaaattaattaaaaacctgaatgtaatatctgaagctataaaactacaagaagaaatcagaggaaatacttcttgatattggtctgggcagtgattgtttgggtatgacaccaaaagcacaagcaacaaaagtaaaaattgacaaatagaatggcataaaactaaaactcttctgcacaacaagcagaataaagagacaacctgaggaacacgagaaaatatttgcaaaccatgcatctaataaggtattaatatccataatatgtaaagaactcatgcaactcaatagcaacaaaataataataacctaattttaaaataggcaaaggacctgaagagacatttcttcaaagaaaatatacaaatggccaacaggtatatgaaaaggtgctcaaaatcactaaccatcagggaagtgcaaatcaaaaccataatgagatttcagctcgctcctgtggctattatcaaaaagacaagaaataacaagtgttgatgagagtgtggggaaaagaaaacccttatgcactgttggtgcaaatgtaaattagacaacctttttcatgtttccttccttagctttctcattaattctgcaaaatatgtacttgaaatctctccattattttcaaactccaccaactcatcattcagcaaatagccttccctccacctacaaagaaaaaactacaagctgcagaaggaaaccttcaattctttgcaacttcacctattctttttcctttcttcctgtcagagagaagaatcagattcccaaatctaacgcctcccccagtgctctagatacacccacacctgcctcctcaggagcctccctcattatttatccttttgttcatttccctatagttttgtttactcttgttctatcattcattcaaagaaaatttaaacatgctcagagttctgctgtgcaaaaataaaaggatcctatatctccctccacaactgccttttctcatttactttcatttaaaaaataagcacatactacataacagccacagtctttgaaaacgttgtccactctttttgtctcctactcctctcttcccatttacttctccatccactgatgtgcagtttctaccatcacttcatgtagttctaactgttttgaccaagatatccattctggtgaatccaacagacactatgcagttctcatcttatttgatgcctctaaatcatgtaacactgttgagcactccctcctatgtgaaattctatcttcccttgatatagacagtgccatgctttttaaggtctttgctgcttttttttttcagatgggatgggcagagaatggacatcttctgttcattgcttaaaagttgatattctcataacttcttctcataacttctgtttttagtctacaaactctctccctaataacctcatttattcccatggccttaattactactactagttcagtgtactcctgagtttcagaaaagtatatataattgcaaggacattaatctgcttaaatatctcaaccaccacttatgcaaaaatgaaccaataattgctgccacaaatgttttcctcctctgtgtttcctatctccatgaaaagcagcaaaattctgccagctaaatagccacacttccatgttttccatcctagtaaaaagcagcaaaatcctgctaactgtaaccctccagtgttttctatcaccagataaagtcacaaaattcctgctagctgatcaagcaaaaaccaatttaactcttcttcctcttctagttgattccacctcctcaaaatttggcaaagcttacgcttcatcaatctttgctgctatttccttctaaattcgaaatgtcattatccccttgtgtgatcactctaacagcctcctatatgatctcctcactccatctgccaccactctcatcacctctgattccattttcacatgacagcctgagtgacctttcaaaagcttaggcacacttatgtcactctctggtttaaaatctctcagcagcttatcattggtctctgaataaagttaaaagtcctagaagggcttgaaagatctggagaatttacacaggcaaatgtgtttccaattgcaagcttgccagtggtttttaagagatatttaaggacataaaattctaagctctattatctgcccccaaataattataataataatacttaatacttatatagcacatctatttttaaagcactttcatatatattatttaattcgtggctttcaaaagcccatttttgggataagaaaattgagaactcaaggttaagtggtttacacaaggtcaattatctgctaagtgacatgattggtactcaaattctagtaaaattaagtcactttatagaagagactgatataaaaaaaaatttttttagagtttcactaagcaaattgtttggaatgagattaaagccagagtcatcttatgttgaattttgatagatgatagatagatatagatgagtttttataaaaagatcccagtgcagaagcaaaataactgtttaaaaacaagtatcggatatttagaggaaatattatttctaggagaggacacagtattttttagcttcactttattttgtcgaagactagctctggcactaaacttgatgcatacaaaagatgtcagaaaatataaagatttaactatttgcagctttgtcattttatttatttcaacactagaactgactttcagaatgaaaaaataaaaataaaaaagaagttcctgccataaaattaatcacttgtcaataaataaaaagtaaaatgtgtgttggactgaagtgaaggttgactaaagagtagctgaatagataaaggagattcaacattgtcatcagaagatatgagcaccataccacaaggggaacttggggaactctgccaagaacagaatgaatgcccactgccaacacaaactgacagagggagccatgggagccagtgtgaaataaaagacagaacagagttaattcaggtcaaccaggcctaatgaaagaccagataagagaagagatagaagccaaccaagtggaaatgcctgtctagataacagctaatgaaagaacccaccaaaattaactatgaacaaaagattgttcttatagccaaccctccaagtgattgaaatgcaaatgctttcatgaaagcagtcttctccaagtaaagagaaaatcttaaatgaaactttttttttcttttttttagaaagagtctcttctctgtcgcccaggctggaggtgcgatggcacgatctcagctcactgcaacctccgcctcccggatttaagcgattctcctgcctcagcctcctgagtagctgggattaccggtgtgtggcaccacgccaggctaatttttgtatttttagtacagatggagtttcacaatgttagtcaggctggtctcgaactcctgacctcgtcatcctcctgcctcagcctcccaaagtgctaggatgacaggcatgagccaccgcgcaaaaccgaaacttttaacatcacgttttgagacaaaaatgattctgaaagacattttggcttaagaagaaatcactttatattccattagttccctgaatttagcaaaaacctttgagaagaaaaaggtcacagtgataattgctactgttttcccaataattaaataaaaacaaaaataataataaaaattaaaacaaacaaaatcttccggggatgaaaaatcacagtgtgactatatgaccatccagaaccagattcctcaatgaagagaggtgtggttaaaggagcaatccaaaaaccactcaattttgagagaaaggttttatgcccagtttaaaataataaaataaatgaaactaaagggtaaaataaatttttggaaagccctttttttatttcatggccactggaatagacagagttattcttattttgctaaatattttatcgtgaaaagactaggaaatatatcaaacattactagctttggtaaccaaggttttcctttacagcaaaagattaagaaaagtactaagttggcacaaaagtaattgcagtttttgccattacttttgtgccagcctaataataagtaaaaattaattgactaacaaaaatcgtaacagacaccaaaaaaagtttctcctgagactaactaaagaaacattcacatcttcatgctgccaggaagacaaactgccatacaaccagaggctaacttgggattgcatgcatttactagctttgaatgatgatagagataaactctttaattctgctttgaaatcctgtgaaccctataacttcattcacagatatgtggagaaaagaatattgctttcttttctattagtttaccttgcaaaatttcaccagtcaggttatacttgcccaaacctctaagtttgctattatatatgaccagaaactaaaagctacttttggtaagagcgaaaaatgagtcactcttggataccattggtgagactccaaactagctacaaacttttatagtataatttggcaaaatcaccagaatttaaactgtacctgccctttgactcagcaattcaactttggtgaatttattgtatgtatatacttgctgaagatataagcctgggtatttggagccacatgattcatactagcaaaaaaaatgtccatcaataaagaggctgattaaatagattattacccattcgtacaatagaatttgcacacattgaaaagattgaggtagatctgtattcgttgctaaggaaagatctccaaggtgaactaagatgaaaaaaatcaagtgtaatatactgttaatgtatccttcccttcatgaacaattttgaaaacattttcctatggatatataaggatgtattcatatatggatatattcaggtatacaatgtttttgtagatttatacaccaagatttcaaacatagtaaactttgggtttaggacctgaatggaaatgggagggtacgtttttaattttcatcttacatctactataccatctaaattttattatcatgcacatatacaacatcttccaaagtttctatgggatttatcctagaagctggcatttgagaccacttttatttgtctttttccgataaaatatagtttcaatgcagcaaaaactgtcaaatatgaaataaacagggtcaaattagtcatggtaggttgtctttgctcaaaactaagcataaacaaatgcttatatctaatctatatcatatccacagcaatggctgatatgatcttattctctccctcattccagaataagcatgttcgatagggcactagtgtttaattaagcacaattttcaaaggctggatcaggccccactagacatataaatgcaatatacttagtaccataaagtttgctaataatgcgcattcataaggtaaaagccttttaatatcagggtattaggttagctggaatccaatttatgaaaaaaaccttctatatgtgctcattggtaagcaataatgcatttcaattccatgccggcacaaaacctctcaggttcccttatgctcttttaaataagaatcatagaacattaatagaagtgctctcctaggtctctattcaaatgttctttgatttatagatttcattaacaaagatcaagcaaatttccttttgctagtattccagagtgagacaaagctgctaacacttgttttgtgaaaacttgcattatggcattttaaaactactttgttttagggctttgtcaaactcagacatgatctcttttcagggttaggcctattttgatcacttttaataagtaatagatggatgttttaacataccaggagacagaaacagtcaaagaaatattctactctttcctgtatttcttccctgagggcaatgctttaaaaaaaatcaattgtgatatatgtcacattgcatttcagccctctgctgaagagggaaaattctgaggagctgggacccctccagtcctaactctgagctggcatggcccacactggtcatagggtgcagacacagagaggactgcctacaactagggacttcttcaaaggcaagagatattctgaccactgttttgcacactttgaagtagaactaggagtggtggtaatagccaatcataactcatttcctctctgaggctggttcaaggggcatgtctttctcttttccaaaaatgatgttaaacagcaaccaagcctaatttcccccagaacatttctcacataaattttacaagcattgtattttctgtctgttatgttttgtttcctggtaaaagtgcacacagataacagcttgattgtgacacgtgcttgtgaacaataaatatttattatcacaacacttctttgttcccagcttggtgagtctggagagattttaggcaaattaagggcaatttgagcctggatctctcaaaacagtgctaagtagaattactgaagagatacttctcatttataccagaacaaaaattcttattttcacacatatatcaacatttgcttaattcatgctcaccagataatagtacaccatgttaaagaaaatctgtagctatagaactacatgttgaatggaaagcgatttattttgaagtcctgaaactgatgactaagacggaatgttatgcatctcagagcaccttgcattttagtaacatgtaaaaatatttttaattagtatgagtatcatttatcagcattgtctactcacaaagtatttagacacacagctatctacacacaaagtattttgcacatgtttaaaaatagccttgtggccttaattcttattaatatgaactctatatagtttatagagtttatattgtttatgtataatttatattgtttattcacaaatactctatctcatgagattgccataagaataaggcatatactgttgtatttccattgtggaaatttcagaaatacagactcaaaaagatagagttctcagaatcacacaagaggttcaaaacttgagcctttctgtctccaaatcctaagcctttctgtaataccttacttacctgcaatttagtaagacattatattaaaaatattttggttcatatgctctatgtacatcgagctataggatacaatgccagtcttcaaatagcacactagtcagtcagctaacaaatacatattgagtgcccactacatgccaaacactgttttaggctataacagtgaagataaataatccctcttcttactgagctgatattctaggaagataggatcaaaaatagaacacattaagacaattttaggtactgttaattgctgggaagatgtcttagtataatgtcatagaaagtggccactgtgggactctgttttagatagggaggtcagggaagggctctttgaagaaaatggcatgtgagttgatacccaattgaagagaagaaaggagtcatgctttgatctggggaaaagatggatccaagcaaaaggatagcaagtgcaaaagttcagatctgtgtgtatccaaagtaatggaggcctagtgtgaaaggggagcgtataaacagatgaggttggagagatggacaggggcccatcacataggccctaaaactttagcctaacaaaccaagatttatttcttacgcatgtcacattccaataagaattgtctggggtgagaggtttgctccaggaaggcaatgaagaccccaccatcctttcatcttgtgggaatatcatgtttaatatacgctctccaattctgccacacaataggaaagagacaggaggatcctagctgggagagttttatgagacaggcctggaagtgatgtccactacttctgcttacattccattgcccaaacttggtccacatgaaagatgaggaggatgggaaatgtaatttagctgtgtgcccatgaagaagataaaaaaaaaaaaaaaaacaggatattggtaagtgttagcattctttggtgcaggcttcatataataatttttaaaatgatctttcatgtacagtgagaagccactggacattttaagcagaagagcaacacaatctgattgttattctgaaggatcacttgcctgttgtgtggaagctaagctattatgagcattcagtcaaagagactagtcaggaggctaatgcagaactcagggtaaaattttagttgttcaattagattgtaacaaggtaaattaagaaaaattgtcagattttgaatacagttatttgtgggcacaggtagagtttactgacatattggttgcaagaatgagagaagtgtcaaaatgacttattttttcccttttttttttttgattgagcaattggtgtaatttattgagatatagtggcttagaggaaattagatttggggttggggtaggagagaccagagagtctctacttctatttgaacacactaaacttgaaatacctattagaccttcaagtgaagatatcaaataagaagttggatgtgtgaatctggagctcaggagagtaattcagttcggagatacaaattggtggtcattcattgaattgatggaatataaaaattcagaaatgtcattttataatatttgcaaggaactagagaaacaatgtttaaacatatatattttactgaatatgtataaaatataaaaaaattaagataaacattactttcaagaaaaactatttgttggaaaaatacagattaataaaaccatactatgaatttacatcacaatatgggtataatttcttgtttgcaaataatataaacatagtgcttttggctataataataagaaaaaatagcttttgtgtaaatcttcttaaatagggatagatggcactatataagcatatcatatattttctgattttagctcttagaaaaaataaaagccatggctcaaaatttaaagtgatatataggaaatcaagcttcttgatattgccactaaagcctagaaatattagacaccaatagaactaaacccaatcacattcaaaagaaatagttgaccttcaaaaagtttattccaattgggaaaacttattatgaaagtgttccactaaatgaaatgtaacacattttatttttagttcataaaagcctacttatatatttctaaatttttaattcagtgcatgaaaataactttaaaagcttcagtagctgaaattttttaaaaattgcatcaaaatattttaagagtatcttttcatcttgaactcagtatagcaggaaaatgttcactatctcatgggtggcttttgcaatgccaaaattggttcttccctagtatattttacttcatcttactaccagttttcacatgaattctttgagggatggagtgattttgcttctgttttttcactgggaattacttaatcctaaatcttgtggaaagataaggcaaagaaaaccaagagaactcattgaaatagaaaaagaaggcttagttatgttttagatatcatagcttttttttgtaagggactaaacagttcattttacctgtgttaactgatcaaccaagcagccagtcacgtatctgactttaatgatttgtcttgaagacacaagttttttaagtaattagttgctcaatataatcaccatttaaaagaagaaaaaagcattaccaaaactttaggcaaaaataaaaagaaagtgaaaataacataaacttcaccaatattaaagaggagttattgaaaattataaaactcttcctatgaagttgaaattgtgttattaatagcttctaataatcttcttctctgagtgtaaatacattgtctttaattaaaatcccagtgaggggcctttatagcatgacttaactcttccccagtgactatttttaaaagtgcgtatttggagtggataaaagagctctggatcacacaaatatcaagatcttccacactccccacaagagagcatatagacaaatgctgcctggagcaccataagagcaatttaatcaaggtcagtctcttatacaaaatgcttacaagttcatcccaacatttccttaaccaagaaaaaatagatttattacattgtaacattatattgcactcacccctcagaagcaaaccaaatccccacaaatgagaaacagttttaaggacacaatccttaacatggtattcaaggccctccttgatatattccacaaaccccaacatatcccccaaaaatcttacatgtgcactttctatcagtcaaacctcactcgattccccaacccatggctttgtctgccgtcttattccaccgtatctgtattttccaaatagtacacataccaagggctatttcataagatacatcttcctaacaaatgtcaatgatcttcttctgttttgatttgggcaagcacccagatacacacacccacatacacacacacacacacacacacacacacacactcactctacacccttcagatttccaccacactgctacacctccacagagcacttatcacattctgatgtagtattttgagttcattttacccattttaagtaggcaaaaagcctacttagaagtatagcacaagaactcactcaaaagagtaagtagtagtgaagcagatactggagtaggggtcagaagactactttgaaacccacttagcagaagcttaacttctctctctctatttctctccctcactctccctccctctctttttctctctcaacttgcttttattgatctgtaaaaccagtgtatcagaaattactttgtagtaggattatgaggcttaaattggtaatatatgagaatcctacgatatgaagcagatagaagcataaagcattattattattattatatactacttacaatgtacctcttatacagcaaatgttcaaaagtcatttttatattcctatcacattgaaaaaagaaagacatgaaatattgtgaaacaatagtaaatttacagtaagtccaggtccaattggaaatcaggcaaataaatcaaaggtctcaaaaatatatgagtttgttgatgtcaataaaataaatgttctctcatccacccttccattctatttggttgtcacaatagcacaaaaggacacctgagggttagaaaatgtaagaaataattctgatgtggatcaaggctcaaccgcctagaaatgaagatggtgtgttcccttgactgctctgcagcgcacttgctactaatcaggaggttctattcccgccaaaagggttaggatagattgaaaacatgatttatgatagaggcaaaaatatagataacaaaggtaaatgtgtcgtttgaatgctatttttttaagaaaagaaactgaagaaaatgtgaactcagaaaaagaatgttttcatagagcaaattattttacataccaactgtatgaagagtcagccctctgtatccatgggttctacatccatggattccacaaaccatggatcaaaaatatttgggaaaaaataaaaaataacagaacaacaataaaaatacaaattttaaaaacaatacagtataacaactattcatgtaacatttacagtatactaggtattataagtaacctagaaatgatttaaagtacacaggaggatgtgtaggtacatactgcaaatattacataagggacttgagcatctgtagattctagtatttgcaaaggatcctaaaccaatccccacagattatcagagatgacgatactgtatcatagcgtaaaataataattgatatttataataaagattctaagttattaatagttgtatgttctatattctttaattaggtggagatgcttatagtacttcataaaaatatttcatacaaaattatacaaaaatgaagtttcagtgctttcattatctagaaaatttactcttgtgaaaagaattatttgcagcaatatcagataaatgaaacattgagctaattaagcaaaatattttgtataatttctgtctaactatttaaggaaagtgcttaaagagtactttaaacaagatttcaagaagctgttagtgcctgcattctccttggaatagttaggaataagcaaaagagaagatgagactccaggacaaatgaacaccattattaaagatgtggaggaatggacatatgaggcctgttcataaaaacatagagaccaacgtggggaataataattaagagtaaataaggtgcccagaatgtaaagagaggcttaaaagtcatgccgagaaatgtagttgtaacagaaagtgagatagagccattgaaagcttctgatctagcagcaatcttatgaaagcattatttaaataacactttgttgtttttttttaattcttttttttattatactttaagttttagggtacaggtgcacaacgtgcaggtttgttacatatgtatacatgtggcatgttggcgtgctgcaccaatcaactcgtcatttaacattagatacatctcctaatgctatccccctcccctctccccccaccacacaacaggccctggtgtgtgatgttccccttcctgtgtccatgtgttctcattgttcaattcccacctatgagtgagaatatgcggtgtttggttttttctccttgcaatagtttgctgagaatgatagtttccagcttcatccatgtccctacaaaggacacgaactcatccttttttatggctgcatagtattccatggtgtatatgtgccacattttctttatccagtctatcattgttggacatttggcttggttccaagtctttgctattgtgaatagtgccacaataaacataagtgtgcatgtgtctttatagcagcatgatttataatcctttgggtatatacccagtaatgggatggctgggtcaaatggtatttctagttcaagatccctgaggaatcaccacactgacttccacaatggttgaactagtttacagtcccaccaacagtgtaaaagtgtccctatttctccacatcttctccagcacctgttgtttcctgactttttaatgattgccattctaactggtgtgagatggtatctccttgtggttttgatttgcatttctctaatggccagggatgatgagcattttttcatgtgtctgttggctgcataaatgtcttcttttgagaagtgtctgttcatatccttcgcccactttttgatggggctatttgtttttttcttgtagatttgtttgagttcattgtagattctgaatattagccctttgtcagatgagtagattgcaaaaatgttctcccattctgtaggttgcctgttcattctgattgtagtttcttttgctatgcagaagctcttcagtttaattagatctcatttgtcaattttggcttttgttgccattgcttttggtgttttagacatgaagtccttgcccatgcctatgtcttcaatggtattgcctaggttttcttctagggtttttatggttttaggtctgacatgtaagtctttaatccatctcgaattaatttttgtgtaaggtgtaaggaagggatccagtttcagctttctacatatggctagccagttttcccagcaccatttattaaatagggaattctttccccattgcttatttttgtcagatttgtcaaagatcagatggttgtagatatgcagcattatttctgagggctctgttctgttccattgttctatatctctgttttggtaccagtaccatgctgttttggttactgtagccttatagtatagtttgaactcaggtagcatacctccagctttgttcttttggcttaggattgacttggtgatgtgggctcttttttggttccatatgaactttaaagtagtcttttccaatcctgtgaaaaaagtcattggtagcttgatggggatggcattgaatctataaattaccttgggcagtatggccattttcatgatattgattcttcctacccatgagcatggaatgttcttctatttgtttgtatcctcttttatttccttgagcagtggtttgtagttctccttgaagaggtccttcacatcccttgtaagttggattcctaggtattttattctctttgaagcaattgtgaatgggagttcactcatgatttggttctgtttgtctgttattggtgtataagaatgcttgtgatttttacacattgattttgtatcctgagactttgctgaatttgcctatcagctttaggagattttgggctgagatgatggggttttaagaagagactgaattagtgagactgaagataaggaagccagtgagcaagttcttggtgtcacccagtaattaagttctgggatattattggaaaatgatccttccttatttaaatattcaccaatacatgaagcaatcttatgaaaagagttatcatgtagacagtacacaactgtgaaagaaaaatatcttgggccctgaaaatcactaagctaaatagaaaactcaagctggaaactgctcagggaaaacctgcctcccattctattcaaagtcatccctctgctcactgagatagatgcacattctgtttgcctcctttggaaagtcttatcagaaactcagaagaatgtaaccatttgtctcttacccacctgtgacctggaaggtctctccttgcttagagttgtccctgcctttctggatggaaccagtttacttcttacatatgttgattgatatctaatgtctccctaaaatgtataaaaccaagctatgccctgaccaccttgggcacaagttgtcaggacttcttgagactgtgtcatgggtgcacgtcctcaacctcagcgaaataaactttctaaattaactgagacctgtctcaaattttcagagttcacacaacatatatgaagacacaaaagttaattagtattgcttcaatgtctccagccctttactttcttgcctaccaaagaaaattctagcttagcccattctgtccttcccatcatgctctatttgggggattcagaagggttctttggaagcttttcatttgaataaatcaacagaagagtcagaagtctgcagctagggaagaggttttcaggggattctggaaaatgtagaaagcataaagtatgggaatatcaaagcaaacattttactggacaatgttaaacaggcaacaaaaactttattcaagactattgcaatacagccattttggagaatagtacagtggttcctcaaaaaactaaaaatagaattactatatcatctagcaataccactgctgggtatacacaaaaggaaatgaactctgttgaagggaagtctgcactcccatgttcactgcagcattattcacaatatccaagttgtggaaacaacctaatagttcactaatggataatcaatttttaaaatatgtcatatatacacaacaaaatactgtttagccttaaaagaaaaaaaaaacaggaaattctatcatttgtgatatggaagaaacttgaggacatttagttgaaataagccaggcacagaaagactaatgccatatgatctcacttatatgtgggatctaaacaggttggactcacagaggtaaagtgtagaatggtggctcctagaggctgggagttgaggggaggaagatcgggaaaggggagatgttgttgaatgggtacaaagttacagttagaaggaataagttctggatgttctatttcacagcaaggtgactacagttaatatattgtacattttaaaatagcttaaagtgaagattttagatattctcatcacaaataaacaataaatatttgaggtgatggatatgctaattactctgatttgatcattccacaatgtaacatgtgaacaacactttttttgttttgtttttgtttttgttatggagtttcactcttgttgcccaggctggagtgcaatggcgcaatcttggctcactgcaacctccgcctcctgggttcaaacaattctgcctcagcctcccaagtagctgggattacaggggtgtgccaccatgcccagctaatttttctatttttagtagagatgcagtttcaccatgttggccaggttggtcgtgaactcctggcctcaggtaatccacccatttcagcctcccacagtgctgggattacaggcatgagccaccacatccagcctgtaaacaacactttgtagcccataaatatatacaattattgtttgtcaattaaaaataaagctttacaaaaagaatattgcaataggagaaggaggcctgaactcagtgtaaatgcaattcttctgaaacaaacacctgggaagtttttaagagctgagacagaagggtcttagaccatctgtgtttgctagttggttttacccaaagagagagtcaacattctcataccttcatgacaggagatagttttacaactggaagcaaggtgcccaccaaagttaggttcctactctcccacagaaactgggatacagaaggtctaacttccttgacaattacatatcaaagagatggctgtagatctttgagaaagacaatcctgggtggtaaaactggcagaaggcttttaaaaaagttttgcatcacaaaggagcagtgaaacatttataattacaagttttctaaagtgaatgttttaccttagaaagggagatcaggggtctagaggtcggtcggaagcagcctatttaaacgtttgggggagctgaaggaaacactaaggctatcttggtcaaatgcaattgctttgaataaaaaaagtgaaaaaaaataatttaagagttattactggcataaacaaaagtagtgctattcataatgtttgagaaatacaagtggaaaacttgagtttttattgtaaaggaaaatttttaaatcccagggtatccaaactctttatgtaaaagggaagtttaagcttgaaggctgagtctccctcttccagatgactagctatgacaacattatgcatcagcccaagtaaaaggcctcaggcatctatgaagggccacccccacagatcatttctaagtaaattctcccataaacaaggacatcccaattgtaattttaggtctacaatctaagtctagctcctaaaactatagtctgttcaattccacactgaaaacgtccactacaagcttatcttcccaggtgcagaaaaacacaagatgagattgtctttgttcctctacctaactgatttttcctttactgccttttttctctttatttaccttatcttacataaaatggtagtctcacaaaaatgtaaccatttgccttactgcctacctgttcctcttcctacctacctgttcctcttcctgcaggtctccttccacccactttaatgaaatagataaatactaaacctcctgaaaagctccttggaatgacagccacagatatggcttatgattttcccagatgtgccctaaaactggcttagtaaacctcgaatgattgagatttttgtctctgttattcatttcagttaccattatgaaattattttttggttatagtttttctattacaatactacatggggactagactgtaagcctttttgagtgttacacactagtattaaaataccaactgccagaataaaaactagcacatccgattaaacttcgagtagcctcccaaaaatgatcctaactgaaaattattttccaaagaaagaaaactatcttgatctgagatatgttgataaaagaaatcaatacattagaaaaagtttttctaggaatccagaaaacaaaatttaataaatagtattaatattgtatcccaatgaagaaaatattgaaaatcttctttgtctgtggctattaaaatagctggtgagaagatatcccatttaaactatatcctctaccaacctctctgtttaatgaagatgtacaatattatatatttgcaagttcttagaaaagaagggaagatttttttaattccaggtacataaggttacatatgataaattgtttttttctagcaatgttggttttacactcacaatgtttcattaagagtttcacatgagagactgaagacaatccataattggcatagctgttttctttctccaacccagtccacaccaccctcacaccaacctatctgcttgcatgaatagacaaaaatgccaaaagatcctcaactcaggccaaattgcacgaaaaaaaaagttactgaagcaagaaagtactaaagattgtttcctctgaagcctttatgtgacgtccctaacctgcaaagtccccaacctctaaacttcccatattcttgctcttacagtgtcaaggaaatggactggactttttgcatatgaatgaatgggtaagagtaggaggggctgtaaaaggaggttccctcaaagtctccattaaatactcattaaagtcctcctctgtaaactgtaactccctcatcagacatcactgatcatctgttgggcttaatgacctaccaataaaaactaatttgatcttaattgaatctcaatgtgaatgtttttttagaaataaacaaattacaattttctatatataccaatttttctcattgctgccttttcagtgacttttcattaaacctcagatactggttcatcaaatgagtaacatgttatgggcttccttatttctctaactccctaattccttcttttcccatattttggggtactggaaaatttaggaatcaacaagcaataaccaaacaattccattaataaatgggcaaaggacattaacagacactcaaaaaaagacatacatgcagccaaaaaagatatgaaaaaaatgttcaacatcactaatcattagagaaatgcaattcaaaactacaatgggatatcatctcacaccagtcagaatggctattctttaaaagtcaaaaaataacagatgctggtgaagtggtggagaaaaggcaacacttatacactgctggtgggaatgtaaactaattcagccactatagaaaccagtttggagatttctgaaagaagttaaaacagagctgtcatttgacccaacaatcccattactgggtatgtatccaaacaaaaataaatcattctaatagaaggacacatgcactcatttgttcattgcagcactattcacaatagcaaagacatggcctcaacctaaatgcccaacaacagtggactgaataaagaaaatgtggtacatatacaccacaaaatactacacagtcataaaaagagtgagatcacatcccttgcagcaacgtggatggagccggaggcctttattctaagtgcattaacaaaggaacagaaaaccaaataccacatgttctcacttataagtggaagataagcactgagtacatatgaacacaaagagggaaataacagacaccagagcctatttgagagtggagtgtgggagaagggtgaggatcaaaaaactacctatcgggtactatgcttactacctgggtgatgaaataacctgtacaccaaatccttgtgacatacaatttacccttataacaaacttgtacaggtattgcttgaacttaaaagttagaagaaaaaaattaaattaaaaagaaaaagattctgaaacctgttggacagatttttaaaaactccttgaagttgctgcctaccccatggaaaagcaaaatgaatgcaagaacctttgtctttttcctcataataaacgaaatgtaaaagaggacaggtgtcatttcttcttgcaaggtaggaacttagaaaataagttggactagaatgtatttatttatgctgataatgttatctttacaatttccctgctttcagaaaaaccaaaagtccttatccgtccactcaatttaacttgtcaaatattcatgagtacctctagagaaaatatattctgctaaacactgtgggagatttaaaaaatagtgacacatacttgtgtcctaattgtagaaataagacatgtttacaattttatttcaaggctgaatgtgtaaagagaggcatataaaaagtcacatggatggttcaaagggaaaaatagcttccctccatttgaagagaaccattctgccagtctagttctgtgttaagatatgtgacttcaataagtttctttgaccagggagcataaaacaaaaaataagtgtatattaattattagtgatcagtttctgagttgagagaaagatctagagaacttggaccaaggggcaagcaagttttcatattgctctagaggacagaataaagatttggatctagaaaaaccttggaggccaatttcaaaggtttatagtgtcaaattggaaccaaccaaaatgtccaacaatgatagactggattaagaaaatgtgacacatatacaccatggaatactatgcagccataaaaaaggatgagttcatgtcctttgtagggacatggatgaagctggaaaccatcattctcagcaaactatcgcaaggacaaaaaaccaaacaccaaactatatataatatatattatatataaacaatatatattatatatattataaacagtatataatatatattatatataaatatatataaaaaagaacaaaaaatatatatatatatatataaaagaacaaaaaaaagaagtttaatagtggtaaattgtggacattgagggatatagtgtgaaacaaatacagggttgggtcatcaaatcagattcacagcgatcagagatcttacccagaatcaaaccatactaacaagtttaaagagaaagaaaatcatgagagaggggaaggatggagaagctgggatagccagtgtcactttcaggtcattttgtgatgcattagtatctgctctgatctagatttaacatgagctctaagtgttgcatgcaaagcactgcttacataaaagcgagccatcactgtcataaaatatcttaatttttttttttttttttttttagacggagtctcgctctgtcacccaggctggagtgaagtggcgcaatcttggctcactgcaaactccacctcccaggctcacgccgttctcctgcctcagcctcccaagtagctaggactacaggcgcccgccaccacgcctggctaattttttgtatttttagtagagacggggtttcaccgtgtcagccaggatggtatcgatctcctctcctcgtgatccgcctgcctcggcctcccaaagtgctgggattacaggggtgagccaccgcgctcggccaaaatatctgaattttattctcagttactagtttgtgtgatgttttccaggtagcctgccctataaattcacacatttccaggtttatttaacataagcaatcctagacagaccagatacatgtgcaaaagttctccacatgtaagaattctcccactattaaatagcagcagatctttctttagaatgtttacaagggtttttgatggatcttttcttccaagggcatcccacagcagggtgagaaaatgacttgtaggtctatggctaacatttttctttccagtccacactctgactttagtcactaatcccttggtacatatttctcaagcatcttttcattatttgtcttaaagtattttatacagatgaataagtctactaacatcctgacaactaccatgttttgaaacatccaatggggagtaggaatgtcctctacaaaggatgttaattgcaactatatgtttttcacaagtcttttgctgttctcttacaagtttgattactctttttcctctatcacctatagttatttgaaccattgatatgtgttgatggaggcaaacaaagttgagttcacttttatttctggccaattggtttccatatgtaacatttacagtctccaagttagcctcccaaagtattttctaatctttgtaaaattctatcggttaacaaggcatttgttatactatatagctgtgacagcaagattaaagtaacatttaacataccatgaaattagataaaaattatagtgtcattccctcccaaccattccctcccaatagaaatgatattttttccatgtgccacatgtttccaaatgccttaggaggttattgttcagaatattctagattccatctggtttttgatataaccatatccctgctaccagtgtgcaggtatttacagacacaggtttccatgtggcattttttaatatcctccttctatttcccataattatgacacagtgtgttcactatctgttttatccaaaccaattacaacctgaaagcaaactcactttgcatttgtgacacctaggtcattagaaaatgatgatagaagtctcatcgtccagtgacaacctgctataatttagaattagcatagtgttcccacagtgtaccttcccaacctggcttttgaccactcttggccactggcctttgaaaacatcagaatcaatagtgactagagtatctgataattcttctttgataagagtatgaaccctttcccagggttgccaatgattatagcagtccaatagaataattattcaattagtttatttacttagagctttagaatcccctcaaagtgatttttgtggccaacctcttagaaaagcactccctttagtgtcactgtttgggttatcaagtctttttcttaatgaggacaatcatcccagaacattatttcagactgacctacatatttatttcaaaatcaaagctatcccaaagccatctcttaaaatctctacagaacatctggtatggcatggccattggtgatcaagctaccacatatgttgctgccatttcacttgtatgggattggtaccatttggaaaaacagtctgaaatggaaaattttgtgtgccccatgaggctatcagttgtgtatattttacctgcaaacacagttccatcttactacacaataaggcttcccataaacatccttatgtacctccagaagggacttattagtaatataggattactgggttccatattagcttttttaaagtgcatttcatccacattcacatttgatatactcgaaggaacaaaacaagctctaatatacttgacaaatggcatcaatctgctttccatcatatccagatagctgttacagcaatatgtcaccatgacttaagcccacacggaattcttaagctctgctgtttggcattctctgccctataagattcatggtagtatttatctcaagtcaactgagaaataaccagaatggcaaattcagcttgtaaacaatgagctgaatgatagtagtagtcagctgtcagtaagttgattcatcaggaaatgctgtgtcacttcttttcttaaattacccaagtggagtccaatttctcttccttagacaaaacagatgaggaggtttctcccatacccaccattactcattgccagacttgagagagatagctaagagtattcttctcttgtccttattacattcctctctgggatcatgtcccacctctgtttgctgtgatacactccatttccatttataacctgccccctttatcctttttcccacggttgtgtttcttatctgaaatgtactgttgaaccataacactggcaataacaaaatctttcctaatgctgctccttggcctcactccctgggataacttgtcaacccataacatctctgccattcaacagaatctagaattactgacatgtccccattcatcaattttaagaatccacaacaataattaaagaatgtgttacagggtgttgctaacacctccttttccattgcttaagagaaatagggcaggatgaagggagactgcatcaaatgggaggcagaagtgccaaatttcagccaaattcagctttacccaggatcaaaatttattaacgtaatgactcaatttttatttttatttcattcaaagtttatgacgtttcttttcttaaataacttttttattgattatgaaataaatatgtgggattaggttaaaacattaaaaccaaattgacttatttcttctgacattctatagcagacataagtattctctgagatttttggaagaacttccttgtatgcagaagttccacagtagctgttaggagcaggagtaaaattatgactctgggagtttaatcactgcagtccttgccaggccttcacactgaagtgctggaaagctctgggcaaattacttactctctcagtgtttatttctccaactgaaaattaggttgatttctccaactgataattaggttgaactagtaattttttctgtattgtttgtgatattttaggaagatatcacccttgacggttttctatgacttaagaagttgaatcaagtttcaacttcttagcaagacatacaagttacttcaaaatctgtgacctcccctccaccgccaaaatgcttcattttaactcctattattccctttatgtacaccaatgtcagcaaactttttctgtaaaaaccgagtagcaaatattttcaccctggcagaccatatagtctccatcagaactacttaattattttaacacagagacagtttcattttcacactgctgataaagacattcctgagactgggcaatttacaaaagaaagaggtttattggacttacagttccacgtggttggggaggcctcacaatcatgacagaaggtgaaaggcatgtctcacatggtggtggcaagagacagaatgagagccaagcaaacgggtttccctttatcaaaccatcaggtctcgtgagattcattcactattaggagaacagcaaaggaaaggcctgccccccataattcaatcacctcccactggtttcctctcaggacacatgggaactgtgggagttacaattcaaaatgagatttgggtggggacacagccaaaccatatcagtcagctatagacaatacgtaaatgaaagagcatggctatgttctaaccaaactttctttatggacactgaaatatgcattttatataatttacatgtcacaaactactattctttttatttttttcaaccattttgtacagctcatgggtcttacaaaagcagtcagtgggctggatttagcccttgagccatagtctaccaatccctaatgtatactgtgcttacatcatgcaaaatgtctctccatttcctaaataattaaagtattttcaaggttcaatgccattgcacataaggattcctttgcctaaaacatcattatttccacaccctcattttttcctgacaaattcctacaggccaatcaaaggttgctcacctagtatccctccccaaatcttctgcaatctttctatctcaatatgacaggatcaaccattcagtgggttaaaccaaataccttactcacgcttgactatttctctcacatctcacatgcaattcatgagaaaaatcttcccagtactattccaaaatacatcccaaaacctacacttctccgtatgacagtctgagacaccatcatctctcccatagactgtttccaacatataagccagagtgctattcctgaaacatgcttcccaagctcccatctcaggacatttttcatttgctattgttcatgtcacaaacattcttcccagagatatttccaaaaatcattcacctgcttcaagtctttgtgaaaatggcaaaatttcagagacaatttctaaacactctctaaaaatttcaaactccaccactcccaaaattccatatcttctttcctggtttatttccttcttcacatttacagcatttgacatatgatatgttttactttttggtttatcatctgtatctctccaccagaatgaagtttcacatcaggaaattttgcctgttcgttcactgcagaatcttcaatgcctcaaacatcatctaccacttggtaagtttattcatcacttactatgttacagattctattacaggcaggctcactttgcctgaatcctcaatgtcaagtccttatttaacatctccgtgttctgaatgttccttcaaaattcatcattgcagagaaagacaactcttatacagtgtcgatgagaatgtagattagtacagccattgtggaaaacaatatggaggtttctcaaaaaactaaaaatagaactgccataaaatccagcagtctcaaaaatatgtaggtatttacccaaaggaaagaaaatcagtacatcaaagggattcccacatctgctgattatcgcagtactgttcacaattaccaagatatggaatcaatctaagtatccatcaacagatgtatggataaagaaaatgtggtgtatatatacacaaaggaatactattcagcaataaaaagggagtgaaactgtcatttgcagtaacatagatgtagccagatatcattgtgttaagggaaataagccaggtacacaatgaaaaatatcacatgtcctcactcatatgtgggagctaaaaatgttgatctcatggacatagagtaatagtaccatatgctgggaagggggtgggagaagacaggttgctcaatgggtacaaaaatacagttagacagaaggaatacgttctaatgtttcatagtaaagtagagtgaccatagttaataataattcattatatatttcacaacatctagaagatttgaaatgttcccagcacaaacaaatgataaatgtttgaggcgatgactatcctaattaccttgatcattacccattgtatgcatgtatcaaaatatcacacatttctcaaaaatgtataattattatatatcaataaaaaattcatcataataaaccctttaaaatcaaggaaaaacgtattcagatctgtcatgactctatgccaaaaactcacattggactctactccaaaattttccatgtgtaccatattacaattttagggttttattaagccttttgggaacatcagagacataaacaataggtgatttaaaatcaaaatgaaagtatataatgcattttaatgactttaagattaaaatattcatttctgttaccaactattacttttttagcatactctctattagaatctacaacttcaactcagatttttgctacattaaaccagtcttaagaaatatttttttacccaaatacaaaagtggtcaatcaaaccacccactcatttactacctcttgaggatacttttaaaaggctcagttagccaaaaagccacttttcttctagcaggatatatatagacattgaatctgaataaattactggactaaacctgcataggcaagtaacttagtgcttttatgtagcaaagtgtttgctatatattgtacaacgtatttgacaaaatcatttgattctgttagatgtgctcatcttgctatggcagacttcagatattacatcattgattacatcatcattacaatcactttaggtttgtctccaaccttgcctatttaattcctttgacccaaaatcaaaaaaataaaaacagaatattacaatgcaacgaagagggagaaattcaccaaatgtcagtatttagttactaaatttgataaatataaattattgatatatgagtaacaaaaattaatttttagtagtgatcagaagatataaaatcactaggaaatcttaactcaaaaaaatttccacataagattgaatctatcatatatctatttcagagcttttgttggtattgggcaatttgaactgctttaaacagcacaaaccctgtttttaggttagggccaaagctgcaactgacaaacatgaaaagaaaaagtccaagatatcatcacagtttatttgtgaaaattaccattatataaggataattctccataaacacaaaataaataaaaatttaataatcttactcatcactccttgttgagggataagttaatatatttaatgagcttggaacagtgtctagaatgtattaaactttaaataaatgttggttattgttgttttgcgcaatgagagtagtactaccagaaactggaaaacgcacaacctatatagtttgatattccaaggtaggttcttaaagccacagggtaaatacacatctttatagaatatcagttttaacttccacaagcaaatcaaattaatttaaaacttttaaattaaaataaatatggatatactatgcagttaaatacaacatgcaaattaatattttaaataataaactatatttaaaagaaattttcccattcatggaggagagtttcaggatgcatttacaaacctagctcaatctcttcctcttagggatattttggtaacaaaacaggctttgacaagcattgctttatgaagcaccctctttgtgcctatattaataaaaaaatagcatatgtctgccctcattctccatgtagaagagtaaatcttatcaccttgctctgtctagctcttcaaggaccaacatttttttcttgctgccttcttcaccaagggtatgtggaagcaaacctgagctaatccttgcatctacaattcttttactttgaacattgcagaactaaaatttactaatacctacctgaaaactcccaaaatgcatttgttttttaatatttgattaatagattataattaggaaagagtaagtaccatatatttgcatcttgatgaggatatttaaaaggaagaaatcaaaataatgatttctggtgtttttgagaagttctatagaatttagtgtttatatcttgattacaaagcctcttcataatttacaagttgtgtctcagctctgcctcccatttaaatctgattaatccagatgaccttgttctaacagcaggtgggttactgtgatttattttggggaattgctaatgagaaagaaaaaatgttaattataaaatatctgtgtcctaggcaaacaaaatataattttttgaggccacatatttgaggaattatatccaaatctggtatatttaagactttctacactgagttgaaaaatatcagaatatccacctctcacagaaagaatttaaaaatgaagtacctagttaatatcaaaccctgacaatgtgtactaggagaacaaataatttgtgaaattaacttataaccacctgatatttagacctaattgtttatatttgtattttctagatatacttgtgtatgtatatctatgtatacatatacacataataaacatgtatatacaaaaaattattaaacttgtaccaaaatattctagattaatgtaatatatttccaccaggtgaaactaataaataagctgaaatgagagaaaatatgtgggttttgctattttttctgattctaaatttcttgagtgaaatttacaaagtcagaatatattgccaaaaattatgacctagaaactatatttcagaatggttaatacagcagtcaaaacatgtgacatagaaagaacacagcattcttataccttttggatgctggtaaattttaatttttttttacttctacaatgattacattaataattgcttaataatgtcgttacactgtatatttatgttttacacatgcctttgtatgcacatcacattttacaattaaaaaggattacctgaaagaaaaagataaaagttgcaaaattatttactaacaccataaagagtccagtaagacacctagaaacgaaatcaacttccctataggtcactgtttttctgatcaatagcaattgctaatagtgtagagtaactaaataattaagatacttagggaaacatctaatagggaatatttgagttttgcatgaaaaaaacataaaagtattgaagaatttttttaaattctgaataaatagacatactgttggataggaagacacaatatagtaagcatatatatatagtaagcatatatatagtatatatgtatatatattgtgtatatatatggatgaatctatgagtatatatatataataaacccccaattcaacatcctatattttttatttgaattctaaaaataaatctgtttttacaatacataaactatatgtttatacttattctggtttttattataaaaaatttcaaagacacagaaaagtaagtttatttttatagggtgttttaaaataaacactaagcttaatacttagacttaacaatatgtaaccatatttgatttatttattcatttatgtatttgcttgctgtaataaattaagaatatcacagcatttctatcttaagtattttagtatgtatttcttaaaaaatgaaaatatgtttctgcataaccaccataaaagtcaatatctaacaaattaatattatctagttcatatttccttaactaccctaaaaatggcttttattgctcatttgttcacactagaattaagactgacatgtgccatttggttaggccttttaacatagacttcccctgccacttcaccacttcagacacacacacacacacacactttttcatttcttatcattgacatgttgaccaagatagttatgtcgaatctcccatattatgaactatctttgtggtttttctaaatgttttctcatggtcttgtttagcattttcttctttattctctgtatttcccaaaaaataaaagttagacataaaagcttgattagattcaggtttaatacttttgacaaaaatgtttaataggtgatgctgattctgcttatgaaattatagaggtacaaaatatctggttgtccactgcgagtgttgttatggttgatctttgggttcaggtggggagagcctgatccctccattgttcagttacatgttttccttttgcatccttaaagtattctgtaggtagtacttttccactatgcaaatattgagttcctcagcaacctttcacctaatggtttggcatacactgatgatctttgcctaattcaattactttgttatgaattacaaaaaaagtggtttttctaattgtattatttattccatagttattaatttccattcttcaaaaaatatatatttttgagataatttgtctacgctgaaatacatttccaattagaatgaaagaataaatgcttatttctttctttttaattagcaatgtatatgtctaaaaggtagtgtaatagtcacctctaccagtaacaaataaggttggtttttgtgttttctcttctctgatatcattatgtatccacgtgtttcaaagaattgtaactattattctttcagtgataaaactgtctcatctttttggccaagagagccccgcaggctggttcctgtgccgtgttgaaaaatacgtcattagtctttgaaagcttctttgctttctggcacagcaagatcttcctggctcaccttttacattcctttttacacacctggaaactgccatatctctaagaaaccttgttatttgtggagagccatatttagagaccacagtcagggtgctaaaagggttcattgctaagggtaatgcttcttcaatctccctttctagaacggtgctacaaaatataatttgttattagaaaaaaatcataggttcacatgagtattttcaatgcacgttgaacatgacagggttttcagttagattatttgttattatactgatttattttacccacattaaattaaaataatactattattaaaattaaaactacgaagtaaaattattagattgagtgaaaaaatatactttctaatccttctaacatagcagttcaaggtataataattaaaccatagtggtatgagtacagaattattaaatatagatcagtgaaagaaagttaacatttcagaaagatttaaaatgacattttgaattagtggtgaaatatgaacatccactaaatagtatgtgtacaaccagctacatgattggaaaaaaattgttaaattcttctgtcataacatacataaaaatattttttacttgaattcaaaagctaaagcaaaatcaaaagcattataataaaacacaggaaagatgctttcaatcagatagaaagaaatgccttgttaaacaagatgaaaagctagattttattaagggaaagattaatagacaaatacttgaaaaagacttgaaactagataaatacttgaaacaaaagtttcaaatacatgacattacgagaaatattcacaatacattatctagtgtatcatataccattagataatacaggaaaaactcctataaaccaattttataaggagaaaatgtcaattaaaaatgataagcatatgaatatgcaatttacagaaaaaatacaagtaaacatctgaaaagatgttcagcctaatatttaagaaaatgtaagttaaaataatcataagatcatttttggcaaaggtattatcaaaaattaaaattaaaatggttaaatgttagccaggatgtaggaaacagaaattcccagagttatggcaggagcataaattgggtcatcttttggggagggtagtatgttaaccaaccaaaatgttgaatctttatgacacaccagcttcatttctggctatctagccatagaaatacacatagttaaaaagattatgtgcaggaatatttattaaagcattgttcacaatacaaaattttgaataactttgtttatccactgatgtataagcagcttagaaatgtatggtatatttagaacataaggaaaatatatgtgtgccagtttcatatttatggcacagaatatgtatggtaagatctaatgtatttttcaaaacatatatgcaaaaatatgcaaataattgcatatgctatatataaagaaaggggtgaagacttgctctttgtcatatgtaaatatgaattgataacatctctgtagttatgtgacaaggaaagaacagctagcaacaggatatattttatagagaaaacaattttttgaaaaataacctaataagaacttaaaataaatggcaaaacccagaagacagatgttggtttatacaaagatttcagagaatgggtgatactgctgtgcatgacccagaagagtaacattccagagaagatgacagaacaaagcagagagaacgaatgatggtaagaaagagaaagatgaaagacgagaggatgatcagtcacaactttagtggtaacatggctaagaagtactttagataagaggaaatctctaaaatgagatttttagatgtttgcatagagcaaagaaatttttcctggagacgtacaactcatggcaaaaaggctgccctatgtgagttatgttatctataaatgctttatgtgagttatgttacctacataaaagctaaaataatactattaaaattaaaactactaagtaaaattattagactgagtgaaaaacatagatcttaattcttaaaccatatcacttcacagagcataaatgctccatgtgagttatgtttctgtaaaaataacagtggagaggttgtcgtaacctttggggaacaagacaaacttgtcacatgtgatgaagcccctagacacaaaggtggcagtaagaagtctcgagatcgcatcactgcactccagcctgacgacagagcgagactctgtctaaaaaaaataaaaataaataaatgcttttaaaaaaagctccaaggattcagagaaagcttaatgaaacctgtagagacagataaagcgtggggtagagtttttacatcattttgcccagctttcaatgacccagcataccccagacaacatctgaattgtatgtgcttctggattgcttgtgtttgggcaggggggttgtttgttttgctataaaaatgtgtttctaatgtatgaagagaagggagaaagaaagaaagctagggaggtagagaaaggaaaagaggaaggaagggaggtaaaaataaaagaagacagggattactatggcttgaatgattttgcgccctccagatttcatgttgaaagttaattctcagtgcaacagtatagagaggtgtggcctttgggaggtgattgagtcatgaggcctgtgccctcataaatggattaatgctgttataaaagggcttgacaagggggttcattttcttttcacccttccatctttacctccaggtgaggacacagccttctttctttccagaggaggtggcattaaggcatcatcttggaagctgagagtagccctccctagacaaccaaagctgccactgccttgatctcagacttcccagtttctagaactaagaaaaataaatttctgttcttcagaagttacatcatcccaggtattttgttataatagtacaaaaaggactgagacatagatatctagcactccttaatgaactaggagaaaagctatctgaataatgtctaataatcactatcttccttctactagttcctcctttaccacccctatttcatttaataatattgctgcttgctcagttgcttcaccttaaactttactattatgttttattcttcagtactacattattcttctccccaattagttgcaacatcctgatgaatcaacctcgcctaaaaataagtcatcttccacctgagaaaagcatcctcttcacctcagagcttcaagaagaaagtacatgtggtgcagaaaaagataagatattcatctaaccagccaaatcaggcataatcaactttggtagtgaaatagtgacagatggtgcaggctgttcaactgcatattcaattccattattccatctcttacatgcggcccctcttctcctttctgactgccactgtcctaactaaagtagcatcacttctcacctggacaaaagcaggtgcccaacttctggcatctgccactccattctgtgcagagattctagatgaatatttgtctcaatcatttgtaaggcactgaaatgacttgggctaatgtaagcagaaaaagaattgtgtacagaataccagaaggccctcagaatgagttggaaggctatagaacaaagctcaggaaattaagaaagatcaagtaacgccagggagggagaaatatagtcaaggtcatgtcacgagaagacttagggcagacacggccactggtgccaatacaatggatgatcagcagtaccttggctagatacactgttaacattatagatcgctgtatgtcactacatcatctcattaatccctcaagtcaaagaattacataggagtttctaattggctgaattaaggcgaagtgtctccttcttcaagtgggaaggataaatgtctgccctctatttggtttctacagtgggagacagaactccacttcagattaatacataatagagaattctccccaaattggaatggtaattgcattcttggtagccaaaaataataataagttttcactgcattcgtctttaaaggaaaccctaagccttgttacacctctttcaaactcattactgactacttattgccaactctataaaatctacatttctaaatataagtaacatctaggcaataatcaaaccatctcttgaattccctttctagacttctttctttgaattgattcttaacagaccattcccctattccattgtttctattatatagttcttcctgctggtaattatcttccttaattctacttttacaagcgttacaccaccttcaacattccctgaaatgcaaccttttccaacaattccttgtttcctgttaacgtctccttttccagaggtctgtaatcaattcttacgattttatgttgccttggcatccattttgaatatgtttacttttctcatactaaaagcagggctcagtcacccttggcagttttacagccccacccaggttcctcaatgtagtcagtccagatgtctgctttatacaaattcttcctggcaagcacctccctatggaacagctagatataacctactctactggccctgctgaccctcactgtcttcatggactgtgcagatataccacagtgaccgcctttcagtcacactgtgacctcctagagctcatgcctgcttgttttaaacttaccaattaaaactccttcaggaaacctttttggataatgccctggtccccagcaaagtcactgacccatgggcttctctctctctactccctctcccctggtgctgactgatctccaggcatgttgtttacccccagagcctgtaagtaataaaatctttatttctatcttgtgtccctcctaatcatttaaggggtgcttcattatcttaaagaccctaaatttaaagagtcccaatttataagatttaccttcctcccaaattatattttaattatttgtgtgtgtcctatctctccctctagattgcagtctctcaaagagcagaacatgatttatttttcacatttcttcaaacatttttcacataggtgcctaacaaatgctgagctgattgtgcaaatgtagcattcaaaagcaaatataaaacagaataattcacaagcagaaatggtttacagaattaccatggaacaaaaagacgaggatgatacaataagagaagatgagctctactttacaaaagctctttgcaaacacaaaagtctgagcataagtcattctttatgcatttacctaacaaaagtattcattttcaaaaagattcactatatcctttaaaaagtaaacttgctaggagtattaaaatgtcacttgatttgcaaaaatagttattttaaatatctattgtataaagaaagtgcacatgtacataaatacaaaggatgaaatcttttcatcaaactcctactcttccaaaaatactctctctggctctgtattctacgactaaacggagaagagggacaatgagctgatttagcaggcagctacaaatggtgattgaaggatctgaaaaaagatctattaaaagaggtcaagagaatgaatattattcagcattaagattaaaggttgatttgagacaatttaataacaatctataaatacatgaagggctctcacacagggaataatcaccagctgctctccaactccaatttggaccagaacaggagaaaaattatgttagataaaagaaagaattattgatagtaggaattatttaatactaaaatggatagctaaggagagttgtggactctcgtaccttgtaagagagctttaaaatgttgctgatgaaaacacacaacctgcctgtgggtaaaagaatgcactagataatctctcaagattatttccccatttctagaatcagaggttttaaatttatttctcttttagaaaattttacttttctttcaatttcttgtattgtctaaggaaaactgtgttgaaagaataattttaggatttggttatattctaattttcttccacatccatctttaagttctgccattttgatgataactttctggcatttatttgagtgttaaacttagggagaaggtgagcaagaatatatgcaatataaattttgaaacattttacagttagcttctcttatatttcatacccaagaggtttctagcaaagtatgactcttccacctccatagttattccttctcccgtgtcccagagctggtatatatttggatcagggaattccttctgctctgttgttacttcccacaagttgtctgtgacatttaatataggtcaagaaaattaatagaaggaggcataaaaataatgttgagatagctacaacacaactagcctctaagttaactgggttgcatattacactgaaatttccatttgttttcaagtatgtccaaatgatcagaggaaactaaccaagtatgttaaaaatctcagaatataaggaaaactagaatttttttcactaaatatctactgacaatacaatcaattagaggaagttaaagagttgttaaaacaattccactagtatattagttggagttctccagagaaacagatcaatagtgtacatgcagaaaggggacagaaagggagaggtttattttaaggaattggctcaagattgtgtggactggcaaatctgtataataggccagttggctggttacttgggcaagagttgatatcagagtattgggttacgaatctgtagcacaagccagtatgctggaaattcagcaggatttctgtgttacacaatcttgaggcacaattccttcttcaggaaaccttagttttcatcgtaacaacttcagctaattagatgagggccacccatattatttaaaaaaataaccatttttatttcaagtcagctacttgtagatgttaattacatctacaaaatactttcacagaaacatctagcctagtgtttgatcaaactgggcaccatagcctaaccaagctgacacataaaatttaacattcacaaatgggtttctcaattttaaatttagtaagaaggagttttttgctgatttctttgctcagaaatccctgtaatgaactcattcttgataataaatatgggcaatttgcaaataagtcaatttgcttattcattcatttagtcaacaaacgcttgttgagtattcccatgtcctagcaccattctaggcactaggaatgtagaaatagagaagaaaaataaggccctcaccatcatagaccttattacattcatcttgtttggagtacttatcactattcaacattatattgtatatctattagcttatttgtttattgatttacccccacaataatatcattttcaacaagttagggacattttctgttttatcattgctgtatgcccagcatacagaacaggtccaagtagataataggaaatgaagacgtgtgctaaatgaattcaagaatagcccagcatagcctttccatcttgaagatgataaaacaaagacccacagaggttgacttcttaaaagtcatacaattttagttattctaccaggaacagaccacaaatatctaggttcatatatcctctgataaaccacacatataaaggcacattcaacaaacatttataaaaactggtcaatgtatgaaaataatggtcccaacaaagaacaatcacactcatgaattagtccaagagtatactttattctttatcatcacccttcatgaaataatgtcagtttaggaaaggcatggtggctcatgcctgtaatcccagcgctttgggaggctgaggcgggtggatcacgaggtcaggagttcgagaccaacctggccaacatgttgaaaccccatctactaaaaacacaaaaaaatagctgggcgtggtggcaggcacctgtaatcccagctacttgggaggctgaggcaggagaatcgcttgaacccaggagatggaggttgcagtaagccaagattgcaccattgcactccagcctgagcaacagagcaagactgtctaaaaaaaaaaaaaaaaaaaaaaaaaaaaaaaaaaaaaaaaagaatgtcagtttgataactaaactattaaagtttagttcaattgctaaagctatctatctcagcattcctccgaaagtaacccgaccttcctactgaaatttcatttcatgtggctgaaatggaaccaggttccttttcctgggtgcaggaaaggagacacatgacacacctaggatgaatcactcagagcaccccagtcctcataaattggtttagagaaggcacatagcccaaggggaacccatcagaggccatctatgagagaaaggcccactcttcctctgaggccactaagtgtaaaaacccaaatgtgtgaagctgctggcagcaatctttttaattatgtggaagaagccagcctataaaggatgtcaagttattagagaggaaaacttaaagacagagaaagaaaaagatagaaacctaatgatatgacttaggggcctggatccagctgtgcctgaattttctatttttaattacttgggggcaattaatatatgtatgtttttattaagaacatttaatgagatgtgtcataaatatagttctacaaatgtaaactctatgaatgcagagatttttgtacattttgttcaccgctgtatcattagcacctagaatggtaccttagcttctgaaaggcattcaataaatttttgaaataataaatcccatgttcacgatgtgtacagcaccaggcttaaaacctgcaaagaaaatcaggccaagatttctggtagtgatgtaaattacaaagcccaaaagagttaccatgtgctgtgatacctgttatctcattaatcataaacacaggagatagtcgttattacaaatgaggaaattgagctcagagaggttaattaatttccttaaggtcatacagtaaatgatggagctgggcctgaagccctggtgacctgtctgactctactgtctgcatgtgtttcattcattaattacaatactattttattttgtaaaatattttgccagtgtcattagtcacttgacacacaacaaggaaaatttaaccaaaacctttgtaaataagaatttcaaagacctagaggtaaaacaacttttaccaaatcaagcagcaaggataggagagctgtaaatgaaatacaagattcaccacttatttagccctttgtgtcatatttcaaaacatcttctaaacactaatacaaaagaatacactgaaagtaaattacatacaaggaatatctgcaacatatctcatggaaccattcacagaatattagatttagaggctgggcgcagtgactcacacctgtaattctagcactttgggatgccaaggcaggtgggtcacctgagatcaggagttcaagaccagcctggccaacatagtaaaaccttgtctgtactaaatatacaaaaaaaaaaaattagccagatgtggtggaggacaccggtaatcccagctactcaggaggctgaggcaggagagttgcttgaacatgggaggcggaagttgcagtaagccgagctcgcacctctgtactccagcctggctgacagagcaagactccatctcaaaaaaaaaaaaaaaaattaggtaagaattagcaggtagttcttcccacagggttacacttaaatgtatgggtgtttaaagggtacttggtggccttgaatgtgattgtgtacaatttgccatcactcacattgtagaaatatgtttttctatgaccgatgacattgaaggcaatggttttgtttccttttcctgaaagatgatatctcagtatcaaatctgtccagttctgcttctgaaaatcatatagagcaacaggaataatgaaggagaaaaacagctacatttctagtaaaagtaggagatagagaaaacccaagattcattaagcatctgtaagcctgggcaatgactccctagaatggcagaattggctggggaacctgaaagagaactattagaaagtacaggggtggagaaggaagtacagaattcgcatatattagagagactgatggaaaattagggttgcagaggtgtttaaagatccaaaaacatcactaaaaatattcacccctagataaacagggccccacatgaatgggaaattctgtgggtacgtcagaaagtaaatggcaaaactaggaaacagaatatcaatacctagattctgggcaagtattgcttaatgaagaacccagcagaaaacaacctaagggagcagcaagggggctgcagggaattataggaagtgccaaagtcttgggtctggaagcgttcagaaattttgcacaaataactctttcaggaaggagtgttacactaagagaaaacttctagagaagccgctagatacgaagaacaggtttgctgaggtagcgagagcaataaagagacacaaattctggaagggtgctgccaaacaatttgtaaagtcaccttgtaagtcaaaggctgtgaggagatgtgggagagataaaactgaggttgggagtcttgctaaagcatactgggctcggagagtggctccccagaagaaaggactttgtttccagcccctgaccctggctccagaggagggaagccttgaattatgaaacctggaaagctcttttccaattcaacttcaccctaaaataatctcccatcaccagttcaggaaaatctgtttggtttaaactgcataacagaaaacaaatttggtttgtttccataccagcaaaggttgaaaataagtagctaaatttttcaacaagcaatgaaaactcaaaaattttgttttgaagcagattaagttataaacacacacacacacacacacatacacacacacacacacaacagacatagagggactcatagaagagaggcctagaaacaaaggatttgcagaactcaaaaaagaaattgaaaaaaaaaaaggactagataattttagaaacaaagacaaataagagctacaatgaacaacagacaccacagaaagattagtaattagagtataaaaaagaaatgtgaataaaatggaacatattagaaaagaagaaaggtttgaagagaagtggatagatatagaagagaagcaaagaagatccaacatgtatttgaagccctgggcagggggagcgggggccaagataatggaacaaagaaatatttgaaattttaattatttgtgacagttttttttaaatgagacataaaataaaaaacacatattgctaaatggtatactatgtatcagtgaaaacacccaggtcaacaccaagacaatccccacaaaaattattaaaaatcaaacataaaaaaaagaaagattatttggatattcaggcaactagatcaagacacttataaatgacagaaaaaaaagtggcatcagacttctcactgcaacaccagaaaacagtaaagaaacacctacaagttactcaaaaaaataaaatgtgaggcaagcattgtatttcaatctaagctcccctttaagtataaagacaatgatcttctgaacattaaaaaacccagggtatgtttctctaatttccctttctggggaatctactatgggataagcaccaggcaatcaagaaattattggagaaactttgctgaaagttgatggtgcacaataattacatttaacaataaaattgaggctaaaaatggggaagagtgctaaagaatagcatacaaatattagtatgatctagcaatataaaaataacacaaaataaaaatttaattaacacagagataagagaaaaaaagctaaattccttgattgtccataagttatgacctggaatattgatatttaaactcaaaaatctttagcgtatttgaaagcacaaaaatcaacactaagttaaagccattggtgaaaattagataatagaagagagaaaagggaaaggaaggaaaagtttccactctaaatgtattcttgatgataaacaatgtaaataaaggggattatttgtattatgtaagatattaatgtaaaagtaaccactaaaacaaattacaaactttcctaaatttccaagaattctaaaaatagaagaaaaaagcagatagcatcatgattgggaaaagcactctttcttttatatatttgcacaattacctatttatgaacatatatagaatgatattatagacctaggatcaaatattccagtcatatcaacaaatgtaaatgtggtgaactcatctaatatataaaaagattttcatattagcactcaaagtaaaatacaacctgataaggtacaaaagagaatcacctaaaacaaaatgactcagaagtattaaaattaaaggattggtagaaatttgcaaagaggctgttaaggactgaactgtgtttccccacaaaattagtatgttaaagtcctaactcccagtacctcaaaaggagactgtatttggagatagggcctttaaagaagtaattaaggtaaaatgacatcatttggggtaaacatgtatcctctatgatgtccttataagagaaaattaggacgtacatgcaaaaagggaagaccatgtgaagacacagggagaagagttcgatctacaagctaaggagagagatctcagaagaaaccaacaccttgatactggacttccagctttcaagattgtaaggaaaaatttctcttgtttaagacataccatttgcagtattcattacagcagaactagcaaactaatacgaagaccattgctctgacactcacaatatgaacaagccagataaactacaatttgtattatagtattttttaaatccatcagaactgaggatgcaaagagatacaaaataataaattttcttcttaggaaagaaaatattcagtttttgttccttcttagtagagctatagggtctacagagatacattccagacagaataaaaagaatagccaaatttttgatcaaacttttgatggccaagtatggcctggtatatgggttataatcactaggaataccaaacacaaagtgagtcttccctgctagcctactcttccaacagatctttgctgcatacacaggataaaaggctataggaagggcaggagggccgggggagatttcccctgaggttcacttgaacttcttcaagagtaaagcagcaggctagagaaagccatgagtaaggtacaactgctgaatgaaatcctttcaaagcactccaaaagataggaagagacagtagagaggagatagacatcccaaaatgcagaaagtagacagtagaaattgagaaaggataactccccatgacccaacaagctagaatccatggagtaagacaaacagggaactctcccctagttcaggaagttgactgggctgaatagcataaatagaatttcccagagaaagcaaagtcctgaacccatcttcagaatatttgtaaccaatggggaactaaatcaaggtaaagaggcaacacaacccagacccagcccagctacgggttagactgatttagccacacacatgtaatgttacaggagaatggagtggccttttttggaggtaaatatttacgagtttctaattttttttacacagtgttcagcatacaataaaataatcacaagatatgtgaaaaaagaagaaaatgagaggaaataatagaagatgtacagataatctagataatagaattatcagatcagacagggacagtaaaataaccatgataattttgctttttaacatttctattcttcaattgacaaataaaaattgtatatatttatcattacagcatgttgttctgaaatatgtatacgttgtggaatagctaaattaaactagttaacattgcattactttaaaacatagtagaaaagatgaaaatgcatagatgagaaatttcagtagataaattataaacaaaaaggaactaagttgagattccagaactaaattatgcaaaataataaataaaaaatgcattcaatgaagttaacagcacaccagacacagcggaagaaacatagcagagttcaagaagggtgaatagaaagtatccaatctaaaacagataaaaagagtgaaaaaactagagtacctgagatctgtaagacaatattaaacatttcaattggcatgtagttggaatctcagaagagagacattgtgacagaggaaatgttttaagtgataaccaaatatgtacaaattatatgaaaagattaagaaaactgtaataggtaattagtaaaacttataaaaactaaattaatggaaaaattttaaaagcagacagaagaaaaaaatatgaaacgaagaatcacagctgatttctgttaagtgacaaaagcaaggtacagaaaagcacgtaaaatatttacatgcttttgtaagaaaggacagaaggaaataagagaagatgatagatgattagatacatagacagacacatacatacatacatagaatggttgaatgtccttaaattggttataacttactctgtgtcagaaatagcatgaagaaaccataacatggtaacagtaatgtgatagtgattgaggatcacataaaatctttgtgagttcacaactagaaacaagctgtgacaagaatatcttgaaaagaaaaaaaaagaactcaactttaagaaataagatttaataacagaaatggtagcctttttccttaatgatatgcattggttttactactagtctctctaatgcccatgtaattaaataaatcaacagtttgatattttctcttcaaaagaacaatgaatagtatgctcgttttattaaatatgactttattgtgttattattacaaaaacaatatacattcataaaagaaacacaagaaataaagctaagtgaaagttaataataaaataattaacacccatggccatactaccaagatatcactgtggattatatcttcctataggtatgtaggtaggtaagtaggtatataggcaggtagatggatgatgagagataataatagataatagatggatggataactacaaatattaatatctatatagtgggacattgatgaagatagaaagatagaggttatctttctaaaactgaattatactacactacactacatctgattttaaataaataaaatcatgaagaatttcctttgcgaggacctcttgtcattttcagggaccaagacatcagcgttatcatttctgtaaaagcccactgaaatcagtaacaaaggtctccttctaaatgtgtgtgaattgctttcacttacaacttcaggaaagaaaacctgccaggacattcctaagagtaaaatccatgcttcttttcactaaatccaaaccattgaattagtgtagaccaagacaaacacaaaatatcacaataatgctttggggtatatacgcttcattaaagataatccactacaatatgacaaaacataaggtagctattctttctgcagcaacacagatgaagactttattttaaacccatagcagattgaatttttgcatgatgttttctttatactgccttgcttaatctggaaatacattaaaacactcatccacctgctgtgctggtttcagctgttgcaaattgatgattagcttcctcctgacaatattttcttctcacaaaattttaaaactgactgaaacaatgttaaaattctgaaatggaaaatacaacttatttaacactttaaaactattttacctttaaatcatttgaataagataaaactattaagattagaaaacattaattaggtgttaacttttaatgttttattcttctagatgaaattcataacattatcatcccaaagccaggtaaataggcataattattagctgcaattgcctccattaaatgccatcacaaaatgtgtaatgttggtagcagtctcagaatttgctggtaacttaaggcaagcttggttatcaaaaattcaaacagactttttactttctctgctatctgacttaaaggataagtattttcttttagtcaaatttaatttttgtatttaaaatttaatgagttgattaaaagaaaatcatgtagattaaaaaaaaattcttatatccagaaggttctaagcaagggttggcaaactatgacttacggacaattgcctctttttgtaaataaaatgttatcagagcacagccatactcattcatttctatattgtcattggcagattttactggacagcaaagttgagcaattgccaccaataatttatatctttcaagcctaaaatatactatctaaccctttaagaaaaggtttgccaattcttggattaaataaagagtttcaagccaactctgacccctatcacatcatactttttaatgtgttaagaaagagaaaaaataaaagaaggtataaaaacataacatggtctccagtttgaatcagttgctggattttgtttgttttaaactgcacctcagcattcagcatttcacttgtccctttaactgaccctgatctggtacgaattttcttcttagcactgaaatgtgctccatcacaaatttctgattaccattttgattaaaatatccaccatttttactgacagtatctcacacctgttcttatttttattcatatcctttgtatttcctacaacattaagactaaagaacattctaagatcatttatggttgaaaattatttccttatagaattctacaagttcctatgggtaggcagtcatagtggtcttggcaaactgaatatgccctaactgatgagcctccttgattactcatgctgactcacttgtatgagactcaaaatctttggattatcttacaaattttaatggggaagattttttttttttttttttgagatggagttttgctctgttgcccaggctggagtgtggtggtatgatctcagctcactgcaacctccacctccaggattcaagtgattttcctgcctcagcctcccaagtagctgggattacaggcatgcgccaccatgcacagctaattttgtatttttagtagagacggggtttctccatgttggtcaggctggttttgaactcccaacctcaggtgatccaccagccttggcctcccaaagtactgggattataggcatgagccaccgcaccgggcttgggaagaatattatgattgagtactcattgctattgtgagattaataagtagctgtagaagataaactagtcacacactgcattttttacatttcatttgacaacaaatttagaaaataactccaataagaataacagaacagaattagagaatgacagaaaaacaagtccaaattcacaaaaatccttcagagacattttttagtgaattctagttctgtgggttccaaaccttactacatactggatcacctaggaaatgtacacgacaaaataacctaaatacagtgggtgggctctccccataaaattctgattcagtagctctcttgtggtattctggggtatatagttttaacaaacatctcatgttgttatgatagatggatatggacagatatttggaaacatgatacagttgttttcaatactataacactaaggaatgatagtcatatctggttatttgtttgttcattcccaagcagcaatgttttgcaattagcttgtgtgagggttaattttatgtgtcaatttgactgggccatggggtgcccagatatttggtcaaaaattctgggtgcttctttgatggtgttttttaatgagattcacatttaagttggtagactgagtaaagcagatttcccttcatgatgtgggtggatctcatcaaatcagtggaagacccaaatagatgaaggatgactcttccctcggaaaaagagaacgttcctgcatgatggcttttaaatgaggatatcaactcttcctggttctacagcagcctttagacttgaacagggacattggctctacagattttggacttactagcctccatgatgatgtgagccagttccctataatatatcctttaggaatatagacaaatagataaatatcctattggttttgtttatctggagaacctcgactaatacactacggaaaagaggaaaatcaatccctctaaaagtctacaatcctactattacactgacctttaagtttaaaaaaaaaaaaaagaaggcccacaatctttcattgttattcagctttatcactgtcaagcccaatgatcctggacaattctcttggatcttgtattcttccattttctcacctgttaaatgttaaggatacccccctgtctacctcacagaattatgagggcatataccatataccttgaagaaagtaaaggagaaatatgagagtaaacatggctcattgagcacgcattcagttccactacctctgaagtgagaataatagcagcagggtatctttaaagaattataccattaaaaacaaagggaaatgaagaagagattataccagcaaaatttaagaagctggaaagcagaaggttcagtggtaaatgatttagccacacaagggaaagccaaatcctaaataagcatgtaaagttcatgtgtaacccaatttgcatggcagaattctcaaaaggttcaagactgagtgaaagtggaggtaaaattaggacaaaaaaatggaagatgaaaaaaaaaaaagcagaaggagtggttgacagttttaagacctaataagtcccagaacacttttaaccagataaccaccgctcccctcctccattagaaaaatggaagtttattctcaagaaaggaccttgggactaggggaccccaggcactatggaaggtgagattaccatataaaatcaagggaacatttcataccaaatattgcaagttccagctcaattctccaaatcatctcacaaaagactagcagctaagcttatactctatggacagataaatgaaagattctttatactgaatctgaccagaccaagagaaagaaacctcaagaagttccccaactaacatgccaatcagatacccaacagtgcattcatagtctcctacctcttccaagtacacagagcttgcagtcagcacattagcccctcagaaaacacctgtagaaagtctctaatgggaaaggcagacagaaacagagaacaaataaaactaggaataaccagcatcgatacagagagaaggaaagctttaaaaactataattaggtctatgatggatatgtaaagtggaatatgtttatataattaagtttctgattaacttccatcataatttcagagatttaacattccagtttttgaactatgaaaatattctgctcaagaacataataaaataacatcacaccattcaccataatacatcccttcataaactcagcagtatatatgtatttaattatctcacacaagcatgagactaatctgattgaacaatgaaagcaaggcaaaaaatgttctaaaggaagcattttctgttatactcaaagctaattccaattgggacatttgtttatgacacatatagggagaaatttgaatatacatatttgaatatatatgcagacacacctcatcttaatgcatttccctttattgcacttcacagatactacgtaaattacaaattgaaggttctttgtgaccctgtgtcaagcctattggtgccatttttccaacagcatgtgcttacttcatacctctgtgtcatattttggtaatttccacaatatttcaaacttcttcattattagtatacatgatatggtgatttgtgatcagtgagcggttgtgaccagggaatggttacagcaggccttggatgagacccagtgctgtgcaggtctcaggtctgacccagtgcagccgtagttgtggtggccacagcagtgcctgtgttactccaccctcagcattaggtggctcagaacagaaacaagggctccatttgtttgggggaaaaaaaagggaaaagaagaagagtctccacctggtaatccagagaattcttctgggttttgttcaagatcctcaaggtggtaccctctacaaatctgcaagaaccacagtgttacttggccttgggtacccctccaaagcaaatacaccttagatcacaatatccaagttctttcaaatatcttcaaagccttctcaagaaggatgggtataaacaagcccagatagtgaacattacaataaatactaaacacttcaatacccagatactgaggaacatcaacaagcataagcaccatccaggaaaacatgacctcaccaaatgaactaagcaaggcaccagggaccaatcctggagaaacagagatatttgacctttcagacagagaatgcaaaatagctatgttgaggaaactcaaagaaatttaagttaacagagaaaaggaattcagaatttgatcagatagatttaaccaagagactgaaataatttaaaagaaccgagcaaaaattttggagctgaaaaatgcacttgtcacactgaagaatgcatcggagtcttttaatagcagaattgatcaagcagaagaaagaattagtgagcttgaagacagactatctgaaaatacagtcagaagagacaaaaaaagaataaaaaacaataaagcacgtctacagaattttgaaaacagcctcaaaaaagcaaatctaagagctattggcattaaagaggaggtagagaaatatacgggtagaaagtttgttcaaagggataatatcagagaatttcccaaaactagaaaaagatattagtatccaaatgcaagaagcttatagaacacaaagcttctataatacaaaagcttctataacacaaaaatttgtgttatagacacaaatttaacccaaggaagatacctcaaggcatttaataatcaaactgccacagatcaagaagaaagaaaggattctaaaagcagcaagagaaaagaaacaaataacttacactggaactccaaaatatctggcagcagacttctcagtgaaagtttacagaccaggagagagtggcatggcatatataaaaaactgatggaaaaagattttttattctagaatatatctccagtgaagatatcctccaaacctgacagagaaataaagacgttaccaggcaaacaaaagctgaggaatttcatcaacatctgaccagtcctacaagaaatgctaaagggagtacttcgataagaaagaaaaggccattaatgagcaataaataatcacctgaaggtacaaaactcactgctaatagtaagcgtacagaaaaacacagactattataacagtgtaactgtggtgtgtaaactatttttatgctaagtagaaaggctaaacaatgaacaaaaaataactacaataactttaagacatgaacagtagaataagatataaatagaaacaacaaaaagtataaaagtggggggatgaagttaaggcatagagtctttattagttttctttcagcttgtttgtttatgcaaacagtgttaagtttttattaggttaaaataatgggttacaaaataaccaagcctcatggtaacctcaaatcaaaaaacataaaataggtacatgaaaaataaaaagcaagaaactaacatatcaccagagaaaactgtgtttactaaaggaagacaaaaaggaaagagaagactataaataaaccagaaaacaaataacaaaatggcaggagtaagtccttacttatcaataacaacatagaatgtaaatggactaaactggccagtcaaaagacctagactggctgaatggatgaaaaaaacaagacccagtgatgtgtttcccacaagaaacaaagttcacctataaagatacacgtagactgaaaataaagagttggaaaaatatattccatgccaatggaaaccaaaaaacagcaggggtggctttacttatattagacaaaatagatttcaagacaaaaactataaaaaaagataaagaaggtcactatatcgtgataaaggggtcaattcagaaagaggatataacaattttaaatatatatgcacccaacactggagtgcccagatatataaagaaaatattattagagctaaagagagagataggccccaatacagtaatagctggagactttaacacctcactttcagcattggacacatcttccagacagaaagctaatcaagaaacattggacttaatctatactataggccaaatggatctaataagtatttacagaatattttagccaaaagctgcagaatctacattcttttcctcagcacatgaattattctcaaggatagatcatatattaggtcaaaaaacaagtcctaaaacactcaaaaaatctaaaataatatcaagcattttctctgtccacagtggaataaactaaaaattaataacaggagaaattttgaaaactgtacaaatacaaggaattaaacaatatgctcttgaataaccagtgagttgagagaaattaagagggaaattgaaaaatttttgaaacaaatgataatggaaacacaacatgccaaaacctatgggatacagcaaaaacaatactaaaagtttatatctgtaattgtctacatcaaaaaagaataaaaacttaaaataaacaatctaatgatgcctcttaaaggactagaaaagcaagagcaaaccaaacccaaaacttgtagaataaaataataaagataacagcagaaataaatgaattttaaatgaagaaaacaatacaaaagatcaatgaaacaaaaaagttgtttttttgaaaaggtaaacaaatttgacaaacatttaagccagactaagaaaaaaaagagagaagacggaaatcaataaaatcagaaattaaaagggagacattacaactgatactgcagaaattcgtatgccaataaattgaaaacttagaagaaatgaacaaattcatagagacatacaacctcccaagattgaaccaaaaaaaatctaaaacctaagattgaagtcataataaaaggaaaagaaaagcccaggatccaatggtttcactgctgaattctacctaacattttaaagaggaactgataccaatcctactgaaactattacaaaaaatagagaacagaatattcattctgtgaggccagtactaccctgatacaaaaccagacaaagacacgtcaaaagaagaaaaatacagaccaatatctctgatgaatattgatgaaaaaatcttgaacaaaatactagcaaagcaaattcaacagtacattaaaagatcattgattgtgaccaagtcatatttatccctgggatgcaaggatggttcaacatacacaaattaatcaatgtgatactcatatcaacagaatgaaaaaactatatgatcatttcaactgatgctgaaaaagcatttgatataacttgacaccttttcatgataaaaaaaaatctaaaaaaactaggtatagaaggaatataacgtaataaaagccatatacaatagacccacagctagtgtaatactgaatagggaaaaactgaaagcctttcccctaagatctggaacatgacaaggatgcctactttcaccactgttattcaacatagtactggaagtcttagctagagcaatcggacaagaaagaaataaaggacattgaaattggaatggaagaagtcaaattatccttgtttgcagataacatgatgttatatttggaaaaacctagactccacacacaaaaaaaatttagtactgataaacaaattcaataaagttgtaaaatataaaatcaacatatgaaaatcagtagcatttctatatgccaagagtgagcaatctgaaaacgagatttaaaaagtaatcccatttacaatagccacaaataaaattgtatacataggacttgatttaatcaaaaaagtgaaaaatctctacaataaaaattataaaacactgataaacaaaattgaagaaaacatcaaaaaagaaaaatattccatgtttatggattggaataattaatattgttaaattgcccatactacccaaagcaatctacaaattcaatgtaatccctatcaaaataacaataaaattctccacagaaatacaaaatacaattctaaaatttatatggaaacataaaagacccagaatacccaaagcattctgaacaaaaagaacaaaacaggaggaatcacattacctgacttcaaattatactatagagctatagtaaccaaagtggcatgatactggtataaaaacagacacataaaccaatggaatagaatagagaacccagaaataaattcacacacctacagtgaattcatttttgacaaagttaccaaaagcaaaaaagacagtctcttcaataaatgatgctgggaaaactggatatctatatgtagaagaatgaaactagacccctatctcttgccatataccaaaatcaaataaaaaagacttaaatctaatacctcaaactatgaaactactacaataaaaaattttggaaaatctccaggacattggtctgggcaaaaatctgagcaatacccccacaagcacaggcaaccaaaacaaaattggagaaatgggattacatcaagttaaaaagcttctgcacagcagagaatacaatcatgaaagtgaagagacaacccacagaatgggagaaaatatcttcgaattatccatctgacaagaatgtgtaaagaactcaaacaactctacatgaaaacaatctaataatctgatcaaaaaatgggcaaaagatctgaacagacatttctcaaaagaaggcttaaaaatgcaaaacagacataaaaaggtactcaatattattggtcatcagaaaaatgcaaatcaaaactacaatcatctcaccctagttaaaatggcttacatccaaaagacaggcaataacaagtgctggcaaagatgtagagaaaaggaaacctttgtacactcttggtgaggatgttaaatcagtacaaccattatggataacatttggagattcctcaaaaaaaccctaaaaatcgagctaccatatgatctagcaatttcactactgggtatatacctgaaagaaaggaaatcagtatattgaagagatatctgcactcccatgtttgttgtagcactgttcacaatagctaagatttggaagcaacctaagtgtccatcaacagcttaatgaatagagaaaatgtgggtacataaacatgatggagtactattcagccacaaaaaagaatgagatccattcatttgcaacaacatggttggaaccggagatcattatgttatgtgaaataacccagtcacagaaagacaacatcgcatgtatcacttatttgtgggatctaaaaatcaaacaattgaactcatggacatagagagtagaaggatggttaccagaggttgggaggggcagtggggggctgcaggggaggtggggatggttaacaggttaaaaaaatgttcagaaagaatgaatgacatgctatgtgatctcacttcaaggtttactatagtcaataatagctgaactgtacatttttgaataactaaaagagtgcaactggattgttgataacacaaaggataaatgcttgaggggatggataccatattctacatgatgtgcttgtttcacattccatgcctgtatcaaaatatttcatgtaccatgcaaatacatataactactgtgtattcacagattttatatatgtgtgtatacatatgtatatatggcacagagcaagttgaagaagaaagagatgtctctttgcaagtacaatatctttattacaaattttaccaaaggtgtatcattatacaaagacattgttagggctctctcagagttttgaaaggggtccatgcaggggcctatagattaagcttcactgatctgattttgtcatgtcagtttctgtttatacttgcaactataaagaaaataatgacttttggttgaagaaaatgtggagaaggaacagagaggcatatttttaaattagtagcaatcatattggtagcattagcattgctattttaagactgctgtatgagtgttgtggattaaagtaaatgagtaatgatggaaaatttgtatcatattatcttccataggtcctgaagagccaggattctcagtgtagaagagagtagatacaggtgtaataccgaagccagccaataaataatcctatcattctgattttaatttggaagtgtcagtaagaactcataagtatttcatctttaaaatattatctatgaatatactcttagttctatctaccaaggaggcctgaaaacaatgaccaatctaagagcaaaagtcatcccttaagcctagattgtgagcttgaaataccattttccactaaatgaattcagggattcttagataacaaatgtaaaaggtatatatctaagacttttatcataccaaatagtaaaaaagctaccagacactaatagggtcatgttaaggcagtcagagggtcatgttaaggcagtcagaagctcatgttaagaaatttctactggccaaaatgagacaattagtctttaaaaagactaaaactgaaatgaatttaaatctgtcaaatatgcctaaatatgagattatcatattaaaatataaaattaattatctttgaaaaataacagaaaatctatttgttatcttgaagacaaaataaaaggaaagaatcaaaacagatcctatctatcctatctgactataaaactgggtaactaaatagtagatgagggtaaacatcctaagagtatttcaactacaaataaaaaagacaaaataaaatgtcatcatttttcacacaccaataaattaatatgtctaagctttgagctgtttatactgtatttctaaaaacagaaccagacatcgttatgtgcctcctgatgaaagaacaggatacactacatgcagttgtgccaaaacaatcaaacgtaagtctgatccagcctttagaaccagccacgaatttgtgggaaattcagaggacagaaaaaacatgttgagcacttacatgagtttacaactttaaaaatccagtctgtgagaaactctgtaggttcaacactcctgattatttaacataaaaagtgaaaagaaaaaaaaaatggaagcgaaacttttagattaaaagaaaatgtattttttttttattaagaacagacaagactcatctatagcattaaggatatgcagttgggtgataaaaccgaaaagcaacaaaaaaagattactataaaaatcaggataaactccaaatagatactttaaaattctaaaatcataaacaaagtaaattccaaatgggtaaatacctaattacagtttttaaaatgtctagcacgttgtgaaaaaaattatgataaggtgctaggaaaagatttctgtacgatatgagaataatatcattttcttaaataagccaaccaaagaacaatacaataaatgaaggcgataaatttgactcttatcaaaattaagtatgttcaccagtcattacacaccataaagtttaatgataagccatatccttagtatttgcaatgtgtaaaagcttggtatccatgatataaaaagaatagttataaagcaataagtttttttaaatataaaaataggcaaaggttaagaagaggcgatttacagagaagaacacacatggcatataagctacatgaaaagatgctcaacagtgctggtaatcagtgagataacatacatataacattccatattcaccagaatggcaaaaacaaaattttgataatacatatcttggcagggttgtcctaaaacaagtgctatagaaaaagtacattagaaccaccactttagagaataactagataattatccagcaatatctagcaaaagttgtgattagaacaaggcaaataaggagtttctggaatgccaacatgttatttttcttgacgtgggtgttaattttgtgatagtcattgaaatgtacattcatttttgtgtaccattcaatattgctctacttcattattttaaaaagattttaattaaacagaaatctattagaggtattcatgaggaaaatgttctctttccttctccttttctttctcccttggattcaggaagctgtagctagagctgcaatggccatgttgcgaccatgaaaaaaaggccaagagatctgcaaagaaatgagccctgacttattccactgctgaactaatatcagcaattgcctgccttgaacgtcttgttatgtgatcaaagtaagtcgtcatttgttaaaaaggaagagatggatgagggtaaagtagtgtggtagaatttagtgcttttggtaacatacaatgagattcttgtatgtcagttttcccatcagggtaaaataaggataacaataactgatttatagggccattaaaaagattaaataagaaaaaagtaagttaaatatgaagcatagtgcctgacatatgataggcaatgacagtgttaatttctattactctaataacaccaattggaaaacaggagaccttaaatatcagtcattcacaaatgaaatgtttcgtactgtttctgagttgttttctgttttggtttagtatccttgatattggtgaacacagctaaatgctaaatgtatgtggatatgggggaggtggggatgttccctgaggatacttaaattttacgtcatatgcttcaaatcagggatccagtctctatcagtctttacttacgctgtactgtgatagaggaaaaggcaaacattaaacatgaatgtactacactaagatgtcttaataaatttctaaattatgactttcctatttgtcttacccttatgcaatctgttaccacacagatggatgaacataaagctgatttattctctgtcaatttttcatatcctttaagagttctcctgattttagatattctcatttaaattttttgaagagtttctcctaactcaaagccagatgttaatgtttatagaataagaattgcttaaattttttctcaaactgaggtctcttgacctaaagtaaaagcatgattttactgaatggtttgggcattttttagttgcctaagtatgcatgatcttcatttcctttctgttttcagctcttctgtttctcagcagtttcttcttccttgaagaacttggagtgacattagctaaagaagtgaacaaaacctcccctcacttatatttcacgaactgtctgctgagcagagtgaaagaggtaactgtgatgctacatgttctagtggaagttcagtgcagttatagttgaacaagaactcaacagaacaaaaccatcattttgttccatcggatagtctttgatattccccactgtatcatattgatgaatgccaaatgactcccaaacttgccctaagaccttcactgacctttcaatttctaactgtattgtgaagcactttagggggtcttgacttcatgctttgtcagactagctcttttcgtgaatgaagttcatgcatatggcagtacaatagacactattaagtcgcccagatgatatatcagagatgcatttttaaaggattgttaaaggtaagagatattatacatataagaagagaccatctccttgatccataggacagaagttctttagaaagacaactaagccatgaatacattccaacatcaaaacccaagagctaatcctgtggaaaattataaaaataaaagactgatgggaaaaactggtaggaactgctttcattgacaatagcaggtatgtgaaccagaagacacattatcagagaatacacacacacacacccctccttcatgttcctatacactccacacattagattctgaaaagctattcattagaaaatcccatgtttgttaagttcaaagtaacactatgcaaaagacttgaaaatattagcagatttaatatctttttactgtgaattacgaatgcattgaaataattaagagatcttaactagatattccaccagcacaccaccataattaatggaggctagaacatgtctattaaatcccctggaaaaaaggttttcagtttcctgatctacaatttgtccattgttctgcccaaatccttcaggttccttcaaggctaggattgtccctactttactcttggcctcaattgccaagagactaatgcccatggctcttgacaaagaaaacaatcatttaaaggtatttaacctaatcgagagtcgtgagaatggagccaactacacagccatatatgaagtctgctaaaaacagaacaaatgggcaagtgctcaggtcctcaccaaagcaaagccttaaatgatgaagtcaaatataatctgggagaatatcagaatacattacttttgaaagaaaagtctaagaattataaacatgaaggaaaaacggggagaaaggtgcaagaattacattgactactacacaaaagactcaaagggccctaatatgactgtcatgtaggttcacataaattctacacatatctctgattattactttcctctaggtcaagagaccccagttagcaaaacacttaagcaattcttatttcataaacattaacatctggctttgagttagaagaaattctttcaaacatttaaatgagaatatttaaaatattctgggtgcactttttcattagaggctcccacaaaattgccacaaacaatatttaactgctttgttttaaattttgaaactcttgtaaaaatatttttacacagaattgtaagattttttaatataccccaaagatatttgcatttttgttgtttcatttaacttggtttaaaatttaaagtaatacatcattttttaaaaagcaaaaaagtcaaacattatgaatggtataattttactttgtgaaattttaaaaattgtatacagataatacattgtggaaggatacaaaagaaactgccaatagtagcgctctaatagtggctgttaaacaaggtttgatggctcaggaaaactcacagaacccacaatgacaatgcttacaagtttacagggtgtattttgcaggaaaaggatataacataacaatgacagtaagaaagactatgcatgtcagacgaaggctgtctctcttgcatcaggaaccaccaatgcgtggttcctgactggaaccagagagcataaaatggagtctccaatgaggtttttttcttttttcctttgctattcacataggcatagtcctactatataatcagcatcaatagcagaggcctccgggggtctcactgagactaggtgccaattgttagtctcactgttatcaacagtgctgacaagttgatactcaccactgaaaaactctgtggaccacatttacaaagtaactatcttcaacagcatgctccatgccttgtccaggagccagtgcagcacgggaacatttcttatttcagcaggacacctcaggctaattccagacacactggatgaacccccacacctcaagtagtttctttggtgaagaaaattcaagagtgttgaccagtggcatgattcagcttttccttttatactttgttttactgcttagagcttcagtactttaagtatctttcttttaaaaaaacagttggcatatacattatcagataccagccactctgagcagaactggaaattagtagttgtaagtaaaatttacctacaattgctattaaaaaagttagacgagtaaagggcaagactcctctatacttggtaacctaacaattaaaaacaagaaagaagaactaaatgtcattttatcaacatttaactttagtctttctctattagaaaaaccatacctggcccaggaatggagcacagatgcactttatagcagatcatttaatccagaatgagatgatgattctctacaaagcatatcatttgctccaaacactaaacagcagaataataattaaggcccattcaaaagtctggcacttccagccctcagttctttcttctctataaactggagctcaaatacaattttataaatcccattaacaataatgtttcacagtgaggagaattatgtgtcccagccacaacctcagggataaggcggaattcaaaaggaagagaagttaaagcttgataggaaataataatgacaaggtcacataaaagctaccctaattcttacctaatggattccacacataatttacagctaaaagatgaagctgagagggaatcatgaatttggccaaacatgaaagactaaaatttttagtcaactaataggcatttaaggagtatataataaatgcccaagagcatcttggccctttccctcaataaatttacaaacaagcagtatcatctaggaacttcaacttgtactgtgcttgtcttgtccttcaaacacaagaagagtttgtgtcactgttaaaacactggtttcagcctgggtctcaagttgaatgaaatcctagtttttattgaagtatcaaagacaagtgcatcagtatcaaatgagaaaggaaagaagtacagagcaaatatacagggaagtgtgaaggaattactgggcagcactgagtacccatttcagatcatgaatttaaaatgagaccatcatacttgtgtgttttcttaagccatctttacacttgaatgcagaatgagttgggtgcgtaattgggttcagccagggttgtttttttgccaagtgtataaatgaaaagaagatggtcaaggaagttaagggtgattgcacagggttgattattacaatatggcaatgaatctgaggcagaggcatgagataatgacagagatggtggggttttctatgtagaagcaatagtttgttcaattctacctaggtaaagagatgaaggcacttcactttaaccccctatctccagacaacgtgttcaagtcctctgccctctgttcagaggaatttgcccagagattaaatatagatgcatgtggtccacattgatgaagatttggcaatgggtcttttttattattgtccctgctctctacagtgatggtctttattactttctgtccctccacttcttccattccagtctgagttctcttctgtctctccattcccatccccagtctcaatcttttacagtttttgaaagaagaaaacaaaaaaaagtaataaacatatgtgtgcctgtgtcattatagtacaatgatttataatcctttgggtatatacccaataatggaattgctcagtgaaatggtatttctagttctggatccttaaggaatcgccacactgtcttccacaatggttgaactaatttacactcccaccaacaatgtaaaagcagcactgttcacaatagcaaagactttgaaccaacccaaatgctcatcaatgatagactggataaagaaaatgtggcacatatacaccacggaatactatgcagccataaaaaaggatgagttcatgtcctttgcagggacatggatgattctggaaaccatcattctcagcaaagtatcacaagaacagaaaaccaaacgccgcatgttctcactcataagtgggagttgaacaatgagaacacatggacacagggaggcgaacattacacactggggcctgtcaggggtgggggtctaggggagggatagcattaggagaaatacctaatgtagatgacgagggttgatgggtgcagcaaaccaccatggcgtgtgtatacctatgtaacaaacctgcacattctgcacatgtaccccagaagttaaagtataataaataaaaaaaacaccctcagcaaatacacatgaaaaaatttatgactctgtttttcttcctccttttattgttattctttttccttcccttccattccactcctttcctgagaattgaaatattaaaatcattaggtgggacatctaggtaggcatctgtgctggaagtatggagaaggggtagtcatagtgactcagagaagggtggcaaactctaagcaaaatgaggagggtattcatgtgggggcctctggtaccccccacatgaatttctgaaaaacttacatttctaataaatttatctttgttaatgagatagacataaatttatatatgtagatagagatatcctctgtcaagaacaatgccccacccaacataaatcactaaccaaaagtttccatagatggacttatatacacagcacatatcactgaggaaatgtgtacttaagatgaaaatagaaggtatggcagttttccaaagatagcagtcccctcaccactgactgcttaatggactattaaataattccagtctttaccactgtctctctaagaacatcaaagggaccttaattcataatacacagcacatcttaaatccctcttttctctcctctccaactcttgtctttgccacagctgatgctgagcctcactctctcaactctccacctttctaggtgccccaccttgcttgacttctgttttctgttttttgtttgtttgtttgtttgtttttggcaagatcagattctcacatgatggaggagtcagaaaaggtgagccaagaaagaccaaataaattccctatttctctttactgggctagaagaggtgtggtggctatgtgtagactacaaacacttatactttaacaaatattgtcacactgacacttttccttttggccgcactaaatagggatgctccctttaccaaggaaaatcaatctgtgccctcagctaggaaggtaagactggttgtctactaggtaaaatcaagaaagcctcaagaccttccttaggccatcttaaactgttctgccaggatcagcttaactatgcttaactgttccttaaccaattaaataattcttgcccttaatgtctcttgaccaatggagaaggttaactttggttcatatccacccagtgctacttctcttctttccttccccccaaaacccaaaactaatattagccatatgtttcagtaagctctccccaatccgagactctctgtggacctaccatagccagaaacagccagaactgtctctctgaattaaagcttgggatttatataaatggccctagatactgccctctggggaactttaagtggcaacctacatgctatctgaaacagaagcccaacatctacctctctggatgggtcttgcctctggaagttggcagctggagcccagcatgaattcacagacagagggagctttctcctgtgtcttcaaaggaaaatcccaagcagaatcaagtgagcagccacagcagcagttctgtctactgtaggatgcttcctactcaatcatagccaggtgtgattttatatgatagaagtatctctttcttttaagccctttgttacaggaaggaacacagtgtggttgttttcatcttcaggcacccttaaaaggtaaatttgaatccaaatcaaatagaaaagataatccatgaatcttactacagagttggaatttaacaataatgctaacacttattcaccacttgttatgtacctgacactgttctagtcctttgtatatattttaattttatttaatacaaaactccatgaggtaggaactaccattatctctctttgaaaatgaggaaactgaaggtcaacaagtaactactaatgtatctggcactgtatctcaaacccaaatgcttaatggctacattatactacctgtcccctagtatatgtgaatggggcaaagagctgaaagggatatccctgtcctctcatccagtaggagtgaatgtgaaaagagagagggagctaaaatcgtggcagaaaggacaaattataaggggaggtggtcctgaatagccactgagtgatgacagagagcaatgttgaagaaaatgatgctaagactaagtaacatatagtcatagatccatacctcccaggacatccagcagataatgaaaatgcaggctccccaggcaccttaaaagatcccaaaagagacagaggttacacaaaagtcacaccttcctaattaaaagtacttaggacaagagacaaatggtccaggtcaagaaacccaatcaacacagaaaggatgttcggaagctatgtgctgaggactcagagcattctagtcccttgtacacagtaaaggggaagcatgggtgggcaggaaaacgcttatcctcagatgtgtcggcagcaaactttttactaaaagaagaccccattcaagataaaacataattgaaaaatatttaaccaccctctgattccagcaaaatagcttgccagaagcattttttcaaattgcatccatttttatgactaagtggggttcttggcagcagtcctatgtgattcccaagactatgcttagctgcttattccttccatgcaaaagcagccctttaatgcagtcaccaccacatccttacaactgtatgtcatccctctatctaccttcatcccacaccaacaggtcacaaaggtccaaggagagctggcgactgagtcacatgagcacttagagtgacagtccactctcctctagataagcaacatccattcctgagcagtctgcttttacttgctccaggtgaattcaatgacacttctgaacttaggaaataaaacaggactgcgttctttatagtaaaaatggcttcaggttacctcatcagtttctttcatatgtaccgcttccatgtctgagattgttattaagctatggactctcagcttcaaacccactcatctacgctcaactttgcgctgctggggctggaactctgcaaactctatttcacctctgccagctgagtttcttagatggggccaccaagaggtgctagagggagaccaggggctggaggagagagaggagacttgctcttctgtttgctcactgttctgcaagcatcattcagcacagttacttcaactcagcagcagcagttgacttcagtaatagttgattccagtttccattttttccatgctccaggaaccaatcatcttttatcatctcagagataacaggaccatagccacaggattcccactctgaacttctcaattctaataacctcaacctgtcccctttgttcctgagccctggagggcacagctgcttccttcaggtaccatctctgcattgccttaatgtttccctttttctccaatacctgattatttatatccttaaattatctgttaaaataactgttgtctattttcctcaccaaccctgcctgatacaatatgtgagttaatttcttctgtcctgtctaaacatacaaaaaggaaaccaaaatttgtcacctcgtggagcttcagtaataggagactgtttaagttttcaacaaatacattctcccctttgttgacaatggcagaaaacacggtcataaacctacttttcatttgttcttttcctgttgttgactgttaatgatgaatgtttggaaatcaaaattttaatgctgaaaattttattggttaaagttacttgtattacataaaggagaagtaattcaatcttgagcaagaaaacagagctgtgaaaacttttgggtttcctcaaaacttcctgcatgagtttcctctggctacacatttctttgtccacattatgacaaacctggtggtttaaaacaacagaagtgtattctctcataaatctggaggccagcaatctgaaatcaatgtgtcagcaaggctgtgctaccactgaagactctaggggagaatcccttgcttcttccagcttctggtggctctacgactccttgacctgtaccacaccaatcgaatctctgcctatgagatcatatcacctcctcctctttatgtgtcttctcctctatgtctttctctaaaaactcctctgcttttatcttataaggatacatgtgattgtatgtaaggcccacccagataatccagagtagctcctcctctcaagaaccttaatttaatcagttcctttattatacaaggtaatattcacagcctctaggaaaaaggacatggacaaatttggggggagtcaccatttagcccaccattgtccacccttaatgacccctttactttttccattttcttcctttgggaatgggaatgttttgtaactgttataatatgtctgactcattattgtagtttggaaacaacttgttttctagtttcacaggtccacaaatggagacaatgtcccaagatggatcatgcttagattctcacctatatcttatttacatgatttagatgatgagatttgggactttttaagcaattatatttaaatgagattctcagatttagagcttgtgctataacagtttgaggttttgagggatgtattttgcatataggttgaacataatttttggagggccaaaggatggaatgtagtatactaaatgctgtccttcaaaaagatacgtccacattttactccccagaacctgtgaatactaccttatatggcagaaggtgtgattaaggatcttgagttaaagaatttatgttagattatccaggtgaatatgaaatgcaatcaccatgtatatttatataagaaaggcagagggattttgagataggcatgcagaggagaaaccacacaaagaagtagcagcaatataatcatgaaggcagagactgggttcacgaagctacagaccaaggaacaccaaagaatatcaattgccaccagaagctgaaaaaggcaagaagcagattatcccctggagccttcgcaaggaatacagccacgtcaacaacttggtttcagacttctggtctccagaactgtgggagaacacatttttttttttttggtctctcttattttactgtggtgagaacaattaacaagagatctaccttctcaaacatttttttttagttctttttaattatactttaagttttagggtacatgtgcacaatgtgcaggttagttacatatgtatacatgtgccatgttggtgtgctgcacccattaactcgtcatttaacattaggtatatctcctaatgctatccctccccctgccccatcccacaacagtccccggtgtgtgatgctccccttcctgtgtccatgatgagttcatgtcctttgtagggacatggatgaagctggaaaccatcattctcagcaaactatcgcaaggacaaaaaaccaaacaccgcatgttctcattcacaagtgggaattgaacaatgagaacacatggacccaaacatttttaacatacactacattattgttgacaataggcacaacattttacaaaagatcactagaacttatccattgtgcttgacaaacttcatgatggtagattagtaactctccacttccactttgccccaacccctggtaaccattattgcactctttgattttatgaatttggctattttaaatacctcatatagttgaaattatgcagtatttgtctttacgtgaccagcttattttacttagcataatgtgctcaaagttcatccatactgcaaaatttcctccttttacagggctaagtagtgtcccataatatgaatatactacattttctttattaatttatcaatcaatgggcattcaggttgtttccacatctgcggtattgtaaatagtgctgcaatgaacataagagtgctagcatctcttcaagatctttatttcaattcgattggataaatacccagaagtgagcttgcttagtcacacagtagatctatgtttaagtttgaggaacctccatactgtttccaaattaactgccccattttgcattcccatcaacagagtgcaggggttccaatttctccacatccttcccaacatttctctttaaaataacaataataataataataaccattctaatatgtgatgtcttctttgggaaaatgtcactcaactccttagaacatttttttagggttttttttttttttgctattaagttatatgaattccctacatatttgggggattaaacacttagacgattttcaaatatctgctcccattccataagctgccttttcattctcttgattgttgccattcctgtgcaaatttcatgtagtcccacatgtttatttttgtttttgttgcctgtacttgaggtgtcatatacataaaatcattgccaagaccaatatcatgaatatttccacgtgttttcttctagttgttttaaattttcaggtctcatctttaagtcttttgtcctttttgagctgattcttatttatggtataagataaggatccaattttattatcttgtatgtggatattcagttttcccaaaaccatttactcataaaactatcatttttctattgtatattctaggcacttttgtcaagaatcagttgaccttacaggcatacctcattttattacacttcactttatggtactttacagatattttgtttttttacaaatgtaactttgtggcaaccctgtttccagcaagtctgttggcaccatttttccaacagcatatactcacttcatgtctctgagtcacatgctggtaattttaacaatatttcaaactttttcattattattatatctattatggtaatccataatcagtgctctttgatgttactagtgtagttgtttgggggtattatgatctacgcccatgtaagacagtgaagttaatcagtaaatactctgtgtattctgactgttccatggactggccattcccctatctctctctctcccctcagatctccctattccctgagacacaacaatattgaaattaggccaattaataatgatacaatcacctctaagtattcacatgaaaggaagagttacatatctctcacctgaaaacagaagctagagattataaagtttagtgaggaaggcatgtgatctaaaacagggacaattttgcttctttctaatttgcatgtcttttatttatttctcttgcctcattgctccagttaggacttccagtgctgtatgtgtagaagtagcaacaataggcattcttgcctttttcctgatcttagagaaaaagctttcaacttttcccaataattatgatgttagctgtgtgttttgttatatatggccttaatgatgttaaggtaatttccttctattactagtttgttgagagtttttatcataaatgtttgctgagatttgtcagacactttatcttcacctatttagatgatcatgtgatttttatcctttattttattaatatagtttatcacattaattgtgttgaaccatctttgcatcccagaaataaagaccccttggtcatggtgtaagatccttttaaaatgctgttgaattcagtttgttatactttgctctgatctttatgattcccctccttctgccagctttgagctttgtatcttgctagtgttcagttgagaacttttgcatgtatatttatcatggttactgacttgtagttttcttgataccaaaaggtatcagggtgatgctgatgaaacgaacttggaaatatttccttcttttcaatattttgaaatgatttgagaagtaatgttatcagcttttctttaaatgcttagtagaattaaacagtgaagctatcagatccacagcttttctttggaaattttttttatcacagataacaactccatactagttatgtctattcagactatttctttatgatttagtcttcataagttctatgttggtaaaaacttatccatttattctaggtcattcagtttgttagcataaacttatatgctataattgtttgtaatagactttataattatttttatttttgtggcatcagttataatgttcatttttatttctgattttatttcagtctccatttttttagtctagctaacagtatgtccatttaatattttcagaataccaactcttagctctgttgatttctttctattatttgtctatttcagtcattcctagtctaatctgttattttctttttcctgctaactttaggtttagcttggttttcattggtctagttcctaaagtgtaaagtttagttctttatttaagatctttcttgatttttaatgtaggcatttattgctatgaaagtctctcttagtattgctttgccacgtcccataaattttggtatgttgtatttgtattttcatttgtctcaaggtatttcctaatttcctcttaaagtttgtctttaacccaatgattatttaagagtgtgttctttaatttccacttgtgtaaattttctagttttctttttgtcactgattttaagtttatttcattgtggtcagaaaacatacttcgtatgattttaatcttcttaactttgttaagatttgtttagtgacctaactcacaatccattctggagaaaaatctatatatacttgagaagaatatgtattttgctattgttgagtgaaatgtcctatatctctgtgtgtgtgtgtatatatatatactatatatatatagtgtgtatatatatatagtatatatatatctgtatatatgtatctgtatgtgtgtgtgtgtgtgtgtgtgtatatatatatatatatatatatatatatatatatatatatatatatatatagtgtcattctagtcctgtttccttattgaccttccatctggatgttctgtccattattggccgatgttggctttatatattttggcacttttctgtttaatgcatatatatatatatgtgtgtgtgcgtgtgtgtgtatacacacacgtgtatatatatacacacacacatatataattgtgagatctttctggtcgagtgacccttttatcattagtcattataaaaattcttctgtcttttgttacagttctagacatagttctattttgtctaagattgcttgcttagacccttgctctctttcagttagcatttgcatagaatatctttttccattccttcagtgattaagtgaagtaatgaataatgaaatgaagccataataaaaagtctcccatcaaaaaaataaaaataaaaaaagcctaagacctaatggcttgagagctgatttctactatcttttaaagaacaataccaactgtacttaaactccttataaaattaaagaggagggaatccttccaaactcattctacaaggctagcattaccctgatactaaaaccagacaaggacacacaaagaaagaaagaaaaacacaggccaatatcactgatgaacatagatgcaaatattctcaacaaaatactagcaaagcaaatccaacagtacaataaaaagatcacacaccatgatcaagtggaattcatccctgggaggcaaggatggtttcacatatacaaatcaataaatgtgatacatcacattaataaaataaagaacaaaaattatatgagtatttcgacagatgaaaaaaaggcatttgataaaattcaccatccctacatgcaaaataccctcaacaaactaggaatagaaggaaaatacctcaaaatggaagaatcaaatatgatgaagccacagatgacatcacagtcaatggggaaaaattgaaactctttcctctaagatctagaaaaagacaaagatgcccactttcaccactttcattcaacaaatactggaagtcctggccacagcaattagctaagggaaagaaataaagggcttcaaagctggaaagaaagaagtcaaattatccttatttgtagaatgtgatgttatttttaaagaaattgaaagactataaaaaacctgttacaattgataaacaaattcagtgaagttacaggatatgaaatcaatatacaaaactcagtagcatttgtatacaccaagaacaaacaatctgaaaagaaatcaagaaagcaattgcatttgcaatagctacaacggttataaaatacttagaaatcaatttaaccaaagaagtgaaagatctatataagaaaaatgatttaaaaattgatgaaataaattaaaagatcacacaaaaaagtgaaaagatattccatactcatgaattttaagaattaatattgtgaaaatggcaatactactaaaagtaatttatagagtcaatgcaatttgtatcaaaataccaatgacatttttcacagaaatataaaacaatcctaaaatctgcgtggacctacaaaagaccccaaatagtcttaatcaaaaagaacaaagctggagccaccacattacccaacttcaaatatgactgcaaagctatagtaaccaaatcaacatgttattggcataaaaacagatatgtagaccaatggagaagtattgagaacccagatattaatccatacatttacagctaactgctttgacaaaggcaccaagaacatagaatacagaaagaacagtctcttcaataaattgtactgggaaaactgaataaccacatgcaaaagaatgaaactagaccccgatctcttgccatacataaaaatcaaatcaaaatgaattgaaatcttaaatcttagacctagaattatgaaaccctagagaaaaaaattgggtaaatgagccaggacatgggtctgggcaaataatttttgtgtaagacctcaaaagcacaggcagccaaagcaaaaactgacatatgggattatattaagctaaaatgcttctgcacagcaaaggaaataatcaacgaagtgaagagacaaccagcagaatggggaaaaatatttacaaactattcaactgacaaaagattaacacagaacatataaggagctcaaacaactcaatagcaataaaaacaccccaattaaaaactgggcaaaggacctggatagccatttctcagaagaatgcatacaaatggccaacagttatatgaaaaaacctcaatataactaatcatcagagaaatgcaaatcaaaaatgcaactaaatggcagtgagatgatatctcattgtcttgtatcttttggtctcatagcaaaaagacagggaaaaacagatgctggcaaagatgtggagaaaggggaatccttgcacagtgttgatggaagtatcaattaccacagccactgtggaaaaccgtatggatatttctcaaaaaactaaaaattgggggtggggggttgagccaagatgtctgaatagaggcagctccattctgcagctcccaccaagaaggacaaaaactacaagtgaactctgcatcttcaattgaggtactgaagttctcctactgggattgcctaggtggctggcatgacccatggagagtgagcaaaaacagggtggaacgtgagatttgggaggggccaggggtggaattatatggtttgtctgtgtccccacccaaatctcatcttgaattgtagtccccataattcccatgtgtcgtgggagggaccttgtgggaggtaattgaatcatgctggtggttaccctcatgctgttcttgtgataatgagtaaatctcatgagatctgatggttttataaaggggagttctcctgcacaggttttctcttgtctgctgccatgtaagagataccttttgcctgctgccatgattgtgaggcctctccagccatgtggaactgtgagtccattaggcctctttttctttagaaattatcctatcttgagtatgtcttgatcagtagcatgaaaatggactaatatagtgatgcttatcccaattcttctgatttgatctttacacattatatgaaggtatcaaattatacatacccccaagatgtgtctattatgtatcaatatttctgatatataaaattaattttaaaaaactaataataaagtaaacttatagaacagcaaatagtttgggctatttttaatccattttttaatcctttttttaaatccattcagccaccctatgtttgattagggagtttaatttatttactgtattagtttgttttcatgctgcatcaagacatacccaaaaccggaacaaaagaggtttaattggacttacagttccacatggctggggaggcctcagaatcatggtgggaagtgaaaggcacttcctacatggcagcagcaagagaaaaaggaggaggaagcaaaagtggaaacccctgatcaaaccatcgaatctcatgagacttattcactataatgaaaatagcacgggaaaaaccagcccctatgattcaattatgtccccatgggtccctcctacaacatgtgagaattctgagagatacaattcaagttgagatttgggtgaggacacagccaaacgacattatttacatttaaagtaattattgatagggaaggatttgctattgccactttattcattgttttctactggtcttatagttcttctattgtattttcctttcctattgctttcctttgtgttttgtccacttttcgtattagcacactttgatctttttctcttttgattttgtgtaactttgtgggtataacatgtctctgggtgaatttctttgtgttgatctaatttggtatcttctaggcttcctagatgtggatgatcatttccttccccagatttggaaagttttcacccattatttctctgaataagctttatggttctttttcttctcctagtactcccataatgtgcatattgctcctattgatgatgtcccataattcctctatgctttctccactttttcatttttttttgtttttctactgaattatttttagtgatctttcaattcactcatcctttcttctgattaatctagtctgctattgaatccctctagtaaatttttagttgagttattgtgctcttcagctccatgatttctgtttggtacttttaatattttctatctctttgttgaaattcttactttatacatgcattgttcttttgacctcactgagcatctttttaagagttatttttaattctctgtctgtaaattatatacctccttttcattaggctttggtttctgtagatttaccttgttcttttgtttgaaacatctttgcctggtttttcatttttcttgactctctgtgttgatgtctgcatattacacaaagcaggcacccctctgtcttcacaaactgacctgtataggaaaagaccttcaccaatcatcctagccagggattctgagatcgtctattaactcttttcctctcaaggaagaagtaggcagctgcagtttctgactacttgctctgtgctgagctagggtggggagctttggcatctaccaatccaagtcaacatgcccattgttccccaggcagctagactgtactggatctgtcagagcttcaagattggtgaggcaggtactagttctttgggcagctctggaaactgggcattgatgtacacgtcaactctccccctaccagaggaaactgagagctggttttatttttatttttttccatctatttgctctgtgcttaactgaggggaggatccatgtcatctactacctctgttctcctccaggtggctagactattctggacccttcagatatccaaaagccccctgagaaaatttggggtattagacacatgaaaaaacaccttccctgctctgggtgaagctgagagctagtgtacctttacttggtcatatagtgctgtgctaggggtagggtttctggtgaaagggtatcttaaatcttcccactagctttgttaagtctggtttcatatttggttttcaggatgccagagcttttctggtttctcacaaaggggatttgtccatgagttgctgctgaattgatgtgtttatgaggtatatttgtgggggaagaagggtcaagggctttctatttcactatattgctgatatcatttcatatttctattgttttaagccccaaagtttgtggtaatttgttatggcagctttaagaaactaacacggttcccaaaagataacaaaaaatacaatggcaaaaagttaaaaattgttaaaaccagatttgaaaaaaaaagattaccagccataggacatatgttctcaacttcagatgggggagggatgagagtagatacagattcatttgtactatttcaaaataagttttaaagtacaaaagtcagtgctattaattgagattcttaactgttgatgttatacaagagtttcaagaatcaacaagctttaaaaattaatgcatcattaaatgtatgtagctcatcaattctttttaatgatattcagttacccccaaaacacaacctgcaggcacagtgaaattcacttggttgatgattctaaacattatggaacgtcaacctctagcaattcaaatctgcccaattgtatttccttttcactactgataaattttcaaactgaaacctttcaaaccacacatcttggttacaaaataaattttaagcattagaatatggttgtttccatactaaaagagatgaaaaagattctagtatttattttcttgtatacaacagttttaaaccttctaaagctgttttctatttctttcattcatcaagcacatgaaaaaagtaattgtcctaaaagtagagaaaaaatgtgaaagacgttgcaattcactttatagcatcttgcaagttataaactcatgtgtttaacaacttctttaaagaacctagatattattatactgagttacatctacaaattatataacaacctagttttatgcttttcataagtctcaaggaatgttcttgctaccccaactttgaatcactctaacatttcagaaacttcttgttttccccaatccattatatctgtctactgaagcagtaaatagcccaacatttttagtgctgaaaaccacaaatgtaacatcttataagaatgaattaataatgagaaaattttttatgaaatgacaatagttcatgaattatactttaagagtaagaagtttttggttctcagggttgataataactagaagttgtgagagatgttcctggttctactaccaccagacctcagatatatggtactctggtcttacaggaagcagagaagctttcaaggtaccctctttcatcactatataaacagaaagactatccaaacctgacctttaaggagcaaacaacaagaatggtgacagttaggagcctagaagcctaagcagaactgctcacggccatgagtggaaattcctgagggaaacttctgggaatctgagaaaatagaggccagtgtggcacacagcaagactggaccagcataccatgaaagggcaaagttccctagagttgccacaaggccccagtaatatggctgcacgttaatccttgaacagaataagctaaatctgagacttactctgattgcaaactcttgacgaggagtaaaatatttgcatggtcttaatttcttctcacagattgtttattagtttgaaagggtgaaaataattaattatattgcagataaataagttagtatcttgaccaagtgatcaaaattagcatcaccattgagagacagatggatatgcgtacctctgcatgttataccctgagaagtacatagcagtacctatccagtattacagcaaagaattagaaaatattttaaagacaatatctaaaaatacaaaaaactgtaaaatatattatagatgataagttataaaactctaatgaaaacatttaaaaagataaataaatagggagctactccaggttcaaggatagaaagatttcacatcataaaaatgtcagttttccctaaattgatgtatatatttaatgcatctccaaccaatgtaccaatggggcttttcacacaattagaacagttgattctaaaatttctatggaaaagccaagcataacaatacttcagaagaaggaaataggagatttgtctcaccatatatatggatgcattataaagctatcttagaagacaatatgatattagtataaggaaataaactggctagtggaaaagaacagcatccagaaataagctcatattttatatggaattttgataggtggcagaggtgacaccatctgtccctggagaaaaaaaagggtgggtgttttttgaagtcttttgtttttttccccagttactttgatggttcatgctcatcatttattagtaaggggaagaagaaagaaagaaaagcaaatgggcatataaagtgacctctctgtgtcttttctgatgcttctattgctgacagaaatagtagttattagaacctagacatttttatatattacatttataatcacaccagtttgagaataagccccaaaaggcccatgacgtcacaaatcataattttgctctggtggaaatttggatatgtatattattttcaaattgtagtttgcataagaatcgaagtatttgaaaaaaaaatgtagagattataactcagtagatctggtgtgcggtcagaaaaatgacatttttaacaaggctctgggtaattctgaaaaccatattttgagaaaagctagaatgaagtgttggggagcccaggagtaaatgcctctctacacagttatgtagtctttccctcatcaacaaatgtcatggctatattattagctgagaattttaactttttcagatggcactacaactaagattcctagtgaatcttaagagttggctataaatctaaaagcctgcatctcactgctagccagttataccacatccagcaatgagtcttttaggaatctttttatgttgatgagaaaacacaatggagcaatgtgaaaatgcaacaagacttgttgagtacagaatgagaaacactttctgtttctgcaatttcattttccttcccatttttacagaggggaagcttggcactatcctagtaactaatgagatttccccacagttcacagcagcagggcttccaagaagaccttatacacccttatccctaccacaaagggcttgaaggccttgaccaagcacaatacacatcaccagtgtctattaactttcacctgcagtgatgcttcccaagcagctctagctctgaccttggctgtggctcttagctttgcatattaaggctgggtgaggcactcatccctatacctcaaaatccccacacttttatgatcatttcttataaaacaccaggtaatgttttcagagaataaacgaggtctggtacattgcatttttgagaaatggaagagtaactactccatgctttctgtatctttaactgtttttctcatctgttatgttcctcggtgactaaattgatgcttccttctttttatcaagcatattctaaaagtttatattgtcttcgacagtctggcttaggaatatttgtatacttactggtacattttttaaataaaatatactggaatgtttatagttggggtatcattaatgcttctcatatcataggccccaagctggaatattaggcctcatcaatacaaacatagatgacttccacccatcaccttctcattaagtatcctttccttaggcttacataggccatagggttttctaaggggagatgtccataaatgagatgaaagccaagtaattcttaggcaatgacagagattgctcctgctaagtgatcaccaaagaaggtactagctactgataaagtgaaagcttcactatttgctaactaaaggagctgtggtagtccatgcattaggcaatggtgggctgcctctgaggaaagctggaaaatctgtgacccagttcccacatagataccgaatgtgcaaacgcaccccctccttgccattacggcctgaattgcacctccccaaaattcacatgttgaacttctgaggtatccttcgtacctcagactgtgagggtatctgtagataaacatttaaaaacgtaactaaggtaaaattaggtcatgtgagtggaccctaatcccatctgactaatgtgtccttataggaggagaagacagacacaggcatgagcatgttcagagaaaagaccgtatgatgatacagtggggaggcggccatctaccagccaaggagggaggactcagaagaaactaaccttgccaacaccttgatcttagacttccagccaccagaactatgagaaaatagatttctattattggaaccattcagtctgttacagcagcctagcaaactaatattaatacattgccaagtgaacccttttggctctcctgagcaacagttatttactcttcctaggcaatttcaccgacagtgcctggcccttagaaggctccataaacatttcttaactaaatggcttaaaagacttatggggtactctactttctgacttgtcacacaactgcccttgggtgaaaattccagagccagttaatttcttaaatgtggggataagaaagcagaaaacatttttaaagtgttaataacttaaaatatcatccagttatatgccacaatagccaaagaatatatttccaggataaaccaaaaggatgtatcaataggcaactcaaatgctttattaacatattaaaagaaatttttgccttgattcttaagtgttagataaaatttgaagtatacactgttctcatctattaaggcttagaggtctttcaaaaagtcattagagaagttgttaactggatacttctgcatactaaaagttgacctcctaaaacatgtcaacctacaataaagacatatgtgacactggaataatctgactcaatggctgaattttgcacaatgtgtattaaagcttagaactgagagaaatggaattatcttattttcaaaaattattttagcaggcctaataaaaattaaagatactaggtgtaagtgttaactaaaataaaaacagacaaatctacagctacagaaaaacagtctgctcaagttcttcctgcaatggcataacgacgcagggaagtcaacccttccacctggggtcatgatccttcttcccaagattttcagtctcacccaggttcctcacagtatcacctttgttagctttcagtactagaagttaccatattctatgtatttctttatatattcatctgtctcgagaataagcatctggagattgggaattctgtccttttcactgctgaatgtctaatgctttaaagcatgtctacacatagtagtttctcaatgaagccttttcagttgatggattgaccaaaatattcagtaaagtgtttcttaatacggaaatcatggaccaaaaagaaactgacaggagagttataagaaaatctcaaagaaacagtgaaaatctgaattgcatgcagatagtgggcagcaagctacatgacaaatgaaatgagatacaattcagagaataatttgaatacagcattatttgaaaattacgattcttgatagagtagaaaaggtggaatggaagggcaccatggagcccttagagtttcataaggagtctaaaagccacttacattttaaaaattaaaaggttggtactaaaatatctttatgtacctgtttactttctttatacaactacaaaatttgcagggtttatggagcacagcaaagtgctttgatcaatgccactttacagatgagtaaaccaaaggcttagagaaggtgaataactgcccaaagtcacaaaactagtaagtttaagaattgagctctggactcagaagatgtcggttaggaaaattacaatctcaaaaatactccatggtcaattttgactctagtgtccaatacagtcaacatggttcaaaaaaaaatcatctcacctctcccttaacatgaatttgggtctgggcatattgccaattactataattcccataatattgctcataatttttcttgcccataaagaggatctcaaagcactttcagtaattgtgactgatcaaattgttactatttatgcttgctgttcaattacaaatcagttcaatataattaccttgttggattgttgagaaattgccttattcattgttgaagactatcttccaacttggtaatttctaaataaagcagtgtcctttcttcatgttgtggcataactcttagcttttgaaggaccagaagaagaaagggaaattttatcccactgtataaaaactaaaataaatcaaaaaataaactaaataagaaaagctatgggagaaatggataaacaaaataaacagtagaaggagacaaaaacttattttagggcatgtagcaaataatagctaatgagggtagactacgcttgaattagatacatcgaaagcacaaccttagattctctccatctcacttatccttaagaccctcagcctgttcttctaagtaactacctcataggcccactctaaaaccagcagagatgtgtggttcagccaattgcaactgacaaagcctgaaatccttgtctcttcccactactttctgactcagatgaagtacccagctacaggacatgggaactggcttctttagttgtgtaactaagctgcacaacttagtgacaaccccaaaatgtagaagcgtcaattcttcgtagtgtttactctgactattgagtgactggagatgggagggaagctgtagataagttgctttgcattccccccttacatgaaccatctgggggcaaggtgcttttaaataatctgacagaaaacctcttgcatggctggaaaattgcctgtgtttgtttgtgaagccaagcatagttcagtgatgtaccaccttatgtttgctgtcttcctctttacaacttaactttttcctcactctcagagccctggaattagatttaccaataaagcattagcaccttagctttgcctcaggctctgttctccaaggaccctagaaaaagtcttatgtactatctgaaagctctcaatgcacaaggtagaaaatgggggtatataatgagcttctaaattagtagaaaagacaaacactttgatgataaatagagattgggttgcctattcatgaagagttagtctagcacaattttgtgcccaatatgtaagtcaactacaaatgcccaacattagcattttagcagcttagcatggtgggggaaaaggctctgtttacataatgatatttttcccatctttcagaagaaaacacaattacaagtgcatttttgaggaataattttttcaggaaaagtaatgcaaccaatcatccaaggtacctataaaaatttaattacgattatcaaataaaatgcagggaaatagcaacagaaactactaaacatgtcttcaatccaccagcctcgagaaaacactggactttacccagctacctcttgttgtctagttacccgctcttcaaactgagaatcatcagctgaatttcaaaacagaattatgcaagtttatttgatttcctctgcttgcctctcatgaaaagacataaaaattaaaatggattggtagagatggtaggagctttcaggtgaacacgaaatactgtcatcaatctcattgtttcagggaacagtgggcatggtggcacaatcaggctgaacagagaaaagcatttcagctgtggccactatgaaaaatgagataccaccgaacaaggcagcaatttcacacaagcaagttaacatacttcctttttaaaaagctccagggaaatctgaaattgcaagtaaagggattaagagaagagatgctaagagaaacccttgacttttctctaaaccactacataatttcactagaacaaactctttaagccatgaggattacaatttcctgttataagagccatttcaataaaaggtttgctgattactttgaaaagttaaaaaaaataaagtaaaaaaacaagtaagtgaaaactgattgctcccatgacatgaactgcttattgagttttaatgtctttctcttctgtaggtttcaggtggaattagtcaaaaccaaacgtggattaacagcataagaggtaaataagtacatatcttgaaaaattagaagacacatcccccctgagatgtgtctctcagagttagaagtcagagtctttcctattaacagattatgttagtattgttaatataagttaagactaatgtgtaaataatctgtcaaaatacaaggaaaaaaaagaagcttagtagctacacaactctgcttatttttgttggtatttgaaagcaccaacctctctagttctatattagactctctgttattggtttgtgggattctttgtctttaagactgctccttccaccttgctttcacttactctaatcagacaacctatctggggacttctcatctcataggacaaaattattcttaataagcttcattcatccctatcctcatctcatggccataatagcaatggaataaatgccaggatctgtaagaatttccaagcatttaggggagatgatcttgcaaagataacattgttctcagatctttctcttgctttatcagaacttagattttatttcctttttctttgagatcctgcccattttcagtgagaggaactaatttttatatgattttagctaatatcttttccagaaaaaaattttaataacttataaagtaaacattttagtcaccatggaatgcaaagagggaggaaatttttggccaggggccccttctattctccaactataaaacatggaaggttacctggctaacctatgcacagtgccagtcctaggttagagacagattaattaatagcatgggcaaataaaacagtgatgtaagcagccaggtagtggatttctggggtcagatcctggacctcaagtatccacacaattacaaaagcaaattactatatatttattgcatagctgcatttattgtcaaggttgttatacataaatagatttcaatacttattttttccctcttaaattgccatcacattgctaaatagcaagaacattcagaccagaaaattgagttattttttaaaaggaaagttaagtggacagcagctgcaggattattacattcccttgatttattttttatttacagatgcacattttcattagctgggatttgaacagaatggatttttacaacaataaaagaaaaagcaacccaatttgggcttttatacacagatgggcttctgtctccttagacagttttgagtgtatcttcttccaacacagcccagatgcatctatttgtaaatgttcagctcgcagccttgaggtagagggcataatttccctccccagtctgaagaacaaatctcagatgtaacgtgttttctgtatagatgtaaggaagtcccagagaggtaggctggaaatgcaaacaaaatttttccctttcttcccattataaattaaggcatttcatgcttctgtgattcttttttcacttacatatctgtatttgctacaatgcttttctagatggctttaggctgtattacttcctcttgccttagaaaacaatcaaatttgtgttgccagtgtcccagactaagtttcatttcttcacagttgttaggactatcctctaaagctctcaaatgtttattgttttaggtttctaatcacagtggttataaataagcacagattctgaagagtccttatatgcggtacacattttcactgaccagtctagtttgtttgggcgcctaagaaatgtttaataattaaataaattcaccctggatgtggtaaagaacttgaagatttttaaccacacagccctgccttagcttcggaggtggtgctgctaagacatctcaggagcactggtttagaattttattaatacttcattttctaactctgttagggtagcaatacagtatctttactattaggaaattggtaggatgtagtgctactggactagccaagatggtaaatgggcatcaatacaattgacggcagatatctggaatgctgggtggagaccacagtggcaagggtcttcgtgactacaggatcacagactgcggaagacatctgagccctgatccctgggtttgtcctctgcctctttcctattccatgctagccccctagagggtccaacggaagctaaagaactaggcaagctttaggtaagccttgcccactccagacttttgtccatgtccctgtacctaaacacactagaaactgtggttgaaaaagtaagacagtaactaacgtatcagcaaagcaaccaggatattttccctggtgattttaccacttgcaagcttcctggcccattgcctcaaggacattgttttcacttgtccctggcacgtgcctatccatatttatggatgagtggattatcactagacaaagacaaattatctttaaatctgaagctataaaatgtttatgtttgttgatttatattgcccagttgttctcccagcagggtggttagcagggtgacataaaaataaaacagcatccaccctttctatgccaaatgtaggaaaagagttaaaatgatgttcccaaacatggatggtggccctcactttgacaaaactaaatgagtagtacaccttctaaactacagtgatgacaaagaaaactcagttctctatcctaagtaaattacacagctagaagtcacttccaggtaaagacctgtacatcacctttcaatccaccgaggactgtgtaacagctcatctgattccgtgaaatctggagtatcaccctctgtttcaagaacttcagtggttaagtcccaatttaaacattcctcttttatcaaatcctgtgaaagaaatctctttgaactttacctccattttagatgtaatatttgtgtagaatttatagtcagtgtttggtgcttaggttttatttgtccaattttttaacttagcatgagttcttctgagattcatctctgcttagaaagcaataatagaataaaaacaaatacataaataaaaaggattttttttcatagaaatactgacacaacctttaactagagtggagggagtcgtgcggcagtaataataaaagtagcaaacgttagcaatctgcttcatagcatgaaataaaatattttagtaaaaacatgaatactgctcaactgtaatttttcacacagctgtgataaaaggatgataaaaatgataaggcataacaattcctgagtaaacatacatataaaatgaagtggaggttcaaatctaaagagtatgttttactttcagattctaaacatactatggctgatgccttgtgttttttatttttttaacaactatcaattttgttcacttgtacaatttaatggaggctagcagcttccaaaacctgtgctgcattaggagatattctattctagcctgtgcatttgacatcttgtcactttgtaacattacatacctttgaagagatagcctatctattgcctcctgataggaaaaaaatagcaaaagcagtaccaatcaatctttccactggaaaaattcattttcttagaaatgattatgtccctgcctattaaaaatctgagtctttcccaaagtaatagaatacctcttaaatcattagaacaaatggatgttcttccaacaatgagagcaattatttttcaaaatagaaacattccttctagaatgttctaccagatgtaatttatttggggcaaataaatgatttttaaggaggttaaaacataaaatgttcttagaaaaaaagatgactatatatttttacatactatactagtcactatttcggtagaacaatctgtgacctctcggtcaagacacagttaaagaaacatagataagaagaaacaatcagtttggaacttacaataaaataactactctcgcatctacattaagtttgtgaaccattacatctggtagccacaaaacatatatgaacctgtggctctcaccttcttttttttcttcttctttctttgccatatttatactttctttttctttttctttttcttttttttttttttttttttactatactttaagttctagggtacatgtgtacaacatgcaggttacacaggtatacatgtgccatgttggtttgctgcacccatcaactcgtcatttacattaggtatttctcctaatgctatccctcccccagccccccaccccctgacaggcccccagtgtgtgatgttccccaacctgtctccaagtgttctcattgttcaattcccacctgtgagtgagaacacgcggtgtttggttttttgtccttgtgatagtttgctgagaatgatggtttccagctttatccatgtccctgcaaaggacatgaactcattctttttatggctgcatagtattccatggtgtatttgtgccatattttcttaatccagtctatcactgatggacatttgggttggttccaagtctttgctattgggaatagtgctgcaataaacatacgtgtgcatgtgtctttatagtagcatgatttataatcccttgggtatatacccagtaatgggatggctgggtcaaatggtatttctagttctagatccttgaggaatcaccacactgtcttctacaatggctgaactaatttacacccccaccagcagtgtaaaagtgttcctatttctccacatcctctccagcacctgttgtttcctgactttttaatgattgccattccaactggtgtgagatggtatcctactgtggttttgatttgcatttctctgatgaccagtgatgatgaggatattttcatgtgtctgttggctgcatgaatgtcttcttttgaaaagtgtctgttcatattctttgcccactttttgatggggttgtttttctcttgtaaatttgtttaagttctttgtagatcctggatattagccctttgtcagatgggtagattgcaaaaattttctcctgttctgtaagttgcctgttcactctgatggtagtttcttttgccatgtagaagctctttagtttaattagatcccatttgtcaattttggcttttgttgccttgctgttgatattttattcatgaagtcattgcccaagcctatgtcctgaatggtattgcctaggttttcttctagggtttttatggttttaggtcttacatttaagtctttaatccatcttgcgttaatttttgaataaggtgtaagggagctctcgccttctaactgcctttacgcatgacctggcacacagtatttattcactgtttatttataaacacgtatcaagtacctttatgagacatggtagctgtagagacctgcccgcctctatggttgtagttgagctacctgttcaacaaagttctgtattcctatcccacagtgcctagggaagtgtcttcctagccagacactaaattttttagtttttctttgcatctagatgtgggcaggtagctaggaagtaagaagaagagatatgattccttctgagtcaacatggttaagaagcaaatatggtctctttgttctctttcccttatatggcatccttggaattcacgttttgaagacggcaatgccccaagatagaaagaccctgagtttctgcatcaccacacagaagacagccagaaaccacatgaaagtgctttgagagtgagaataagcttaagttgtgttaaactacagtcatgtgctgcataataacatttcagtcaacaacagacagcatatacaagggttatcctgtaagattataatggagccaaaaaatttctattacctagtgatattgtagctgtcataacattgtagtgcaatgcattactcacatttgtagcaatgctggtgtaaacaaacctactgcactgccagtcatatagaaatatagcacatacaattatgtacagtacataatacttgaaaatgataacaaatgactgttactggtttatgtatttactatactatacttttaatcattattttagagtatacttctacttcttaaaaaaagttaactataaacaggctcaggcaggtcaggaggtattccagaagaaggcattgttatcacaggagatgacagctccatgtatgttattgcccctgaaaaccttccagtgggacaagacatggaggtaaaaaacagtgatattgatgatcctgacactttgagtcttaggctaatgtatgtgtttgtgtcatttttggcagaaaaaagtttagaaagttttaaaactttaaaaaatagaataaggatatgaagaaaatatttttgtataatgtgtgtgttttaactaagttactacaaaagaatcaaaaagttagagaagagtttaaaatttataaaataagacagtaagctaaaattaatttattattgaaaagaatttataaatgtagtatagcctacatgtacagcatttataaagtctatagcagtatacagtaatatcctaggccttcacattcattcaccactcactgactcacctagagcaacttccagtcctgcaagctccattcataataagtactctgtacaggtgtaccattttttatcttttatagtgtgtttttaccatgacttttctatattatgtttagataacacaaatacttaccattatgttacagttacatatagtgttccacatagaaacatgctgtgcaagtttgtagcctaggatcaacaggctataccatgtagcctaggtatatagtaggtttgggtaccatctatttttgtattagtatattctataatgtttgtacaacaataaaatcacctaacaagccatttttcagaatatatccccattgttaagcaatacatgactgtattttaattttgggatttatctgttataataactaacacaatcatataaaataatcttgttctcagaggaacttacttctaacaagggagaaaccctccttcaaatgtcttttggagataagatacagttatataaaataatgaggtgataaggcaaagaaccaaaaattatagcttaagaaatcagccacataataaaattaaggaatctgggttgcaaggaaggatgggatcacttaagtctatagagctgttagaaaaggccttatgttggaagcatccttttaacttcatttcgaaggatgggtagcagtgtaacagtgagaaatgaggtcgaaaggcatttgatgcagaaggaactgtatgactaagcagggaagaagtaaagtgcaatgatttgggaatagtgaattgtctgcccaaaggagtatagcctgcacagaagtaaccatgaaatggttaaacagcaaccctccaagttgctatagttcagaacttactgataacctgacatatgcattataaagtccatggctttggcactatggagggagaaagatgtatttgaggaaggtcatctcaccttcaaagtttttctcttcttttcaaaaatccaggtactaaaacatctctctcaccactgtagataatgagagagtgatacagggacttcaaagatctgagaggtcatagaacagagaggggcaagatatatttccagtgaactctaaactaaaaggaaatcattcccctgaaaattgacatttctcaagaagcatcataaaagtgacaaatcctccagtcccctcaaaaaaatgcattagatttgtgctattgtcagcaagaatagggcaaataatgttacattgattacagagccttcttcaactttgtgaatgagactagaacttttttcttgatataaagctctgataaataaccatcctatcagagatggacatgttctacaaacagtgactgagaaatctagatgataagaggggataatatggctaagaagcactgcaaccttatttaaaaggggttaaaaattgagaacagaacctcactatacaataactatttttgaatatttccttacgcttaagtttataatttagaaaatatgtgttttcactccaaaatatgaatacattcattctttagaatgatcctttcaggtctgtaattgacagctaattaattatttaataatatctagaaaacacatctgcattacactttagtttatatgtagaattgtacatttataaacaaatatccatgagcaaataactctgcttccctgcaaaaagtcagataagtcttgtctacagaaagagaatattctccttttttaaaggatcatcttggcaaaggtgcaaaagagacctggccaaacataaaccagttcctactacgttctttttaaaagtttgaatcacattagtatgactccttaaaaaaggaatagtgtttctttgtttctgtttgcctttttaaagacatacatagttttcacacgttttgttgttgttgtttttgcaaacagtagaggtcctagcgatctgtgttgtttgttcagcttcccttgggctacggaaaagtcagaggctcatttccaagagagtactgtgtgaaaacacagtggagagaagttgtagagtaagcaaaggaaatgaccccaacggtttgttcaacagtttggcagcagcttcctatacctgggactaatcatgccaatccctgttactgtcaaatgtgtcctaagcaagtgtcccctctttttttttttttttttttgctattatcttgcttcgtcttaccttgtgctacaataatttataagaagaggagtttcagataaatttatgctttaaagaaattttcttttaaattgatgcaaatgtcaagggaagacaaaatatcccccaactacacagatcagtttccctcctttctctctttacataccattccaaaaaatctaaaatatgcattactgaagattcttttggataagaaaaaaaaggaaatgtactctgggcatgaacaataatttttctgaagccttaattctttctaaaatggaaaactattggaaaactaacctgcatggttctaagaacattttccacaaaaaaaaaaaataataattcaattcaaagatctaaacctgagtagaatttatggtgattgctcttagtctacatgcttacctgggttttctcttcagaaaagccatactttacttcatatcataatcttttctttttaacttggcaaactcattttctatcttctcaccttcttacactccagcaatgatgacctactttaattcattttaatatatcctggtgtttcatggcccccatcaatttgctcattctgtttgctttaggtattatagaatgtgtctttcttcctttgttcacttgctgaactcctattcatcttccaaaccctttgtgccagtcaaggttcaatgtaagaaataaaagtcagctggatatgccagacagaaaggcatttaatacgaggcatgaagtgccaacaaaactgttgaaaggactagaggagcacaggtccggggccaccaaaaagttttcaggtcacatggctacctatgtcagagttatcccacagccaaggctggcagtgaaaaaaggagtctgtgcattgccatatatatatatgtgtttactgtatatatatatatatatatatatatatatatatatatatatatagtatacagtatacgtatatatataaatatatatatatatttgctgtatcatatatctcaactgctatcactactaaaggaaaaatgaactctacctccctcctgccttgcaaattttgcaccacagtctctcattacagttattagccttccaactccaaggtgtagggacactgaagagaaggaaataggtgcttcttgccaaagataatatctaagactccatagctcaagcctcatatcccatcctcaagcctctctctggactttccacccccaaataatcttgcttcatcattcccttcactttatcacctctattctttactaaacatattcttctattatcttagcagtcccacaatattgcaatatagtatttatagctatgtctatactttataaaccacaaggtatctaagacaagtctcaatcaatttagaggtttattttgtcaaggttaaggacatgctggtgacacagcctcaggaggtcctgataatatgtgcccagggtggttggatgacagcttgattttacacattttagggaaacatacgacaccaatcaatacatgtaagatgtacattggttcagtccagaaaggtaggacaactcgaagcagagggaggctgcagggagcttccaggtcataggaagattcaaagattttctgattggcaattagttaaaagttattacctaaacacctgaaatcaatagaaaggaacatctgggttaagataaggtgttgtggagaccaaggtttcatcattcagatgaaacctccaggaagcagacttcaaatctcttatcacacctaaaaagatgtcagactcttagttaattctttcctggatcagggagaaaacttggaaaggaaggaagattctctaaagaaagtagattttccccacagagacagctttgcaggaccattataaaatatgtcaaagaaatatattttggggtaaaatactttgatttctttcagggcctgctatccattgtgtgatgctatactagagtcaggctggaattatttggtgtcttattgctgttttgtcagtcttgagatctctgtttgaatgttaatcctggtaagctgtgcctgaattgcaaatggagggcaatataataaagtatgtccaacccctgcttcccaccatgctctgaactagtttttcaggttaactttggaatgcccttggctgaggaaatggtccatcggtcagctgcggggtgcttagaattttatttttggttcacaaatacatgtgtttatcattttattcatccttgtttaatcttcagtgcctagcatagactctgaacataatatattttatacattttatttcaccaaattttattaaatatcactttaatttgcaaaagaattactaactttgaaaactgaaatttgctgtttcaatatcctctttcagtagatttgaaaaatttggagttgggaagtagtgacattcaactcaactgaaatttcagtaaattctccttttcttagaagaataataggatactattcaattaaaaatatgaaatttgggggttctttggttctaatagattatttccttaatgtattctccagtgatcaatttgctcttctcaattggaaattaaaaaatgaggtatgttattgcacttatttaaattatagttcattttgaattgtgttaaataacctctgggcatgcttataaggctcacgagtaagaatacagcaagcaattggaatttcttttaaaaaaaaatagaccaagtacccatgcccatggagccttgctcactgctagcacagcagtccaatattcaactgcaaggcaggagtgaggctaggggaggggcatccatcattgctgaggcttgactaggtaaacaaagcagccaggaagctcgaactgggtggagcccactgaagctcaaggaggcctgcctgcctttgtagactccacctctgggggcagggcattagcgcaacaaaaggcagcagaaacttctgcagacttaaacgtccaggtctgacagctttgaagagagtagtggctctcccagcaaggagtttgagatctgagaatggacagactgcctcaagtgggtccccaacccccgggtagcctaactgggagacgcctcccagtaggggccaactgacacttcatacagccgggtgcccctctgagacgaagcttccagaggaaggatcagtcagcaacatttgctgttctgcaacctccactggtgatacccaggcaaacagggtctggagtggacctccagcaaactccagcagacctgcagggagtttgttagggacgtgactgttagaagcaaaactaacaaacgaaaaggaacagcatcaatatcaacaaaaaggacatccatgccaaaaccccatgtgtaggtcaccatcatcaaagaccaaaggtagataaaaccacaaagatggggagaaaccaaagcagaaaagctgaaaactctaaaaatcagaatgcctcttctcctccaaaggaacacagctcctcgccagcaatggaacaaagctggatggagaatgactttgacaagttgacagtgtaggcttcaaaagaacagtaataacaaacttctccgagctaaaggaggagttcgaaaccatcgaaaagaagctaaaaaccttgaaaaaagattagacgaatggctaactagaataaacagcatagagaagaccttaaatgacctgatggagttgaaaaccatggaacgagaaatacgtgacacatgcacaagctttaacagccgattccatcaagtggaagaaagggtatcagtgattaaagatcaaattaatgaaatgaagtgacaagagaagtttagagaaaaaagagtaaaaagaaaggaacaaagcctccaagaaatatgggactatgtgaaaagaccaaatctagatctgattggtgtacctgaaactgacagggagaatggaaccaagctggaaaacactctgcaggatatcatccaggagaacttccccaacctagcaaggcaggccaacattcaaattcaggaaatacagagaacaccacaaagatacttcccgagaagagcaaccccaagacacataactgtcagattcaccaaggttgaaatgaaggaaaaaatgttaagggcagccagagagaaaggtcaggttacccacaaagggaagcccatcagactaacagctgatctctcggcagaaactctacaagccagaagagagtgggggccaatattcaacattcttaaagaaaagaattttcaacccagaatgtcatatccagccaaagtaagcttcataattaaaggagaaataaaatcctttacagataagcaaatgctgagagatgttgtcaccaccaggcctgccttacaagagctcctgaaagaagcactaaatatggaaaggaacaacctataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaaagccccaatgaaaagacacagattggcaaattggataaagagtcaagacccatcagcgtgctatattcaggagacccatctcacgtgcagagacacacataggctcaaaataaagtgatggaggaagatctaccaagcaaataggaagcaaaaaaaggcaggggttgcaatcctagtctctaataaaacagactttaaaccaacaaatatcaaaagagacaaagaagaccatcacgtaatggtaaagggatgatttcaacaagaagagctaactatcctaaatacataggctcccaatacaggagcacccagattcacaaaacaggtcctcagagacctacgaagagacttagattcccacacaataataatgagagactttgacacctcattgtcaacattagaaagatcaatgagacagaaagttaacaaggatatccaggaattgaactcagctctgcaccaagcagacctaatagacttctacagaactctccaccccaaatccatggaatatacattcttctcagcaccacatcgcacttatcccaaaattgaccacatagttggaaggaaagcactcctcagcaaatgtaaaagaacagaaattataacaaactgtctctcagaccacaatgcaatcaaattagaactcaggattaagaaactcactcaaaaccgctcaactacatggaaactgaacaacctgttcctgaatgactactgggtaaataacaaaatgaaggcagaaataaagatgttctttgaaaccaatgagaacaaagacacaacataccagaatctctgggacacatttaaagcagtgtgtagcgggaaatttatagcactaaatgcctacaagagagagcaggaaagatctaaaattgacaccctaacatcacaattaaaagaactagagaagcaaaagcaaacacattcaaaagctagcagaaagcaagaaataactaagatcagaacagaactgaaggagatagagacacaaaaaacccttcaaaaaatcaatgaatccaggagctgattttttgaaaagatcagcaaactgatagaccgctagcaagactaataaagaagaaaagagggaagaatcaaatagatgcaataaaaaatgataaaggagatatcaccaccgatcccacagaaatacaaaccaccatcggagaatactagaaacaccttacgcaaataaaatagaaaatctagaagaaacgaataaattcctggacacatacaccctcccaagactaaaccaggaagcagttgaatccctgaatagaccaataacaggctctgaaattgaggcaataattaatagcctaccaagcaaaaaaaaagtccaggaccagacagattcacagccgaattgtaccagaggtacgaagaggagctggtaccattccttctgaaactattccaatcaatagaaaacgagggaatcctccctaactcattttatgaggccagcatcatcctgataccaaagcctggcagagacacaacaaaaaaagagaattttagaccaatatccctgatgaacattgatgcaaaaatcctcaataaaatactagccaaactaatccagcagcacaataaaaagcttatccaccatgataaagttggcttcatccctgggatgcaaggctggttctacatacccaaatcaataaacataattcaccatataaacagaaccaaaggaaaaaaaccacgtgattatctcaatagatacaaaaaaaaaaagcctttgacaaaattcaacagcccttcatgctaaaaagtctcaataaattaggtattcatgggacgtatctcaaaataataacagctatttatgacaaacccacagccaatatcataatgtgtgggcaaaaactggaagcattccctttgaaaactggcacaagacagggatgccgtctctcatcactcctattcaacatagtgttggaagttctggccagggcaatcaggcaggagaaagaaataaagagtattcagttaggaaaagaggaaatcaaattgtccctgtttgcagatgacatgattatttatatatttagaaaaccccatcatctcagcccaaaatctccttaatctgataagcagcttcagcaaagtctcaggatacaaaatcaatgtgtaaaaatcacaagcattaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaatcacaagcattcctatacaccaataatagacaaacagagagccaaatcatgagtgaactcccattcacaattgcttcaaagagaataaaatacctaggaatccaacttacaagggacatgaaggacctcttcaaggagaactacaaaccactgctcagtgaaataaaagaggatacaaacaaatggaagaacattccatgctcatgggtaggaagaatcaatatcgtgaaaatggccatactgcccaaggtaatttatagatttaatgccatccccaccaagctaccaatgactttcttcacagaattggaaaaaactaaagttcatatggaatcaaaaaagagcctacattgccaagacaatcctaagcaaaaagaacaaagctggaggtatcacgctacctgacttcagactatactacaaggctacagtaaccaaaacagcattgtactggtacccaaacagagatatagaccaatggaacagaacggagctctcagaaataataccatacatctacaatcatctgatctttgacaaacctgacaaaaacaagaaataaagaaaggatttcctatttaataaatggtgctgggaaaactggctagccatatgtagaaagtagaaactggatccttccttacaccttattcaaaaattaattcaagatggattaaagacttaaatgttaatcctaaaaccataaaaaccctagaagaaaacctaggcaataccattcaggacataggcatgggcaatgacttcatgactaaaacaccaaaagcatggcaacaaaagccaaaatagactaatgggatctaattaaactaaagagcttctgcacagcgaaagaaactaccatcagagtgaacaggcaacctacagaatgggagaaaattgttgcaatctactcatctgacaaagagctaatatccaggatctgcaaataacttaaacaaatttacaggaaaaaattcaaacaaccccatcaaaaagtgggcgaaggatatgaacagacacttctcagaagaagacatttatgcagccaacagacacatgaaaaaatgctcatcatcactggccatcagcaaaatgcaaatcaaaaccacagtgggataccatctcacaccagttagaatggcaatccttagaaagtcaggaaacaacaggtgctggagaggatgtggagaaataggaacacttttacactgttggtgggactgtaaactagttcaaccattgtggaagacagtgtggtgattcgtcaaggatctagaactagaaataaataccatttgacccagtgatcccattactgggtatatactcaaaggattataaatcatgctgctataaaaacacatgcacacgtatgtttattgcagcactattcccaatagcaaagactcagaaccaacccaaatgtccatcagtgatagactggattaagaaaatgtggcgtatatacaccatggaatactatgcagccataaaaaaggatgagctcatgtcctttgcagggacatggatgaagctggaaaccataattctcagcaaactatcacaaggacagaaaaccaaacaccaaatgttctcactcataggtggaaattgaacaatgagaacatttggacacagggtgggcctgaagtgaggtagggggaggggagagggatagcattaggagaaatacctaatgtaaatgatgagttaatgggtacagcacaccaacatggcacatgtatacatatgtaacaaacctgcacattgtgcaaatgtgccctagaacttaaagtataataaaaaaaaaaaaaagactaagtatcaaaagaatgttcaaataaggttcagaatataattttatgttcactcacaatttcttcactcaagtatggtggacagataaaaaatatctatacgtagcctttctcatccctggagtggggctgagctactttttcaaaccaaactaggcatggtcctgtgattctaaaccatgaagttatatattttttaaatatccatagacatgtaatattcctccagactccatgcaaaaacgagttgtccaccggagacttgattagagggaaaactagtatttaataaaactagcaataaatttttaaatactaaactagaagtgttttgtgtataattacaccacaaactaagagattattatatagctaaaggtggatttactttcagtttcacataaattctgtaataagaatcaaaagtaaaattagactatactagagaaaaatcagaagcaggcattgcaataatcagaacagaaattaactgcagaagatacagctttcatcatcagctttcaagatacttttaagtgtttctcttgacctttaaaatgaagtacctgagttataatacttgtgctgagaatatcaaagaatcagaattcagcaataatatggactcaatgtttgtgcccctcaaaattcatatgttgaagccctgactgtcagtgtggctgtacttgaaaatggggcctctaaggaactaattaaggttaaatgagataatgagattggggccttgattcaatacgattaatgtccttattaagtagagacactagagaatgctcgtgtgctcgctctcgctctctctctctctctctctctctctctctctctctctctccctccctccctgccttcctccctccctctctctctctttctgcacacagaggataggacatgtgcagacagtgaggaggtggccatctgcaagccaggaagacagccttcaccagaaactgatcatgctgtcaccctaatcttggacttccagcctccagaaatgtaataacaataatttgttgtttaagccacccaatctatggtattttgtcatggcaaccagagcagaataatacagtcatcaagactgccaacaatcttctaggatccttttcctgctcatactccctatccccacatacacacatataatgatttcaccaaaaagctgatggcttagcaagcagcatatggaaagggggtggctaaaaaagtattaagattcttatctattactatcaaggaaaatttcatgcatatacttttttgctcctctgagatctcttccacttaaagttactactgatataaatatatagataaaattaatgttatactcattatatatcataagaatgttgaggtaaggccatcagagtgtgatttagccacctagggaaaccctgagccgacttttgttggtgtatcactaaatggcaataatagaaaggggattctgaggtcctcattctctcttatgagaacacaaatcctactatatattactgtggtaattatttattgtatataatgtgttaaaaaaatttctagattttggcaatataattgacaatataaatcaatgtatttcaagtcattgaaatacaagctaaatttaagaggtagaaacactatcacaatcaaattaatacttggaagacactagatccattatttccaggaaaagggataattttggtacaactaataaaaggtatatcccaaataaattggtttttcagcctacttactatctactttcttccaaattgttaacttataaagacttcttctagctctaagcgagaaacgaaagccaaaaactctaaattcctactcttatgatcttgaggctaagactctgaaaactacttttgtcctctgtcagatggccttttgctaggagcggccaggaggaggcacaggaaaaaccctgggaggcagggaaggggaggaaagaattcttacttcctgttcctgtcttccttgcagaatgctagctctgcactccaacagcacccatttgcattcttagaactagtttcattgccctcttctctgaaagattcatagtagccagggcgtgactgctctcaagtaatctgagccccaacttacagagtctgtactcttctaaattgtaaaatccctaacctcttccttgtgtgcttctggccctggagatggtagctactccttgctgttcttgctgggctttccggttttgttctttcagccttatttaagattatgttcccattgttgaaatacctagtgtgcttcctgttttcctgactggactttcaccaatacatatatgaaaaaattatctttaaattttaggaaggagaacccaagtaaaactatttaaaattccacatagatcttccaaaattgaaaaccatttcaaatacaaatggatttcatatatctatatatatacacacacatatatatgtgtgtgtgtgtttatgtgtgtgtgagtatgaattttatatatacatatgtgaattatacatatatgagtatatatatgagtatatatatacacacacacacatatacatacacacacatatgaatgaaagactcctttagaagcactttgcctacatggtacaaataagcataggtttggggattttacatacagaaatagaattatgccatatattttgttctgcacacaaaacagttaactgtgtaatgacaccctaaaaagtgagagtgagagcaaagatgaccttcacttttcacttttgacattgattaggttttttatactgagcattttacagttgcaattaattttttaagatttgtgctgttgaagcaaacaattttctgttgttttacaggttattgataggatcaccagccctgtccttttaattgcctaacacagtcttaggtagcctacagcaggcacacattaaatgaccaataccggcttcaagtttctcctctctaacttggcaaaaaagattaaccattatggttcaagccatgtatgtaacactctagtccaggttttctcgtcttgaatatccatgcctttgtaagcataacacaattcatgcttcagtataacactggggtcgtctttacagaacacagatcatgttaccaaaagtgacttcaaactaaaataaaatgcctatttttatttctcaaacatggtgaaaacgaaaaatggtcctagtaacattttttatcaccgttttcttctttcacccctgctatgacattatgtttgcgctcccaagctacacccctcaaatcctcctcacacctcacaacaaaaacaaaaacaaaaccaaactccttccagcaatttctagtttatcttttctttttgatcttgcatcacaaaatctcagatattaatctgtccaatataacacattttggacagcctaggagaggaagagtttgagtaggtcagaccagaattcttttgagtagggaggaggaatttaaggaactgacagcaggtaactgatatctgcccaggctgtgtaggctgcatggtgctatagctttccctctctgtagattcagggctccaaatgtatcctttatgacagtgatgtcctctttgcagaactaacatttttctaacgctaacaagacaggatggggattttgaacttgttaagttacatctatttatagtggcagcttccatttgaggctccctggtacctcccatttgtgaggctctgtggtaccttcatgcactactatgacacttttcattcttcccaagcaataagtcactagagttattatttattcatttccaactcagtatcctagaagttatgtaagtgcaaataaacatggactaagaatcaggagcaatataattcataatttgtcaaaaaattcatagttgtgataaatgtaatatttttgttcagtttcactatcaagaataaggaaaaatgcctcttctaccactttttaactaatatatgtgaagtatataaaacatgtacaataataggaacatagtacatgtacattaggtagccactgatttcttgcttgaaatataaagtatatgaagtttaaagcactggtagaaatagtaacatttatagttgttaaggagaaataagaaacatcattcccaagagaaatgagcatgtcaaataaccaaggaggaaaggagggaaattattacagcaaggaaaggggagaaatagcagaaacggcaatgttgaatgcaaagatgcctataagtactgaggaatgggatctaatgtcaatgaattcatctgcccaccctagctagtattgcaagatcatgagatttaatcagtttttggcattttaccattggccttctactgaattaacaatagaaaactcttatctcaaaacagattaaaatactaatttgtatacaaatcataactataaaagtctattataccatcttcaaattctgacactggatctctccatttaagaaagaaaaacaaaatacatcacagttccatttgataatctcacacattgggtaatttttcttttattttcattggttttgttttaatgtgaaaatccctcacaaaaaataatcataggatgctgtccaggtatattttagtgctctgggaaaagatgaatagccaacctataataacgcttgttcaaggcctagtaatcactacaaatgctctggcctagttgggaaggccacctcaatccttatcattgcttacagacagcagtaaagcacaaaaacactgctgagtaatagctggtgacctcatcactctttcctacagaatgttgtcctttatcagtgtcagtctcaaatcaatcgattagaatacagcgctggttataaaaccccacttgccttctgcttcagtgtaatgcaaccattctgtttgtttgctcctcaacctcaatttgcaggaaaggaactgcaaagatcaattggaaacctcaacttatgcacaactacttggaaatcatttttttatattgatatagtgtcaatgaaaatgaaagtgaaaaatactactcacttgaggggaaaaaaaagaaatactctcaagagctatgttcaagtacaatacaaaggttgagtgattggaattcttttgtgggtaacctgagtgacagcggaagaatactaatatgttgggcctcggggaagtgttagcctaataatctctgccttctcttacagtgcatgagtgcaagactcttattctgaaaaagaaaaataaagtactgagagatgtttaatgccagtaagagacaataatggtacttagaaatttaacaaaccaaagacaaatccagcacttaaaatttatcccaagcaataactataaattagttaaaaagataccaccaaagttctagatccatgtcagaggagtacaaaagaaagaatatctcagtacctaattgccactagatttctaattgcctctaaacctcttccttaactcttactgcagtctacaccacagcttgagggtcctgttgggtagtatcagcattatcttcctaggattgattctgaaacagctacattttatataggagccccctatatatggatatcactaaagaacaccacacctctctggttaaatttgaaaggatccctttattcattttgtatgttatcaaacaagaaacagaagaacattcattccgggacactgtagccagcatgggaaaacactgcaattgagcagtgtaccatggcagacaaatttttgaaatctgaatttttgtttcttcctatctttttccttttcccttccccaactgaaaagaaagtggaccctgtgcttctttgcttcagggaaaggtatgggatgtggattccttgaaggaagtaggaccccatggaaccaaaaagaaacctgaagaaaaagacagaactttctctgaattaacaacaacaacaaaaaaggctctacaaactgagaaagacaaagtctgtggatgtcttcagtgatggggcttgtttcctgctcactaaaaatgtggcaggacctcagaagaaagagccaattagtatgggttgtggggtaaggtgcctcacccaaaaacatcatactccaagactgtcaatgaagcagtagagaagtggctagaagggcaggaaggaggactaggcagatgggactaacaggtcctccatcagcactcatgtgaaaagctaacataatcacaattatcctcacaacacctttaaatgctcattaagtacaacctacaaacatataatctctcagtaaattcaagtcagccagctttcctccaacactggaacagatcatatttcttccactgaaccccagatcaagtacctggattatggtaaagggtgatgtgcaaaaaaacacccatcagaagtgcactcagtttagctagatgcttactgaaaatgaatgatggagcagatacaaagcttgcacttcaggttcactcctgttaccttcttgaatgccctacaaatagaaataattccctgattgatttttctcactttttttttttaacagagttgaatttcaccggattgcatgaaagaattcaactagattaaaagataaatacattaagcaggaacttccatgaggagagcttcctgaataacctatgttattacgtggttatcatgtgatgtgcaaaatcattggtcatgtttttgttctgaaagtagaatggagagttgagaatttggaaatgcttacttctcaaagacacagtgtgttttgttcaaaagggaattagctttagtgctaactcgacttagggtgaagtgaaagacttcagtttgcctgtgtgctatgtgtactgatctcaggcaagttactgaatctctttattccccaattacttcatctatgacaatgtattaagttggggagtgggggaataaataataactttgaaaatacacacaaactacatgccatagcctagtcgctggaatgcagctattgttggtttgtttctccacgctactctcctctcaaaccttatttcttattctaccattgccattcttgttttattgaaattcagagaatgtcattttaattttctaatgtttgctataatgcttgcaatggcttaggcttcatgtaaaatttacaaaatcttgttatatttttgcatcttcttacagctaaaattttaattcattttcttcaaaaacttcaatactttttagctgttagctataaagcaaataaaagatggacagaataagcaatttaataaaaattggatttgcctttttaaaagaaaggttttaatcttcctaaattggccctttgatgtagataattttcaaaagtgggacacttaatagattaaaagttcatgttaaagtctttcctcggagtaatcaagatttggtaaccctttagaactagaatcattaaaaacagcaaagaggagttattagatgtgaaagatcaagattttcaataagcatggtagacctgcaaattttagcaagctgaagataacattttcactgcacatttctttaaaagaagataaagagcattgaatcaatatatcagtgaagagattattatttttttacaagctgaaggttgctacaggtcattcccagtaaagcaaacagaatttgttaatttaatccaacagacttggcagtgagaccaaacaggaatttaatcagcaagagaaggtggtaagcatctctaaaaattgagtgatcgctgtgcaaacagtaaatatcattatggaagggtgaggaaataaaaagagtgttcctttcatgattttcatcaagctcatcaaatataataaatgattccaaataaaccatttctaggactgcaacagtgacttaatgttacttgtgctagaaaattaaaaattatagttttccagtccctcacctttcttaaatagttttcttaaaaactgcaaggttatgaaatgaacaattaagtgtcttatatgctaagtaaaaacagtaaatgacattttagactttctcctctcaacaaaatgtgccagttctctgatgccaacttgaaggcctttggtacaaagactaacacagagacaaggctaagatgtataaggttaacattagctatttagttctatagtaattgctctaaccatcaaaattaagagtatttttatttttatttttttgaaacagagtctcactctgtcacccaggctggggtgcagtggggaaatctcggctcactgcaacctccatctcccgggttcaagcaattctcctgccttagcctcccaagtagccaggattacaggcccccaccaccacacttggctaatttttgtatttttagtagagatggggtttcaccgtgttcaccaggcttgtttcaaactcctgacttcaagtgatccgtccgccatggcttcccaaagtgctgggattacaggcgtgagccactgcacctggccactaagcgtagttttaaagcacgtatatcattataaaaggataagtgaaaagtatttatcatttatcctcctaacccccaccgccaccatttccatgaagtaatcatgaaggcatattcagaatcttctcacttcctgttaccacagagtttccagcttcacctgcctttctttctttccttctcatttcaaccttttgtaaaactctcctttaattgcaggctctccttatctcaatccagtctccttgaggccccttctttaaaaacatgcctttggaattctcttgctgaacgggctgtgtaggtgtatattatatctaaaacaaaaagactttctcaatggtgttttgttgtcttctctctagctatgaacacacaatgttatcattaaaccagtgaattcactatcctatgaaacctcaataaacaaaatttaattagcgtttcccatgagtgacaaacaaaagtaaattgtgtaataaatggcaaaggtccacatctttatttaaaattctcatggaagtcacttttaagtggaccaaagtaaatggtcaacttaccttgaaaccctagaagaaggttgtctggcttcatacaaaactagaccaagatatgaagagaaaattaaaaactatattaagttaagctactgagaagaaagaaaatcaaggggaaaatcaagggatgctattttaaaggtccgactcagaaaatagattgaaaatcttagctttaggggaaaggagagatgctttttcataaacattctgtgtctaaaattgcgccgtaaaatacatgctcatttatttctaacccagcttttacactgtcttgaatcatttatctccacatttcatctcctagaggaagagaaatttctttcttatgattatactgttaaattgtcttctctttagaattatcgaaaaggatggaacattctgcagaatttcagttagtataagtgtctaaatatccatttaaaagtttatgatacctttcaaaaagggccacaaaatcttctcccatccatatatgcacatcatcccctcacaatgtgcttttgcagcttattccatcaagaggtagatttttgaagagaaaaacactgagagtcgacagagaggcaatgcaaacacagaagctgaagagagaggtatccgggaaccttgcatgtggttgtagagcaccaggattagttctcatccctgaatatgtcctaaggaaaggatgtgtgaagtgatggtacagaagcctactttcaccatgaacctctgagatcttagctacaagatcccatgacccccatagacattttaattggcaaggggatctgcccagacagtaggcagagacagaattccagcctgtacagagcccaggtggatttgcaagtagggcagctgcagcaaaatatgaccataggttaccaaacccctaggctccccaacttcctccaaatagttctaaccccagctgaccacaaggccaggagagagcagggccatctttcccatgtgactggggcacttctcttctgcatgcctctctgcccaccagccacttgaaaggcccctggctggctgttcccacaagagcatgtatacggcacagcctccactgcccagtctgagtgctttgccagtggccccacctcagtgttttcctggtggcctgggagcactaaatctcccctagcatagacaatgcccaaccccaaggggccagaggacaaagctgtgggcctggtcccaaagccccagggtaatagcatacagctaaggtgtgtcaatatgagatccgtggccagcgcttgagcaagggaagagtccccactctcaaaacattgagaaaagttagacacgggttcatgaactgacacaggaacaaggtatactttcttccacaggactggtccatgaaggatgtggcctgtctgccagccacagcctttgcctgaggaatctctgtggcccaaaacacctaataaaagaaacacaagcatgaggtcagtgattggacaggggtcccccccaagacctggtgagggggtcatctctgctcccacactgcacagagcactgctgtgaacatactgaaataaaaaagagctgcatggctgggtaagaaccaatcagccagccattactcttaagtaccatctactggatcgcagcttcttcttccagtatatattctctgtgaaacccagggcaagaatgtagtcactaataaagatcctgtacagaggcttggccctctgaaagtaatccagaaacaaagtgaactcaactatactcaacttacaccaaagttaattcctcaaggaaaataaagaatagaaaaacaaaaagctccatccaaacgacagcaaatccgaaaacacaaaagaacgcaagctttcttggatgagaaagaatcagttaagaactctggtaatttaaaaagtcagaatatccctttatatccaaatgttattagctctccagcaatggttcttaaccagattgaaatgactgaaatgacagacatagttcagaatctggatggtaaggaaactcattgagattcaggagaaggttgaaacccattccaagaaacccggtaaaacattccaagagttcaaagacaaaatagccatttgaagtaaaaaccaaacaaatcttctgtaattaaagattgcactgcaagaattttataatatagtcggaagcattaacaacagaatagaccaaactatggaaagaatctcagaggtcaaagaccagttctttgaatcaactcagacaaatacttaaaaaaattcagaaatgaacaaaacctctgagaatatgggattatgtaaagggaccaaactacaactcatcggcatttctaagggagaaggagacatagtaagcaacttgaaaaatatattcggggatataggccatgaaaatttccctaatcccattacagaggttgacatataaattcaagaaaatacaaagaacccctgtgagatactatacaaaatgaccattcccaagacatatactcatcagattcaccaagtcaatgcaaaagaaaaattgtaaaggcagctagagggaagggtcagatcacttacaaagggaattccatcaggctagcagtggacctctcagcagaaaccttacaagccagaagagaccggtgcctattgtcagcatccttaaagaaatttcaaccaagaatttcatatcccaccaaacttcacataagtgaagaagaaataaagtccttttcagacacacaagcactgagggaattcattaccactagaccagtcttacaggaggtccttaagggaatactaaatatggaaacaaaagaacaatacctgctactactaaaacacacttagacacatagcccacagacactataaagcaattacaaaatcaagtctgcaaaattaccagctaacaaaatgatgggatcaaaatctcacatgtcaatattaaccttaaatgtaagtagtctaaacaccccacttaaaagtcatagagaggcaagttggataaaaaggcaagcctccaactgtctgctctcttcaagagacccttctcacatgtaacaccacccatgggctcaaagtaaagggataaagatctattatgcaaatgcaaaacaaaaatagactataaacaacagcaatctaggaggatattacataatgataaagagttcaattgaacaagaagacttaactatcctaaaaatatatgtacccaatattgaagcacccacattcataaaacaagttctttttgacctatgaaaaggcttagacatccacaaataatagtaggagtcttcaacaccccactgacataattagacagatcattgatacagaaaactaacaaagatattcaggccttaaacttgacactggaccaagattatctacacgatacttcacccaataaccacagaatatactttcctctcatctgcacacaaaatattctaagatcaaccagatgctcagccataaagcaagtctcaatacattgaaaaaaatcaaaataatatcaagcaaactctcgggccacaatgcaaaacagaagtaaatattcaaaagatctctcaaaactacacaatcacatggaaattaaacaacttgctcctgaatgacttttgggtgaacaatgaagttaaggcagaagtcaaaaaattatttgcaattaatgaaaatacagacacaacataccaaatccttgggatgcagctaaaatcagtattaagagaaaagtttatagtgccaaatgcctacatcaagaagttagaaagatctaaaattaacaatctaacattgcacctagaggaattagaaaaacaaaacaagccaatccaaaagctaacagaaaaaaagaaatcactaaaatcagagcagaactgaatgaaatcaagatactatattgtgtagtggccaagtttggatttttaatgtacccattacccattacccaaataatgtatactgcacccattatgtaatttctcattgtccacctccctcctactccgaaacccttccacatctccagtgtccattattccactgtatttgtggaatactctctcctatttgtcacctttgcccttttttctgctgataaataaaatgttttatatttaaaaagatacaaaaatcgatatgaaagatcaatgaaaccaaaaggtgattatttgaaaaaataaacaagagtgatagaccactaactagattaacaaaggaaaaaaagagaaaatccaaataagcacaatcagaagtgacaaagatgacattacaactgatcccacagaaatacagaagatcctcagagacaattatgagaacatctacgcacacaaattaaaaaacttgagaggaaatggataaattcctagaaacacaaccttccaagattgaaataggaagaaaatgaaaacctggacagaccaataacaaaatctgaaattgaatcagtaataataaaaaaaaacctaccaaccaaaaaacaaaggtcaggatcagatacatttacagctgaattctaccagacatacaaaaaactgctatcaattctactaaaactattcccaaaaattgagggagagggattcctcctcaacttattctatgaagccagtaacaccctgatacaaaaatctggtaaacacaacaaaaaaataaaatatcaggtcaataatccctgataaacatggatggaaaaatcctcaacagaatactagcaaacggaacccagcagcacatacaaaagttaattcatcatgatcaagtaggctttatttttaagatgcaaagttgattccacatatgcaaatcaataaacatgatacaccacataaacagaattaaaaacaaaaaccatatgatcatctcaatatatgcaaaaaagctttaaatccaacatcccttcaggagagaaaccctcaacaaattaggcatcaaaggaggatacctcaaactaataagacctatctatgacaaacccacagccaacatcatactgaagaggtaaaagctgtaaccattccctttgagaactggaatgagacaagcatgcccactcttaccactcctattcagcatagtactggaagtcctagccagggcaatcaggcaagaaaaataatactgcacccattatgtaatttctcattgtccacctccctcctactccgaaacccttccacatctccaatgtccattattccacagaaatacagaagatcttcagagacaattatgagaacatctacgcacacaaattaaaaacttgagaggaaatggataaattcctagaaacacaaccttccaagattgaaataggaagaaaatgaaaacctggacagaccaataacaaaatctgaaattgaatcagtaataataaaaaaaaacctaccaaccaaaaaacattcatatggaaccaaaaaagtgcccaaatagccaagccatcataagcaaaaagaacaaaatcagaggcatcacattacccaaactatacttcaaactatattatatatcacattacttcaaactatattataagtctacagtaaccaaaacagtatggtactggtacaaaaataaacacatagaccacagggacagaatagagaacctagaaataaagccacacacctaaaatcgtctgatctttgacaaagttgacaaaaataagtaatgtggaaaagactccctagtcaatagatggtcttggcataactggctagccatatgcagaagaatgaaactggacccctagctataaccacatgtaaaaattaactcaagataggttaaacacttaaatgaatgtccccatttataaaatcctagaagaagaccgagcacattggctcatacctgtaatcccagcactttgggaagctgaggcaggtggattacttgagaccaggtgatccagaccagcctggccaacacggcaaaactccatctctactaaaaatacaaaaattagccgggtgtggtagtgcacgccagtaattccagctcctggggaggctgaggcaccagaatcgcttgaacctgggaggtggagcttgcagtgagccgagatcacgccgctgcactccagcctgggtgacagagaaacactctgtctagaacaaaaaaatgctaaaagaaaacctaggaaatacccttctcagtatcaggcttggcgaagaatttatggctaagccctcaaaataattactaccaaaataaaaattggtaagtgggatctaaattaaactaacgagcttctgtacagcaagagaaactagcaagggagtaagcagaaatcctacagaatgggagaaaatattcacaaactatgcatttgagaaaggtctaatattaagaatctatacaaaacttaaatcaacaagcaaaaaagaaataatcctattaaaaagtgggcaaaggacatgaagtgtctacttcttaaaagacatacaagtgggcaacaaacataaaagaaatgctcatcatcactaattgtcagagaaatgcaaatcaaaaccacaatgagataccatttcacaccactcagaatagtctttgttaaaaattcaaaaaataacagatgctggtgaggctgcagagaatgggaagcacctgcacactgttggtgggaatgtaaattagtccagccactgtggagagcagcttgaatatttctcaaagaactaagggtagaactaccatttgacccagcaattccattactgggtatatatccaaaagaagataaatcattctgccaaatggacatacacacccttaagttcaacacagcactattcacagtagcaaaacatagaatcaagccacgtgccccaccatggtggactggataaagaaaatgtttatatatatgtatatatacaatagaataccatggagccataaaaaagaatgaaatcatgtcctttgcagcaacgtggatgcagctggaggtcattatcccaagcaaactaacacagaaacagaaaaccaaatatcacgtgttttcactgatatgtgggagttaaacattgggtacacatggatatacagatgggtacaataaacactggggactactagaacagggagagagggaggatggaaaggggccgaaaaactacctattgggtatgatgctcacgacttgaatgacagttcagtcatatcccaaacctcagcatcatgcaatatacctttgtcacaaacctgcacatttacccccaaatctaaaataaaagctaaaatgaaaaaggagatttttcagcttcttatttgccctcttggaatgctgttctgagactgccatgaagaagcccaatataatcaattaaagaataataggccacatggagtagaggtgtgtcattccaacttaggccccctagttaagcagccaatagccaatatcaactgctagacatgtcagtactgccatcttacaccgtctagcccctttagagctacagaagttagccacatgagtgaacccaagggagagcaactgcagaagcacccagctgagtcaagaccaaattatttacccatggaggaaaaaaaagtttcgagtgggttcttatgcagcaatagataactgatgaagtaccatatttcctaattttccaacgcaatttagattttaaatattctgtcctatcatatgatgtgtcaaatggatactattttttacattggaaatatggtcttacaagatagtaagtactaaaatgtgttccataatgatggttgacctaaatggacacttcttaccttctagaaggtgaattgttattattatctagtattaaaataaagtcattttaaccctgaacacagctagcttttctttcactcatgcaaactaaaagtgggggcagataatcaaatttaactgcctatgtatccatagaagtattacagctattactcatgacatctaagtccagtaaattccttgtacattcttctccaggtgtcactgcctcatggccactctttctgccacatgcatccatagaaaagcacaaacacataagagataaaatgaagagtgagaaaactgtagattaaggggcaaagatgaataactgttataatgacacactgaacaatcacatttctataatacatttttgttcgaattgcctcccagctagacctctccttggggagatgctgtgtaatttctctggttatgtgatagaaccaagatgaaagataactcacaagctcctgtggcttaaaatataatggttgaaaattggcgggttatttttaaaggatttttgtcaaggaaagagagaactatgctcttccacccccagccactgtccttccacaaaataaaagtcaaattgtttcttctgtttttaaagacgttgctaaaaagttatagtgcaaatgtttaatgagtattaatatactaccctaaataacatctctctttttccttacaataaaaaccaaaagatctaaaatttcttcaaaaagcagtatagtcagattctggggaaagaaatcaattttataaatcatctataattgaatatctgtaattgcaaaagctgtcactgtacaatcatatacctcatggaacagtcagttggattatatgattacttattttaactcccactattcttggaagatataaaaagcaagaattcatatatccagaaccttgtctctaaggatagctgactacttccaccaaagttagaatttatttaaatactgattataaattaaggtcaaatcattttaaatcttctagacaattctagtgctggtagcacttctgttcaaatatgctgaatcatctgaggtttttttttttcagtatatactctacaaatgggaaaacttttcaatgaaaagctaaaattgtagaatcttagctctaaaagggaccacaaactttttaaggttatatatgaggaaactaaagatcacagagttgaaataatatacctggagtagcagggtttgttagtggtgatgctagtttgagaaccaggtttcctggaccctctgaccagcactctctcctccataccatgtggactcaccctggaaattgtgttctctgtggatgggaagccctggtataacccactcctgaatccaggagcggccacacctgagcatggaacttctataacccttcagacgcagccctatccccaacttattaattcagattctctacaggaaagcaaagtgttagcaatatctaaatgatccccaggagattctggtatgcgcctagggtggagaacacctgtaatagtttctcatcctcacccccttaattgactcaggcttaacaggttaggagtcacagtctttgacttcctagaatttctggctctctttggccccttgatactctagatatcaagaacctaattctgagagttcagacttttggagaacagaaaacaaaaaggggatggtggagaataattaaagtacatgggtcttagtgacaggcatcatcagtgacacttcctacagacacatgagaaattacaagagaaaactatcaagaaaaaacttgatttggctatataaaaatggttttacttataggcatttgtctcaactgctaaccaagtttgcaataacatatatcagattgcttatgggttcatttcattatataagtagaccactcatataaagtcatagttacctcctcacaagttcatgaaattgtaggcaatatgtcttagatgcatgcttagaaattatgacattggagataaacaggcagaatatctcatgtttaaaaaaaaaggtctaaatcagtcagaatccatgttagctatatcacaagaaaaattattagcaattcaaagagcctaaaatgtatcaactgatcctcaatcccaacccagttctcaagaagtaaagctaaatctgggttattttgaacctcagaaatgagaaagataatatttacttgctggaataagattacaagtaaagatggtccctcaccccttgaaagtcttgctcaattcttgcagttgtgttgaaaaatattattttttgaaagtccgcaggccatttaagtttccaggtaaagcataaacatagcctggtcagcagtggggtcacatgtctcagcctgcctccttacacaggcagaattttcattggttaaatactaattttgatcatatttaataccaactattaactattaggcttaaatactggaatctgaactacctactcaagaaaaagcatgtctctgaagctgcttggctcaattccatgtgaacagtccaatatttcagaaacaactgtgtcccttaagccttcaacagaactagaaggggaaaagttagtttgcccagtttttcttcatgtcccagcttgaggtatattttatagaactgattgtctttttcctgcctctgtcaccaattcttccccacgccaacaaatctcacatacggaaaacacaagttaattaagcattgtattacagagtattaatagaaatgtttcagatgcttttccttaaatccctatgacacaattactattgccctgaaggagaaattaatttttattgtaaacagaaatacttaaaaacatagttaaatgtttaaacatcagtttaaagaacagattaaaggaagtgatagttaaaccaaaacattatatagtccagcaaagtaatgtgaaaagagaaaatatcctctcaccattctaagcacattaagagtttttcaaagaatttcactcacttgcatttcaagaaccaaatatgaatgttgccaatatctcacttcacttccttgcagtctaaccacggatagcatcaagaaagcattgcttccagctcatcgttctccctcccttagatacattaagacaattttgatacatcaacaaccagagacaatgtaaaataatgtcagagttaaaaatcacaaggctttgggaggccaaggcgggcggatcacaaggtcaggagatcgagaccatcctggctaacacggtgaaaccccgtctctactaaaaaatatatacaaaaaattagccgggcgtggtggcaggtgcctgtagtcccagctactggggaggctgaggcagaagaatggcgtgaacccaggagacagagcttgcagtgagccgagatggtgccactgcactccagcctaggcgacagagactctgtctcaaaaaaagaaaaaaaaatcacaaggctacaagtaactttcggcatttatgtggtacatcctccacctccgacataatcatttaaccagtggttctcaaccttgactccacactgaaatcacctgaaaagctttaaaaattctggtgcccagctctaaacctcagaaattctaattcaattggtctgaggagcagcctgagcatcaagatttttaaaacctctctagatatattagttcattctcacaaagaagcttctttctaataaattaatattatatttaaaaatcctaaaaaaaaaaaaaaagaactccccaagagggtaatttataaagaaaagaggtttaattgactcactgttctgcatggctggggaggcctcaggaaacttgcagtcatgatggacagcaaaagagaagcaagtacctgcttcacaaagtagcaggagagagcgcccgaaggtggaagtgccacactttaaaccatcagatctcgtgataattcactccctatcaagagaccagcatgggtaaaaccacccccatgattcaatcacctcccaccagtttcctcccctgacaggtagagattatggagattacaattggagatgagagttgggtggggacacagccaaaccttatcaccagatgattttaatatgcagccaagtatcaaagcccatcaaataaagaccaccaagaaaacacctgtagttaagcaatgaggcctgcttaccttgctgaaactccaggaaaacattgagggcttctcagtaagagtcagagggtggtgggtggggggattttagtagattatttttaggagtgattagggaagcagggaaagtttctggattgaataacatcaagaaattggggaaattctgtgattgggttcctcaatcgtcttcatccaagagcagtgctatcattgataaataagcagagatcatcaaagaggcaaagttgctggcaatgaggggtgttagtcatttttgtggttaagatgtaacctaaccattgtcctattctaaatatggtgtatttacgttctttggtgaagattttggtctggttttcggcaaggccaattttttctcagtccaattgggccaatttttatgctatcagaaggttgagaaccactgatttaaacaaactacctagctgaatatgaatgctgcctgattgtgacatctgtcattctttagattccagagttaaagttagcaaatctggcttattaaacatgttttttttatttctccccaatttatccaagtgaaactttcccaaagctaaatcttcccagagaaaattctgttcccttcccttgatacaatacatagttacacccacaagtttaatttgcaagagaatacatgctacattcttaagaaaaatctaatttaaaattgccccttttggtaaatcatctttaaaacactagttatgctgtatttaaaactcattttctacttattctgttcttgatggaagctattgttaatttttcacaagtattggctcagggctttcttgatacggtactacccgtgaaagatggggctccttacagaaatgtttttgacaatgttttgatgattcacctaatgttctgctctataacaaatcagaaggttgcaatcatttatgttttacgccaagaatcactgtgtgtatttaatagaaattgggatatttaactattctttggcgatctgaaatatctgtttactgtcttaggaagcctgcataatagtaggtcatgtctgcctgaaaataagatactttcagtgttttacatgtgtcaatacagggtatcatttttatttctttatcagagatagacaatacagtaccttctgatggtatagccagactacccggtattcactgagaaccctactcagggctgcctattcttatttttactacctacacctcgatgggatacaagtttctctcacctaggcagagttatatccactgctgagatttaaaggagtctggaaatggcactattatttctctacttgagttctgaaccagttaagaaaaccaaatattaacattagcaaaaagatatttaaagccctaaaccaaaagaggccatatcacaggttgactcctccaggtgcatatactgagagagagttggtgttcaagacatatataaagaatcaaaggaaggggaggaagcagaatggagcagagaaaaaagtcaaactgtgatgaagacccaaaacagccttggccaacctggcaggagctctagagcgagactgcccattagagtcatctcacagttggttgaaatggctgggccttttaatcttgtcctagttcagtcacaagatgtgggatgctctgaaaagggcatattcttgagcaaagacatccatcactttgcagctgaggctgaccctaagaaagcaggcagccggagacattctgctgaccaccctctcctcagctggtcagtgagttctttcttggaggggctctgggtaacacatgttcatgtctaccacagaccatgatggggaacacagctaaggagttcagcaacaagaggtttcccaatatgatatccagcactagatttccatctagacacaggcagcactgagcaatcacagaccatctgctgagatagatgggcaacgggaaatgagcagagatgcgggcctagaaaatgcaggtctcgggccgggcacggtggctcatgcctgtaatcccagcactttgggaggccgaggcaggtggatcacctgaggtcaggagtacaagagcagcctggccaacatggtctctactaaaaatacaaaaaattagctgggcatggtggcaggcacctataatcccagctactcaggaggctgaggcgggagaatcgcttgaatctgggaggcagaggttgcagtaagctgagatcccaccattgcactccagcctgggcaacaagagcaaaactccatcttgaaagaaaagaaaaaggaaaagaaagagaaaaagaaaaaaagaaaagaggggagggggaaggaaggaaggaagggaaggagggaaggagggagggagggaggaagggagggagggagggaagggaaagaaagaaaagaaaagagaaagaaaatgcagttctcacaggcaagctgactcctgaagaagagaaacacaaagagcctgagatatgtgtatgccaaatttttgctcccacatttcattaaacagattttgctccatgagagggagtttgagaacagatacagagacaggccaggagcgatatgctaatggtgaccctcacctgaaaggaaacaccatgagagaaaggtaagtggtctcctctgtccacctgagtcacagatggtcagttaaaggcagggcagtgaggcttattctcatttccagatgtccagattatcacagtaattcaaagctctcatgtatacagtaatcccttttctacatacttataaatattattccatttgaaaatttagttactcgggagttggtttggttggttggggacttggaagctgaattttattcttgttgtagttgcatacaaaataatagatttattttccaagttctacataacattaattttttttttttttttttgagacggagtctcactctgtcgcccaggctggagtgcagtggcgcgatctgggatcactgcaacccccgccttccgggttcaagcgattctcctgcctcagcctcccaagtagctgggactacaaggcgcctgccaccaggcccagctaatttttgtaattttagtagagacagggtttcaccatgttggtcaggctggtcttgaactcctgacctcaggtgatccaccctcctcggcctcccaaagtgctgggattacagatgtgagccaccgtgcccagccaacattaatattttttagatgctctgtactcttttgtgtcttaatgcaaaaatcacaatggttattttaagaagtctgtggcaaagtgatgttgtatatactgcaagtggcaattcagcagtcagattttttatcctcattcccctttcagctacgcaggaaagggagtgctttggaactcagatcagggaatcacagtagcactcagagcgcaggaatcaagtgcagccatggagacacccacttcctcagtgaggtgttgaaggtggctctaagagcaaccacaggtgcaaatcagcttttaaagaaggagcatgggataggtcaagggcatgtcagtctttctcagccagccaaagacactttaagtaataggctagtccttcctctataaaagcatgataacaagatgttaagaaattttatttttaaaatattggccaactgtttaagtaaaattccatgtcacggagatttgctaacaagataatatatgacaaggtgttaatttccgtatgtgcagttaagacaagtcagtcgttcgaaatctatttcagactgatggtctaaagattgccataggaccatttcctaaaaacacctccaactctttagaatatctgcctgaaatagttgaaacacagccaaattagagaaaacacaaatctatattggatctgcctgaacccacacctttaatgatatttaacaaagtgtggtcctatgagcaccttacacaaatacttcaagcacttactaaaaacccagatggctggaccttacctactgaatgagaatatctaggaagtatggcccaggaaggagtctgcatggtccgctagttcccccaggtgattctaatacacactctaatttgaggaagcctgttagaaattcaggctgcaaaaggtcagacatgaagtccagaattcaggctcaatgaaaaaactctacagaattcatttgacatttatttgggaacagtatttttcacaagagaaaactaaaactcttacttattcattcaataaatattttattgtgttcctgcctcatctagaccctgtgctaaatgcagtagattcaaaaatgaaatgcatagattgtaagaatggtctagaatcatcacacattatgactcctttcatactgaattcagacctcggggtatgtatattactagcatttaaaatgagaattctggggagaaaattaaactcatgctcaagtagaactatcctaaggaaagaaaaacattaaaaagtttacagagaatacaattaaatgtatccattcttctgtggaaaaaaagtggggtgtggagggatgaacagacatgcatgtcactatttttaaataaaaagttatcttgaaacgagatcagagcttagaggatgactcctaccccaacctgaatcacttctttatagtagaatcagagagttgatgaacttttgatctgtcctttctttctttggaaacatacatagatctaaaacctggttatcaaaaaaggtcatgaagagaggataaaaggataatatataaagcattgttgattttccataaagtatccatgaaacctgcagaaagaatctccaaacactaaacccacttcacacacactaccacaattcactagaatattcctccttgcttgctagaataagctaagcttgctcaagattgaacacctgaaatggtttctacaaagtgtacacaaatatggttatggtatgagaagcacatacacgtaactccatttgaccctcatagcttttgtttataaaaagatttcaccaaatatttgtttataattttgtcctatgatcagacaaaacctcttctgatggttttgtccacatcttatcaaaatcaaaacaaagaaaagcatgcattgaaaaaaactggaaaacatattttaatattaaaattaaatagaactatggtttatttttctacatttcctaaatatttaatagtgagaatgtattactttataataaaaagcattttaaattaacttcttgatagggagttttattttatgacaaaatataatttttaaagtaaaaataaatttcaaagtaatagtcttcaatggtcattgtttcttttcatcttatttcctctcctctttaatatgttttacccttcaggacagatcatcgatcatctctatgttctttcaaacatatgtaagtttcaacatttttgttataacaagaagttctggcttttctttttctcttctcttttgttgcagcctcataaattctaaccacagctgtccactctacctcccattattctcaatagtcttgactaactgactttgaaagcatattgcttcagcacattaacttttgctgggcaccttttttccacacctgactctcctaccttgcaattttatatctactctaatagttttctaggtaataaattatacatgacatctgtcttgtcctagtttttaaaatccctgtagcctcttagaagtctttttaatgtccttattgtcaagtccaaaccaactctgatatttccttcatgtaatactcttctacttatcttttttctatctttgcccttacactttttactccaccatctttctcagcattttcttcagtagtttttttttttctccctctaatgctatccatagcttatgcttcttgctttcttctttttctacctcttggtctgcctctttcatttgctgtaaatttggtgtaaaatcacccaacccatggtagatccctttctccttcttcaagtccagataccatgtgttctttaatctgacataaactagccacaggcaaggctcatttgattcttaccattgagccttaaaattagctagtgtggtgaataagacattcataataacccttggctcataaatgagaatagagggagaaaggttaagtgatctttccatagacattgaataatatagtgattgagtggtgaacaaaggttaactacatgattttgttttcctttgttttcacatagatttatattctgacaagagcagacagatgtgtccagccaagggaaggccaactagtatagtactattgctctaatgtctaatattttaatagattagctatggtaaaatggcctatgtgaatgaaaatataagttgcttgcagagagagttcaggaattctcctttagagaatgcatcactttgaaaacacaaggcactccagaaatgcatgataaataaaagaatttttaaaaatggttaatcaatctaaatggtatttttacagtctataagaattttaaatttttctgctagaataaaaccccctaaagatttcaatcttatagacacttagaaatcccctggatcataagaaatagttttaacgatagcgtaaagtttaaaatgcacacacacacacacacacacacacacccccacacacacatattctcagcaaacaaataacatgacaggtagtttgatcacatttcacagaataaaagtataaacatactaagtaaattccacactaaatctccatcaccacatgtgcatacattataagtaaatatatcaaggaatctgaacgcttgagaaatgccatatgtaaaaattatctgacactggctttttaaattcttcggcaaattttgagtatgcacttgacaccagaatatgtaagcaaacaatgtaagcatgtatgcacccaaattagaagcataaatagtcatctaggcagtagatgaaaatgtcattccctaggatgggtacagtttcatgggtaattgatcatatatgccaactctgggaatgtattcccagacagtgacttgaaagaccttgaaactataaaggcaaggaacataatattgctagaaccagagtgatcattctgacttgaaatgacttgaatgtgatattacacaccaaacatgtaaaaaaaatttcagtactatagaagttaaaaagttgtgaggaaaacaaaaggtggtaggattcttcagaattacagcaaaccatccatacctgtgctgtccaataccatagtcaccagccacacataggtattgaaatatggttagtccaattgaaaaactgaatgtttaatcttaattgtaattatatttaagttacatttcattaaattaattttaattaatttaattttaattttaaaaccagtcctcaataccattattagaaaatgtttaaaaatatttggagctgggcacagtagtccatgcctgtagtctcagctacgcaggagtcaggtggggggctaacttgagcccaggagtttaagaccaacctgagcaacatagcaagactccattttatataaattatttaaattaaaatatatatatatatggacaacttaagtatgttaatctactttttcaactgtaaattttatgaaatctaaatgcatactaagtctttccagtaaaaatttagtgtccaaattaagatatgcttatccactcagttgttagctacttgcaaaaagtcaaagacaaataagtaaataatgattttctcaagcgcagcacatcctgttaagtacttactaaagattcagaaataattaaagccatgacaattaaatataaaactgcataaaatttccccctaaaaataacaaaatggtacaaatcaacaagaaaatgtcctgaaagaaactagctatcaattttctggtcttgaactgaatatcagaatgaatatcaagagatcatggaatcatcaggggtttttactattcttaacattgagtcccataactatactggacatgaattcaaaatgcagcaagccaagtcataattagatagcagccaacctcgtgattactcataatcttaaaacacattaccaggactcaagaagaggatgttggattggaatagatgaaaaactacccacttggtgttatagatcaaagggaatgtattcaggctaaaacaaaccaaaccaaaggtagaaaaactgattaaatttttgtcttggtttttaaataagaaaaattttagaaagattcacttccatttctaagtttcctgctacttccaccatatctgcagtgactttctccactaaagaactgaatctttccaagtcatccatgagggttggagtcaagtacttcccaactcctgttaatgtagtatattttgacctcttcccacaaatcacaaatattcttaatggtgtctagaaaggtgaattctttccagaaggtcttcaatttcctttacccgagattcatcagagaaatcactatctatgtcacctgtaaccttaataaatgtatttcttaaataataagacttgaaagttgaaatggctctttgactcatgggttgcagaatgtatgttgtgttcacaggcataaaaacattaacatccttgtaccagtctatctgagttcttaggtgacaaggtacattgtcaatgagcagtaatatctttaaaggaatcttttttttaattttctgaacagtaggtctcaacagtgagcttaaaatattcagcaaaccatgctgttaacaaatgttctgtcatgtgggctttgttgttcaatttataaagcacagagagaatagatttagtataattgttaagggtcctaagatttttcagaatggcaaattgacattggcttcaaattaaagtcaccagctgcactggccccaaacaaaagggtcggcctgttctttaaagctttaaagccaagcattgacttcttctttctagctatgaaagccccagatggcatcttctttcaatataaggctgctttgtctatattgaaaatctgttgtttagtgtagccaccttcattgatgattttagctatatcttctggataacttgctgtatcttctacacgagcatttgctgcttcaccttacacttctatgttatggatatggcttcttgtcttaaaccttatgaactaaccactgctaacttccaacttttcttctgcagcttcctcacctctctcagccttcatagaattaaagagagttagagctttgctctgggtcaggctttggcttaagggaaggttgtggctggtttggccttctatccagaccattaaaactttcttcatatcagcaataagactacttcactttcttatcattactgtgtttgctggaataccacatttaatttccttcaataactttttctttgcattcacaatgcggctacctgttcggtgcaagaggcctagattttggcctatcttagctttcaacatgccttcttcactaagcttaatggtttctagcttttgatcgaaagtgagagatacgcaactcctcctttcccttgaacatttagagggcattgtagggttattaattggcctaattcaatactgttgtgtctcagggaataggatggcccaaagagagggaaagagatgggggaacagccagtcagtggagcagtcagaacacacacatttatggattaagttcaccatctgatatgggcatagctcatggtgccccaaaacaactataatagcaacatcaaagataactgatcacagatcaccctaacagatatactaataatgaaaaagtttgaaatattgtgagaattaccaaaatgtgaaacagacatgaagtgagcacatgctgttggaaaaatggcatcaatagacttgcttaatgcagtttttttaagtgcaatatatttatttctgctagaaatatattatcaaccttatgtaatatttgaagcattacatattatttgtaaacagcttaaaattatatattaccccaattgtatataagtacaaatgtgtggatattagtttctttcattaaaaatggtgtttttttaaaaatacatatgcacccatttacacctttcattcacttacactgttttatgatgtttggtacctgtttcctcacctgaaaaaaaggattagataagatcgtgggtcccagctggccactcacaggctggacgcagcccgggattactgcacagtattttgggtttgtctttagttgcatttgaaagcctttggaaaagacattgctctcaagttcccactattttccattttctgcacccagtccccttcattcgtgtatgctacccaatgaaccctcacaatcacatgattttgcacctctctgtactgaattatactgaagactccataaaacttaaaaactcctgtatctcatttcagccatgagcacttggatatgctgtaatgatattacacaaagcagaatgacaccaaataagattagccaaattgtaagtcttaatcctccttccacacgacattcctttaaaatatttgatgttatcattaccccctgctttcaaaagtctactctattacccttaatttttttgtgcatgcctaacaccaaccttttagaaatcttttatttggaaggatttcatgcttaaggtagagttgcaagaagaccataaagaaactctgtacaccctttatgcagattcacaattgttaatcttttgccctatttactttatcatgtgcatttacagtgagtagtgtgtgcataaacacacatgcacatgcatagatatgtaatatatacaaattatttttctgaaccccttgagagtaagtagcatgtcatgccccattatctctaaataattgaaagtgtatttcctaaaaacaagattccactaaataatcacagtagggttagcaacttcaggagatttaacaatgatgcagtactttgacgtatcatctgtattccagatttgtcaaattacccagtaatgtcatttgtagcatatcttttcttcagtacagatccacttcaaaatcacatattgcatttagtcatcatgctactttagtctccttaaatatagtacagttcttcagcctgtctttgtctttcatggcaaaaggattcctattgtattagaaatcatgaattcatactgatacctccaattccaatgcactcccacagagtcctcttttcttgctttgccccgtttgatatctgtatggaatacagtggaagaagactcaacaattacctcaacgtatttatttactcaactctaccatacacttaaaactaatttcagattgcttcacctgtacaactacaacacacaaaccttctaaaaagaggtcagggtttgtttgcattgtttctgtgctactcaactaacagtgtatagccagatgatatgttcagcagttactttgattaattccttttttgtcctcctggatagttatgttactcatgcgcaatacaagtgggtttatttgttcggtttgtttggagttttaatggatcttttccttcctatttttatggatatttttaaaaaatagaaaataatgtgctttcaacaaactcatagatctaataagtgattatggcaaggttgaattatagcaaggttagaggatacaagattaatactttaaaagaccgttgctttcctatataccagaaatgaacaattggaatttgaaataaacagttatatcatcactaaaaaaagaaaaaagaagaaataggtttaaacaaaatattcacaaaagctatataaggtaaactacaaaactttgacaaaataaatcaaagaaggtctaaataaatggagagatagtccatgttcatggataggtagactcaatattgtgaggatgtctgttcttcccaacttgatctatatattcaatgcaaacacaaccaaaattccagccagttacttgtggctaagaacaaactgattctaaggtttatttaaaggcagaagacccaaaatagccaacacagtattaaagaagaaaaacagtcagagggcttaaactacccaacttcaaaacttactacagaactatagtaataaagacagtgtactattggcaagagaatagacaattagataaacggaacagagagcccagaactaggcccacataaatatagttaaatgacctttgacaatggaacaaaggcaattcagtggagaaataataatcttttcaacaaatggtactagaacaactgaatatccacatgcaaaataataagtctaaacacagaccttaaatcttttgcaaaaattaacttaaatggatcatagacttaaatacaaaatgcaaaactataaaacttctagaaagtaacaggagaaaatctaggtagttttggttttttaggtacaacaccaaaagtacaatccattaacaaaaaaattaacatgatggactgcatgaaaattaaaaacttctgtgaaaaacattgttaagagaataaaatgactagccacactctgggagtaaatatttgcaaaaacacgtatctgataaaggattcgtatttcaaatatacaaagagctcttaaaactcaacagtaaggaaaagatgaattatgggcaaaggatctctctgaacagacacttaaagatatacagatggcaaataagcatatgaaaagatgctcgacatcacatgtgattagggagttgcaaattaaaacatgagctacaactacatacctattagaagagctaaaattcaaaacactagcaatgctaatgctggtgaggatgtggagcaataggaactctcattcattgctggtggaatgcaaagtggtacagccatttaaaaagatagtttgtcaattcctttcaaaactaacatagtcttatcatatgatctagcaagtacgttcccgggtatgtacccaagtgagttaaaattttatgtccacttaaaaatctgcacatgactgttgacagcagctttatgcataattgccaaaacttagaactaagatgtccttcaataggtaatggatgaacagtctgtggtatatccattttccatacaatggaatatttttcagcaataaaaagaaatgcactatcaagctgtgaaaagacttggaggaatctcaaatacatattgctagtgaaaaatgagctatacactgggcggttctaattatatgacattctggaaaaggcaaaattacagagatggtaaaaagattggtggtttccacggtttggggggaaagagggagaaatgaagggatggtgcacaggtgatacttaggccagtgaaataactctgtgatgctactgtagtagtagatacatgaaatcatgcatttgtcaaaactcatactactgtgcaactcagagtaagctataatgtaaactatggactttttggtcaataatgcaccaatattggttcatcagttgtaactaacgcactacaataatgcaatagtttaataataggggagactgccagtgtgggggagaggggatatacgggacttctagattttctactcgatttttctgtaaacctaaaactgctctaaaaatagcctcttaataaaacaacaacaacaataagataccgcttaacaaccactgcgatggctataattataattactaacaagttggcaaggatgtggagaaattggaaaccttatatattgtcggtaagaatataaaatggtgtagtctggccattcgtgaaaaggataaaacaacgttacttactatatgacccagcaattccactcctagatgtacacccaggaaaaattaagagatatgtccacacaaaaacccgtacacgaatgttcatagcagcatcattcatgataggcaaaaagtggagacaacccaaatgcccatcaactgacaaatggataaataaaatgtggcatatccatataaaggaagattattcagctataaaaaatgaagtacgataaatgttacagcatggatgaaccttgaaaacaggatgctaagagaaagaagctggtcaaaaaggattacatgttatatgatcccatgaatgtgaaatgtccagcatagaaatatccatagagatggaaaatagattagtgcatgccagaggctggaaggagggaggaatggaaatgactgcaattagatatggggtttcttttaggaatagtgaagatttaaattctgttaacacttataactaagacactgcactagccctttaaatatttccaaattttaattttttaaaaaaagtctaccttgctttttttgaacccaggtatacagccttaattaagaaatatgaaagctgcaaaactcgatggtttttctactaatggattataaattgtcactaataagtatctcaaaaagggtttcaatggatggtactaaagatgagagcattttaaagtttcatatttatctttaggggatgggtccatacctatgcgaaagcagagctctgctgcccccaacaagtctggtggtcttgatataaacgcttattatttatttagggctgtctcactctcctccttattctctatttgccatttaggctactagtagatagaagtaattagaaaataggaacaaggaggcccaccctacttagagactgggcagtgcaggtgagaaggaatcagaggaataaagttcagggataagggggaggccaggttggggctgggccgaagagatgagagagatgagctcagccctctgggtgggcaatgacaagtgtaggtactagaggacaaactgtgggatagattgcagagtaagaccctcagggtggagtctgaacacatagctggaggcagaggaggagggaaggaaaaaagtggtaaaaagagatcttagtacaggccactgtatgacttagcaggtgcatctacctaaatatttgtacaaataccaactagaatcaaataagtttaaaagaccttatctaggccatgtcatccaaagtattttatagttgaggaaatcagaactagagaaacaaagtaaattggccaaagcatactgggcctagtctagtgatatatcttcaactctatattataatcaaagttcaatcttaaatcaacctaaaatattatattatgtaaaatacagcacacagattcattatgtatcattggcacttttactatgttttgcatttaatctgcccataaatattctgaaactcattctttaaatcatttcctgtttgccccaaaaatactcatctctaatcctactgtaacatcatcatctacatttctgttacattaggattagagacaaattctgtttataaataactctaagaacagtttttatattttattttcatgttgaaaatcagtcagatttgcttcagcctcaaataaagtgtttatgtaaaattaaatgagcactggcagcaagctgcacttttttttttactaaatggggaaaatggactaatatagcagaggcttttgcttattaatattgaatgtagtaattcttatattagttactttggtggtaaataaaaataatctcaatatgatggagtttgtacatggtatattaccatcaaatccagggaaaaatggattttgtagatttggggatgtggtacaagtatataagtttagttgtgtatatgttggttaagtcatttaacagtgataactgagtaccaatctggttcaaatgaatgtgcatatactatgcagttgtgcagtctctctacttggagctgaaagaatctcccaattaatttatggatcacctccctccctttgaataagacacgcctttataaggcatgtcttatctgataaaggcctagagttgtttataaggtatgtcatatctgacataggcctggagcactacatgaccagggcatgggtggcttacagagctctagttttttggttttggggttttttgggggggttaggagtggggagtggatagccccctcatggacacagaaaatagattggaactcttggaaattccaacttgttattacagatgcctttcttccatagtccaaaagacagcattatgcaaagtatcacttacagatgcatttacatctaaacttgctgtatgcttcacagcaagttggtgtctttccactttctccttgatgaagacctgcatccaatatgaatttaaagaggctctgtaaagtaattcgacagcagcaaatatgctatttaaaaatgagtcaatccaagatatgtaaatccaagaaaggttttagactgaagcagttgttttataaaatacacatgcccaaagacacttttttagtggaggcaacttgctgaagaagaatttgaaaggatcttttaacatttataagcagaccaatttgaaattacctagaaaataagtaagctccaagaagaacatacctatggctatcctatttttcgaaggcaaaaatggagctacaaaattaaacaaaggatgtatttcatgtttgaatttgtagaaaaagtcttagaaaggtataatgaaaataaataaaattactaaataagataactatgagatcctaagaattttgccaccatctttgggaataactaatgctgataaagtagagactaatactttggtgccaattccaactccttgcactgtacaaagggggaaaagtatcttaatgcataagaaattatgagacaacacaaataaaaaccaatcttttatgcagaaagtttcaattaaagtgaaattcatattttaaattaccaaattataaccggaaaagtttgtaatgttttcaaaatggtcttcgccaaactacctctatctagcctggaggctagagatggaacttaactatccacttaaattatatctatgtatttgtgcaaagttaaaactttaaatctaataaattattcgaatcaattaaaacaaagtcattattatttggaaaactaaatctttgccaggatgaatatcttaattattttgacatatgaaatatgcaatgtaatttttatgtggggttacatttggaattttcctacatttcatatttagtaaatggatttattataagacagtgatttttttaaagaatgaatttaataagtaactgttttgaaattttgatttacagatcattattgccatctgctggttacatagtttaattgcattttttaaaattcccaattgttttactaaaagacaaaggaaaaactgaggcaagttttagatatccataaccggattagagatctctatgtaagacagataatttgcagccaggtgcagtggctcatacctgtaatcccaatactttgggaggcagaggcggcaggaatgcttgaggctaggagttttagaccagcctgggcaacatagtgataccccatctttacaaaaataaacaaattagctgtgtgtggtggcctgcacctgtagtccttgctactcaggaggctgaggcaggaggatcccttgagcccaggagttcaaggtttcagtgagcaccatcacactttagcctgtgtgacagtgagaccctatcttcagaaaaaaaaaaaaagctaaatcatatgcatgaaaaaatgctcatcatccctggccatcagagaaatgcaaatcaaaaccacaatgagataccatctcacaccagttagaatggcgatcattaaaaagtcaggaaacaacaggtgctggagaggatgtggagaaatacgaacacttttacactgttggtgggactgtaaactagttcaaccattgtggaagacggtgtggcgattcctcagggatctagaactagaaataccatttgacccagccatcccattactgggtatatacccaaaggattataaatcatgctgctataaagacacatgcacacgtatctttattgcagcactattcacaatagcaaagacttggaaccaacccaaatgtccaacaatgatagactggattaagaaaatgtggcacatatacaccatggaatactctgcagccataaaaaaggatgagttcatgtcctttgtagggacatggatgaagctggaaaccagcattctcagcaaactatcacaaggacaaaaaatcaaacaccgcatgttctcactcacaggtgggaattgaacaatgagaacacttggacacaggaaggggaacatcacacactggggcctgtcatggggtgggggaaggggggagggatagcatcaggagatatacctaatgtaaatgatgagttaatgggtgcagcacaccaacatggcacatgtatacatatgtaaaaaacctgcacgttgtgcacatgtaccctagaacttaaagtataataaaaacatatatatataaaagctaaatcatgaggcatctctgtttcaaagatggtaagataatgcaagaatatattgcatcttatctaattataatgtgctattttaattgtcaattaatcatagattaaattatcaacctaactgctttaagttattgtcattagttagtatacagctaaaatgtgactcaaataaccattcaaaataatgaggtcaaaataagtgaccactgttacagaagctgtaaaaacatgaaaacatccatgattctattcaactgcacataaaactaagtgtcatgatttccctcttatacacaaatctactcctctccttagtaggagtagatacataatgatttaggcaactatctctcagttaactaatgaatctaaaacatgtattactgtttaataattactaacatatcacttgatgacaaagaaaccaagtgagcaaaatattaattggaagtattggcaaaaatagcaattacttttgcaccaacctaaaaatactcacgagtgcactataggatggccggtctagaacataataaaggaacatttgtttaagcatgtgctgtgtttttgatgctttacaagcattaattcattcaatcataccatcagtaagacaaatataactgtcttcatttttcagatgaggaaattaatcctagagtggctaaattactagctcaaggtcatacattggtaatcttcctatatgagtcccctgtgtaaaagatttagagcagcacatggcacacagttaattttatgtgtttactaaacatatgaatcataaaatatatcctgcttcttttttcctttaacattatatcatgactattttcctatatcattaaatatccatgcaaaatgactttagtggctgtaatgcttcactatatgaatgtttcataacttagtgtttgatactgaggccacttctattttttaacgatataaataatagcacaatgaacattcttataaaaagattaattttttaaatgataaaaatgaccagatttgtactttcaagggctagaccatggtaagagcattttgtatcccaccaggacaccaagtgatgcaaaaggcaattggaaactccagaaaaaacaaactgaccaaaaagaaaaacaatcgctccacttcacttattgttccaaaaaacattaaaacagtcatattttaaaataaggtgctttattttgagtttgcctagccattcaagaatatattcttatcaaccaccgtaaatactttgtattttaaatgcagtattggacagatagaatttattagctgttaaaacttgggcaaataactacatcctgatgcttgattttaaaatttgcatacagttattgcaagaattaagtgagaaaacattttgagcaccaaacacaatgccaggaatgtagaaatgctccttgaaaaaaatctcccaaaacaaaaaatgagcagtagtagcacttactgaatttaactaagtgacaagataaatagtactgtcagttaagtgctttagaccttcagaaaaagcataattaatatgggctggagaaatgggctggggcttggaaggtgacagcattcagatgggcagggagaaaagaatgtaaaagccaagggatggcttttccacatgaataaaggaattcagcggttatgatgtctcaggctgtggacttcacctgaaatgactgagatggaagattttgtgcccgaggaagtgggaaattaaagttgaaaaggtatattgggcaaatattgaaggcattggtgagcaagcctaggacttgatttgtgggccacgaacatttttgtgctgtgttgcatcaggaaaaattaacctggccacaatgagccatgctttagactggtcagttaggatatgggagttcaatttgatccatcatcaaacagatgggaagtaaagcggtgtgggctccagcatgtggcccgtgacagaggacatggaaaatgtcagtggccccagtgcatctgtgacagccgctttggcctcttgtagggctgcgcggtgactgggagctaagcgctcccctcttagttggtcttggctggtgctgaaagcgcttgagcacaccgctcctagggctgatgacttctgaggaaccttattggaaaagcattttgctctaagattcagtaaacgctgtcccgtgccaaggaagtcgcgtcaacctgaggctctgggatcagacccaccggactcacgcgggctctgccacgtgttgcccgcagtctcggcccgttccctccgctttggtaacgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggcggcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgggggggctgtgcgtggggctgctctcaccggaagctgcacgctcggggaagcgcggaggcgggggtgctgcgcgcttgggagcacgtgggggaacacgcagggactgccggcgcgaatggcttcgaacgcatgcgccccacccgacatttcacagtcgccatgacgaccggtaggtccgcaacggctgcggggacaagaccgttgaggctgccaggcgagtcaggcctttctggacctcgcctgactcggctgggctgtgcctgaaattgacccagctctatcagggattatgaaaaaacaaggagtaagcccgaagccgctgcagtcttcccgccccagccagtctaagcggcggtgcgggcctcccccttcccccccgcctccgccccggagccggaggtagaggaggtggaaaagtcggccctaggcggcgggaggtccttccggcggaggatccgaaatgtggaaaatcgaaaaggcttggagctaaaggtggtggccaagacccttcttctcggccccttcctgttggtccgtaattccctggcgcagctccgggaagaggtgcacgaactgcaggcgtggtggttccccagcagaaccactttggacttcggtaaggagagggcaggagagctccaggaggtagccgcatggcgcttttcttgagtcttgaaggagatcagtttaacaagcaagggtttgtgggtgcctagtaggaaataaaagcaaggtccgaatagaaagaagttggccaaaaatcttgtcattgaaccaggggagagagagagatagggagtatattggtctgaagggctgtcagatcgcagagagtgttttaaggtctaggagttttaaaggctgaggggaaggatcaagggaagaggatcagattaagattccaagagaggaaataattagtggagcaagtcttggaatatttggaggggtagaattaaaggcacaaatttgagaagctaactgtggaaaagaggagagagaattccttttctgagatggcagggagtagaaaagcgaggattactatatggagaaatgttaaagtggagataaaagaagttgggagtgctggcgtctaatggtctttgtttcagtgaagtatgaggctgggtcaccttcagaggtgagactgataggatgccggggtccaggggacatgcttctgtcacagcttggaaagggcatgtgataagcccttcaagcatttagaatactggcatcgttgcaacatatcatttttttcagatgtggtatgtgggttaagggagggagtgagagacacagaaagattttgagcatctttggaaagctggatgaatttggtagtatatttgaccttttccttatatatcatctgaagagtttttgccagtgtatataattgttaggagaattagaaataggatacaaatatagttgaacaggatagtctctgtatattttaaaattaatgaagcctaataaacagttaatgagcatctttacaaccatttaaagttttcaaccttttaaaaattatagcaaccgtgcttgcagacagtccaaaaatacaccatgggccatactttgcctatcctggtataaaacaagtaaatcttccaagaagtatttaagataagcccaggacagttagtaatataggaaaagatctgggtaagcatggttgacaatttcaacattgcaattttttaatttttaaaaatttaatttcttcaataattattgaattaatttgcatttattttgttagccaagtgaagtaatttttgaatttttaagaggctattattggtggtttgtaagatgacttgccaagtatatttgggataaccataagaaataccattataaaatctcagaagggaggtaggacttctggaatagccaaggaaatgcactcctccatgacgacaatgaaaatacttggaaaattatcaaaatcattttcttcaaaactttggaaattaaccaaaggtttacaacaatctaaagggcattaattcaagaaaagctgctgaacctctataagaatagcaaagtttgtggtgttttaacttgttctattccccactcttctctctccaggggaattgaaaacaagcaattccccaaccaaacaggggcacaggctgcgtttgcagctcctgtaaaagctccatacccagagcagtgtctcccagctcccaggtgaagtcttatgtatacatggggcgttggcacaggtgactccagactagtctcctaggccatctagtagcttctaggtctcggctcttgtaaagagcttgcaattcatcaagggttgagctgcacattggggcttttagatgtgctgctgaggaagtgatttcctgcatttaatcatcttctgatgaatgctagagaaactgatctagagtggctcctcttggttagaactagctgaagcatactgtatatacttacttcttttaaaaatttcatataaaggaatagaaaataatactgaaaaaaaaaaaacaaaaaaggtcgcaatcttccataattccatcactcttaccaattacctgaagtaaaaaaaccctctcaagtttctccctttgcttatcaagccctgctgcagagaggtaagctctgttcagaatttgctttgtgtcctggattttttcctatgctcatagagacaggattagctggccatcttgctttgtgtgctatctttctagacatgtaaaatactacatttgaaatacttgttttaatggtattttataataaagcagctattaataactttcctttttttctttattccagcagtccttgtggcttatctccattggtaagatttagtttcagtttgaaatatttaaaaacatttgaattaaaaattgccatctctctttgcatacagtaaaacaataacttctggctatatttgtagaacatctttatgtgcaccaatttatacatgtattttgcttttttacaaacctcatatgtgaaacagcatttacaaaatagatgcattaggggaatagtaacttacgaattaaaatatttttgctttactaaataattcaccacacgtttctttaaatatctagcttttctagtgtattttgcatgtgtagttcatttaaaaccttcctttattttatggtaattatatgttgctagtgaaataacttttttttttttttttttttgagacagagtcttgctctgtctcccaggctggagtgtagtggcgtgatcttgactcactgcaacctctgcctcccaggcacaagtgatcctcgcgcctcagccttccaagtagctgggattacaggtgtgcaccaccacacccagccaatttgttgtatttttggtggagacaaggtttcaccatgttggccaggctggtgtcaaactcctggcctcaaatgatccacctgcctcggcctcccaaagtgttgggattacaggcatgagccaccacattcagccagtgaaataactttggtgataaagttttagcaacacctgccaattggaaatcagttaaaaaagaagttaaagattctgcagtggttatatggttaaatggctctgagtctttcagtgtgcaagcctgtgtacattattttacaaaagtgtttataaaaatttgtaaaataatatttccttctggaatattttatttttacctgtgctcagtgatttctacccttgggaggtatgagatctgcccctatgttctattgacacagtgctgctctagacatttagtctgcagggagattttgatgttagaactgaggctgcaatggtagggaatattcctgcagtatttggtaccctggcatatggcctacatgtaaagaagggttagtggaaaacagggttaatatatggaactttgctttattttcaacttcactggaaagtactgactacataagttagctatagcataattgttggccatagctaattttgtttatcacatatgctcttttcttcactgcctatagctgttgagtttcactactaaaaggtcttcaagtacacacctgtattctttggcacttgaaagttgatcctttatgtgatattatacttattgtaagtctgctttgatctaaagtaattttatttaaaattatattctgaacccttttcaacagttatggaggtatttcccaaggctggtacattagaatcacttgaaacttaaaaaacaaacactaacctgcctctgttccgatttagaggcctgggatggaaggaagggtgaaaaaagccacaagaattttagatatacaattaaggtttttgttttgttttgttttgttttgttttgttttgttttgttttgttttgtttttgagacatgatctctgctcactgcaacctccacctcctgggttcaagaaattctcctgcctcagcctccctagcagccaggattcagacatgcactaccatggctggctaatttttgtgtttttagtagagacggggtttcaccatgttggcaaggctggtctcgaactcctcacctcaagtgatctgcccgcctcgggctcccaaagtgctgggattacaggcatgagccaatgtacccggccacaattaagcttaaaaaccactgagttaaggaatttcaggtgtgtgccgtactggattataaatgctgaaaaacatacaagttagtaagcaaattataaaattaatattataacaattgttttcttttttatggctttcttattgtttattttactgttagttttgaaacttgttcttattgtaatatgattcttcatttttttctaggttacatttagtaaaactttgtgaaaattatcgtcatttctctcacctctcatctttggaacgggagatgactttttgcaccaaaatggttaggtttcttcttctaacgaattaatttgtggtttaagaatagcgagactatgaggtagagatgtattaggaattgaaatgaacttttggtgaactgcactgtttcataagctataacccaggtttattatttaaatagtaaagtgtttgagattatttttctgttacttcattatctctcaccctttcctaatgcagacttctttttaagataataaagatgaattataatagctgaggaaggagaagaatgcaagctctgaaatgacatccttaaatgctgatactggttacaacctctttacctctctgaggaaattgtaacagtgtgtcttttagggtgtttttattttaccagcccttaagaaagatctctaatacgttttaatgcttttttttataatttcaagttgaagtgtttttaaaaacaccttgttttgtaatgttttgaatctcttgagatgtatttaccccactagatacatatttgccactggttagttctccatctaagctcaagaggttattcatctctctttagattccagtggtttttcttttaacttccaggtaaaatagaaactgctatggtatacaaccaaattttggggttaaacataatcagaaaagaaaatccagttaaatttatgaagtgagattttcagatcctagatcttgaatatagcaaaggtcttttcatcttgatggccccaaagcttgttggtcatagtctatttctggccattatcttcttaaataatctatttttaagccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaataccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatatttttacaggaaatattttaaataagttggtagaatttttaaaatggtactgtattagctaataaaatattcagtacaaatatatgtttggatttatgcattaaaaaactaataaaattatttccaacttttgtatttgtaaattattttggtacaggagacaaagcatctaagaaagcatgctgcacattttacttattttagcattgtcatataatctgtttcagtgatgtgtggggcaaaaaaggaaaagagacataacacctaacattcataaaattaaagtaacacatttcagatgatgttacagtagcaaagacttgtaactaacccaaatacccatcaatgatagactggataaagaaaatatgtcacatacacaccatggaatactatgcagccataaaaaaggatgagttcatgacctttgcagggacgcgggtgaagctagaagccatcgttctcagcaaactaacacaagaacagaaaaccaaacaccatatgttctcactcataagtgggagttgaacaatgagaactcatggacacagagaggggaacatcacacaccagggcctattggtggggggtgggggtggggggcaaggggagggagagcattaggacaaatacctaatgcatgcaggacttaaaccttaaatgacaggtcgatagatgcagcaaaccaccatggcacatgtatacctatgtaacaaacctgcatgttctgcacatgtatcccagaacttaaagtaaaataaattttaaaaagtcagtagaactcaacaaaaaatggatgagctgtactaataaaatgttccatacacatatgatgttttcatatatatttatgttattttcatgtactatctgtgttaagtaactgtaaagcccttgaagatcctgttttctgtcttttctcatccttcacaatgcatacattttgaaattgaaattgttctcatataaagggagaaatcataggttgctgggcttactagccatgtttacactggcagtgctctttcttagccatttaaaaatgattctgtatagtcttacacagaaggcaatatactatgatggaaatagtgtgagctgtgtaatgagatgtatctaagtttgaatactgcttcttccattagttaggtaccaccatgtattcaaaagatattcattaaacacttactgtatgtcaggcaccatgctatggttggtcatgttacttaactccatgagctttcttcacctgtaaagcagaactcacaatacctacttggcagggtcattatgaggattagtgaaacaaagttttgaagtacctggcacataaaggcactcaacaaacattagtttcttctgcactaccccctacagctcactaataaccattttagtaatatcaagttacagagtgaggttagctcatttcagaattccaaatagtctcacctttatttgacgtcaacaaataggagtactgggctgcagcttgttcttatgcaaattgttctactgaattcttgcctgtataaattttattttttattcttttgaaacatgagaagattttcacttaattcaatgaagctttttccatagtttctaggatcctatgtttgcacactaatctgaaactatggctagaagtgaggtgcacacaagctgcaacaattccttcatctgcttcatccagttgtcagaagcaaatgcacagcttcaacagtatctgtgttgctttgctgctggtagacaccaaaaatctgagtactttaataataaaattatgtttatatttttatacattacatgttcctattatacatgaaggacaaactcatagaaaaattagttttgaaaaaaacaggacattttaaagaaggggacaattatatatatacatacacatagcagcaaaaatggcaatagctcaaaagtggttaagatatacatacagacactgcaatgaacatcttagtgcatactttgtgattttaaagttatttccacaggatagatttcataaagttaaatttccttaaataaattgtggacacccttaaagccttcaatgcagttagcctcaaattacctttgcaaagctatgtgtgcaccttttggattgtatgcaccaccaaaagttagtgtgtataacaatgctcattttacaacactctcattgggattaattagccttattaagaatatattttgctaatttgtgaggcccaaaatagtatttgttattattttcatttgtatttgttctatgtccagaaaaactcacaatattctttagaaagtgtatgtctctgaagctctgtatgggttcatattctttgattcattgagtctcttcataaaggatggggattgagataaggggaaagaaaaacctttgaaaattcttaataagagaaatataaggacattttcaaaaggacaggtatatatataacttcatgcacaaaagtcaaatttaaatgggtcaaggacttaaatgaaagtaaaatatttaaagtcttagaagaaaatagagaaatacagattaaaaccacatggtaacatttacatgtcagataagaattggtgaggacagggtgccacaagaactctcatgaaattatagtaggagtgtaaattggtacagacaccttagaaaataagttgttaattcctaataagttttaaagtatgtagtctctgcaatttatagtttcaccctaaagaaatgttgttacaaatataccaaggaaaccaattacaagaatcttcatggaagcattatttgtacctgagaaaaaaaagctgaaaacaactcaaaggcccaccaacagaatggataaaatgaatatttccatacaacgtaatattgtaaaggaatgaatgtgatctacagtcacaagcatcagtgagaaccaatgtcaaatagactgttaaagataaaaaactaagtcatcaaaggggatgtgtgtgcatgtcaatatatatgccatttacatagggcctaaaagcaaacaagacaatattatagaagatatagtgtggcaaaacagcgaaagcgtaggcataattaattcaaaacataggctggtgatcacttctaggaaagaatgcaatacaggagaagccctgggtgcttcaatgttaatattcaatttcttggtgttaagtatacaagtgttcattttataattctttaaaatgtgtgtttatatatgtatataatgcttatatatttatactcttcaaagtagggcttttattcctcatcagtggttcttaaacctcatgttctctttaggtaactctgggagcttaaataagcatcaagagttgttctgatgacacgtccagctattcaaataaatgttcaaattgtagattttattgtttccatttgtgcaatgtatttttttccttccaacttctattttaggtgcaggagtacatttgcaggtttgttatataggtaaattgcatgtcatggggtttggtgtacagattattttgtcacccaggtaataagcatagtacctgataggtattttctcagttctcgctctcctcccaccctccaccctcaaataggccctggtgcctattattcccttctttttgtccatgtgtgctcagtgtttagctcctacttatagggagcacatacagtatttggttttctgttctgtattagttcacttaggatactggcctccagctccatccatgttgctgcagaggacgtgatctcatttttttatatggctgtatagtattccatggtatatatgtaccacattttctttatccattccaccatgggtgggcatttaggttgattccatgtctttgctattgtgaataatgctgcaatgaacatacgtgtatatgtgtttttatggtagaacaatttatattcctttgggtatatatccagtaatgggattgctgggttgaatgatagctctgtttaaattctttgaaaaatctccaaactgctttccacagtggccaaactggtttacatttccaccagcagtgtataagtgttctcttttctccacaacttcaccagcatcttttttttttttttttttttttttttttactctttcatcataactattctgactagtgtgagatggtatcttactgtggtcttgatttgcatttctctaatgattagtgatggtgaacattttttcatatgcttgttgcctacatgcacgtcttcttttgagaagtgtctgttcacactttttgcccatttttaatgaggttgtttgtttttgcttgttgatttaagttccttataggtgctggatattagacctttgtcagatgcatagcttgcaagtgttttcccccattctgtaggttgtgtgtttactctgttgatagtttcttttactgtgcagaagctctttagttttattagatcccatttgtcaatttttgtttttgctgcaatttctcttggcatcttcatcatgaagtctttgccaaggcatatgtccatggcctttcttgttttcttctagggttttgatagttttaaggtttacattcaaatctttcatccatcttgagttgatttttgtatatggtgtaaggaaagagtggtacagtgtcttaaaaattaccagattgtgtttcataggattttgaaaaaaagatgtcattcatagaaattgcattaaaattcacatctctcaggatgtgtttcttcatctgtacataggtgataatacctacctcatagaattatgaggatcaagccaagtgttccatgtcaatgtgcattattaagagctacacatgtgatccattttaataccaccagacaataggccaactttgaattggatgttaataaaaaagctatgatgtattcataatccaaaagagcaaataagattatttatatttgacttagaataattttttgaggagcttttgcagctactgacttctttagtatgcttgcctgagattaaaatagatattgacttacttattgtgcttttctgaggttaaaattctttcatatcctttgagcacatatagataatggcttttacttttaaaattttcttccaagagatacatataactcatatgtaaatattgagattattcagatgaagctgcaaagccagttcacagaatatactggattgaatcatatccaagaacctatgaattttatttaaaaagcacctcagctattgaaaagagcaagactgtttacacagcttcatacagacctaagaaatacaatggagatcatatacaagagttatttctttaacaaggatggtgtggcagccacaaaatacaccacctttagggtattcctctgagaacctgctgtccagctgcagggagcacaggtaactgacagccttcaactgtagcgccatcagcatctgcatggcattcactctgggtcacattcttcctgggtaacccccagccaatgaccgagcaaggaagatatactagtctgttctcacattgctataaggaaatacccaagactgggtaatttacaaaggtaagaggtttaattgactcacagttcagcatggctggggaggcctgaggaaacttacaatcatggcagaaggtgaaggagaagcaagccaccttcttcccaaggtggcaggaaggagaaatgaacacaggagaaactaccaaacacttacaaaatcatcagctctcgtgagaactcactaccacgagaacagcatgggagaaaacacccccatgattcaattacatccacctggtctctcccttgacatgtggggattatggggattacaattcaagatgagattttgggtggggacagagccaaaccagatgagaagggtactgtagggcctggctgttttggcccaatgctgaactgcttcatcaggcaatctttgctctgaagctgctcactgagcaagccaagccctggtcagccgtcctttgcaactgaaggctctcctgctttcttcctctttcatagatgtcaacgggctgaaggctttacccacccaatcctgctccccctcctctaacagctatgacaccttcctagtttcaccccttcacccattccagttttacataagttttcctcactacacagagatggtgccaccaagaccttattcattttacaaccttactgggatcccctaatgaaatccctctgagactatagcacagtagaccctggcagaagacaggacccggtacctataagatgcctttcctatctcacggatccagaccattgtcagattttagagttcctagtatggagaaaagtcccttgggaacagtagaacctggactgaactcttttaaaataagtaggaggtaggcgcctgtggtcccagctactcgggaagctgaggcagaaggatcgctggagcccaggatgcagagagacacgatggcgccactgcactgcagcgtgggcaacagagtaagactgtctcaagagaaaaaaaaaaaagtgacagtgtgcaaaatgttcattttatgtatacttagtgccatgtgctgactatgaaatatgatagcatttgtcatgaaattacaaaaagtgttaaggtgctagtttgcacgttttcatggaaaatgggagaaagcaagagaactcaaggacatgcactacatttgttttagttttgtttgagttgtgattatctcagtggctcttctctccctcacccacccacctctcctatttgttcaatctctctccctcgtctggtgccttaaaagggtctccatgctttgcatccctcctccactccacgatcagggacccacccggcatcacacgttctgcttcagcaacaatgaactgctggaaatttccagcaactctttttcctgccagtgctcacactgtacccttgcctgttaaggtcttacctgtcttcctcgcacacccctgcctctcacctgctcagaagtcccctcctgccagcagccagtcctgaccatcccctctgtgatctgctaatgccactccacctgtcacatagttcgatcacttaaaaatgatctgttttcctttgaagtctttcattgaactctgaattacttaataaaaaggtttgtatattatttattcctgttttccacccgacacagtacctggaagatagtagatgctcagcaaacattgcacaaaagaataatgtggaaaataaatggttaaaacatagaaaaattttaaagatagggtatttgggtcacttttactgttttctgtccctacaatatggctgaatcatcccccatatggctcaacattttcttaattcttttaaaagtacccaacactatattgagtgctctggggatcaaaataatagtatatatattaaggctgggtttgaatctctgctctaccatttactagctgggcaatttatataacattttaaaatttcatcatctgtaaagtggaaatattaaaggtatcttcttcaaaagtgacatttggaagaaaaaaataaagtaatacatataaagcatatgagattcagtaagcactcggttagtggtgagttgtttttgttgcttttgctaagacccaggaacccattgtttgaagatcagcatagagcactaacttgttggatgggatttgtgttctctactcaatgatttgtttattctttagagactgtctgtcccctctagagtctattattaatattttctaatgccaatttatgggagttttactattgtgctgtttctctaataatagctaatttatatttttaatttttaaaagccattatgctggaaacagagcattcatacaaacaatacacgaatgaatgtaggttatactgcaaaatagctggttactataatgtagttgtattccatggctttaagtttaaaaataacttcgcatttactagagtggacttaccctccaggcataaaattttaaaacccaacaactccaggcctccagagtctttacttcccactaacttctcaccagtgaaggcgaagctaatgaaaaaggatagatgactgcttctcaattggaaatggatccaaatgccatcaagggaattggtgtcggtatacagattttacctactgtcacagcctggttgggtggaggatggggaaggtggtggtatcggtctacttttagagttttaaatgtttctctgaattcctgtagcagacaattttgagaaaattttgcctagagaaagagtctgaaaccaaaaagctaagcagaggcaaaggtttgcagcttggatctttaacattaataagtctgttgctttttcctacctcccactcctgctacctgaagaaggtgagtaggaggggagggatggtgaaagaggagggatatggagggaaaaggacataagtggtggttgggtagatgacagatagtggttgtctgcctgccgcccatctaggtatgcccccacgggtggcctctgcttttgcccacaggggactcattcacgcacaaaggaaggtgacagacaattggccagaacatagagcactgaaatgaaacacaaaggccactcttgggcctctgtgtttcatcacaattatattagtttgctagggcgccatcaccaagtaccacagacaggtgtcggagatcaaggtatctatcagcagggttagtttcttctgggatctttcctcttgatttgcagataagcgttttctccctgtgtcttcacatgatgtttcctctatgcctgttgtatcctaacctccttttcatataaattcacaattgagcacataactcctatttaataccatatgttggaataaaaagccttatagcaatgcataggatagaaattcttttctttaaaacttagagtattttgcagtaatgaaaaatggtcctgacatacagaatgccatctagcttacacctgcatggggcatgcacggcatgaggcatgaagaagaaagagatgagcaatccttacctgaaaagagaccaccctctcctttaatgggaggagaaattaaagaataatttaatgggaggggaaattaaagaaaaatgcccatagtttgctgcaaacactattgctcaatttaatactgtaatggaatctacaatgtgtgtacaatcattgttaactatacctttattatctttataatgttgaggtaaagagctttctgctattatgcattaataactccatccctaatgccatcatggttctagtgtccagggaaggagtctgtattagtctgttttcacactgatataaagaataccaccagagactgggtaatttataaagaaaggaggtttaattgactcacagttctgcatggctggggggggcctcaggaaattcacaattatggtggaagacaaggcacatcttacatagcagcaggtgagacagagagagagagagagagagagagaacaaaccaggaagtgccacactttaaaaccatcagctctcatgagaactcactcactatcgtgagaacagcatgggggaaaccacctccatgatccaatcacttcccaccaggttcctcccttgacacctgaggattacaatttgaaatgagattttggtggggacacagagacaaaccatattatttcacccctggcccctccaaaatttcatgtccctttcaagtttcaaaaccaaccattccttcccaacagtcttaaagtcttaactcattccagtatcaacctgaaagtccaagtccagagtctcatctaagacaaggcaagttccttctacctatgagtctgtaaaataaaaagcaagttagttacttccaagatacaatagggggccaggtgcagtggctcacacctgtaatcccagcactttgggaggctaaggcaggtggatcacctgaggtcaggagttcaagactagcctacccaacatggtgaaaccccatctctactaaagatacaaaaattagctgggtgtggtggctggcgcttatagtcccagctacttaggaggctgaggcaggagaactgcttgaatgtgggagttagaggttgcagtgaaccgagatcgcaccagtgcactccagcctgggtgacagagggagactccatctccaaaagaaaaaaaaaagatacagtagcaatacaggcattgggtaagtattcccatccaaataggagaaattggccaaaacaaagggcccacaggccacatgaaaatctaaaacccagccgggcagtcattaaatcttaaagctccaaaatgatctcctttgactccatgtctcacacccagggcatgctgatgcaaggcgtgggttcccatggccttgggcagctccacccctgtggcttagcagggtacagcccctccagctgctttcatgggatggcaatgaatgtctgtggctttttcaggtgcaaggtgcaagctgttggtggatctacctttctggggtctggaggatggtagcccttttctcacagctccacaaggcagtacctcagtggagactctgtatgggcactccaaccccacatttcccttctgcactgcctaacagaggttctcaataagggctccacccctcttgcagacttctgcctggacatccaggcttttccacacattctctgaaatccagatggaggttctgaaagctcaactcttgtattctgaatactcacaggccaaacatcatgtggaagctgccaaggttttggggcttgcattctctgaagcaatggtctgagctgtaccttggcccctcttagccacagctggagctggagtggctgggatgcaggacaccatgtcccaaggctgcacagagcagcagggcccagggccctgaggacattttccctcttaggcctttgggcctgtgatgggaggggctactttgaagatctctgaaaggccctggagacatttcccccattgtcttggtgattaacatttggctccttgttacttatgcaaatttctgcagctggcttgaatttcttcccagaaaaatttctaccacatagtcaggctgtacattttccaaatctttatgctctgcttcccttttaaatataagttccaatttcaaaccatctctttgtgagcgcatgtaactgaacgctttcagaatcaaccagattacctcttgaatgctttgctgcttagaaatttcttctgccagataccctaaatcatctctcttaagttcaaagttccacagatctccggagcaggtgaaaaatgctgccagtctctttgctaaagcatagtaagagtgacctttactccagctcccaataggttcctcatttacatctgagaccatctcagcctggacttcattgtctatatcactattagcattttggtcaaaacaattcaacaagtctctaggaagttccaaactttcatttatcctcttgtcttcatctgagccttccaaactgttccaacctctgcctgttatccagttccaaagttgcttccacattctcaagttatctttatagcagtaccacactaccttggtaccaattctctgtattagtccgttttcacactgctatgaagaataccaccagagactgagtatttataaagaaaggaggtttaattgactcatagttctgcatggctggggaggcctcaggaaacttacaatcatggtagaaggtgaaggggaagcaaggcacatcttacatgcggcaggcaacagagagagagagagagactgcaagagagagagagagagagagacagaaagcaagagagcgagagcgagcatcaggaagtaccacactttaaaaccatcagctcttgtgacaactatcatgagaatagcatgggggaaccacccccaagatccaatcacctcccaccaggttcttcccttggcacctgaggattacaatgcaagatgagatttcagtggggacacaaagtcaaaccatatcagagtcttcctcttaaaattcatggaaaggtcatatctatctaatctctctctgatgcttcttttggcagtatcactaaagacatttccatcccagagagtagatgtggaggatgtcagattcagagagaaaaaattatttgtcattggttacaaccacaaaaccatttactatagttttaatattgtgaatatctgttctgatcccaacagatcatcagtcaagtagagaaaaatagaacaaactatttctagagtgtctaaaggattcattctatcattttagtagatgatatacatgaccatcaacattcagtcatttcatgaataagacaagacattataatttaccttagagtgaagctgttctcatagaatttacattgtgcaattttgctttttcacatgaataaattaggggctcaggaagcagaaggacaaataaggcagagaacaagcaggaaaaataattgaggtaggaccagtaatccatggaggatccccaacttcaggtgaaagcatagaatatatctgaatgtgagagttgagccaaagatagactcatttatccatggactaatggatagtcaaatactagtaaaaataataataatagccatcatttacaggcttactctttgctagactctttatatattatataatttaatctttaggacatcttagtaaaactgttctgcagatgagaaaattgggtctcagagatgtcaagtgcctttcttaaggccctccaactagacaggggcaaagcttttaattagatttgggcctgtctaatccattgatacaatcaaacaaaaccactgtgccctggatggaagtcattaatttaagggcaagtagaactggacacctagaaactaagagatccaggagttctcattgtatatttgggactaggtggtagaggacatgaagaacaaggaatagctggctgggaatgaaagcactgaccctcctgcaagagaaaagtaagacagaaaccatgtagttgaagaacccagattccaaaggttatctcaagcattgtttcaaaaattgttgacgaagcaaattactcagctcttctcatccaaaaccttctcggcttggcgtagacctggaatccagggcaggactgaacctcagggatggggaccagtgtccaccagtgcacacggtggagaggggaagggaagaaagccaaaaggccattaattaaacccagggactcctggctcccagcaggatcctattctttctcttcccacagtaagaagctagtggggagatacagacaccaggtgaatccctcagctgactagtcagctgtaggataactgggaaagtgagaggatcctgcgtcctcttgaggaagtgcagctttctgctgtccaggctctggagtccctgctagatttgctcacacacaggacttgcactgggcagaagtctgtggcacatgccttcaaagcattccattagctggaatttaaaattctctgacggaaatcagaatcctgtctgaaggcaattttgcaacagtgtgagatgtgcatgaggctcctgaaggccatggagctgttccaggcaattcgatgaatggagtgttcagccggtcagggcaggcacccaatttaaaacatgcaggtgaataactgatgggacctcttgctcaaacatctcgaatgcattttgccaggctctccaagtgtgtaaaagtcttggaaaataacatgaaattgccttgactgcactcataaaatggctggatgtaaatgtcctttaaaaataaaaataaaaaaaactaaagagcatttttaaggcttttgcttcacaataggatgaaaatgatttgaggtgggagcacaatgatgtcagcgaagtgtggctcagccacgcttttggtagttaatgcagtcagagacacggaggaagtcagaaaacctattctaaaatgatgtcttaatgcaaaaagaaaaagcagtgatgtgtaaatagatactgagttgtgtattctattatgcagttgaaggaaattgagatcagaactgccattctaagaaagagttgacacagattctccatttcagtttctttgaggtgcttaataatctgaggttgaatacaaagacacctgactttcccgtgccttgatttacctatctctgaagcagagaagacacagtgtggccactccatgatactcttgtgtgtagtgtttacctttctcaggcatgagaaggctgcaattacaagatggttctcagagatatgtggggtatttttatcatacttgtttaagacgagaaaaatgttatccctcattccaagaatatgaaattcaattttaagcaagttcacaaatttaaaaaaaattattatgttccttctatgtgccagaatttgtgctaggaactcagaaggcagagaacattctctgtccttaaggaacctcaaggaggagacagacatataaaccagcaattacactaagtattgcagatataggtggcagtactagtacatgtttccagagtgtgaacataaaaatgggataccggatcaatatgatttgtgtgaggttgaagctaccaatatgcaaatgagtcccaagtagatgccagaaaatgcttacctaacaaagctgttcccacctctcccagtgaaaacagaagtcagcccacaatgtctctaaaattcccactatccagcattcttaaaagccctcctaaagagggtaggataggagatgcgagttgtacatggaattcaataattattagatgttaaatattactgagaccgccattgccggccaagataaagtcagccctctatagtctgtctctctcacagattacagctaaaaatgaatacagaaagtaactatttaaggactctgaaaagtaaacaccagaagatagtttgaaagtcaaaatttgaagaaaaaccagtattaggatgagaatcctgagttatttttgcttttgtatctcactgctttgaaatgaaaatggccctaattatggaactgagcagtaggagcagacatcaaaactcagagaaatctcctttgttgaaccaaacagatacagagacctctgtaagctgaaaagtgtagaatatattccaaggctttttttttttctgtttttcccctcttttttcctcctatctctaagcgaggagtggccacagtctagagcttctctgcagcagttgtggcatgtgcacctaaaacactgagaaagcaaacaaacaaaccactgtctctctggtcagaggatcttcaaaagagttccctatcatcccaagtggatgggggaaaatttttgttttcgttctctttgtctctccagttgtgtggaactgcatatcagggtggtcattatggaaaatcaatattctctagaggattttaacaggactcagagtctcacaacataatatcagattgtctaaaatacaatctgaaactacttaacatacaaagaaccaggaaaatgtgaccaatagtcaagggaaaaaccactaacaggtgccaacccactccaaaacagcaaaactcattcttttcaagtacctataaaggacacattctgaaccattaaataaaccttaacaattttaaaataattgaaatcataccaaatatgttgacaataatatgtatgaccatacatggttaaagaaaaaaataaaaaatcaaggatatctagaaaatacctaaacatttggaagttaaacaacgcagtgtaactgtgttaaacaacacagttctaaataacccattggtcaagtaagtttcaagggaaataataaaatattttaaaataattaataataaaaatacaatttataaaaaattgtggaagtgcttagagagaagaaaattatagtactaaatgctcatattagaaaagaaagtctcaaatcaataacttaagcttccacagtgagacattagaaaaaaagaacaaacagctgagcagggtggttcacccctgtaatcccagaactttgggaggccgaggcgggtggatcacctgaggtcaggagtttgagaccagccaggccaacatggtgaaaccccttctctactaaaaatacaaaaaattagctgggtgtgatggcaggcacctgtaatcccagctactcgggaggctgaggcagaagaatctattgaacccgggaggcggagattgcagtgagccaagattgtgctattgcactccagcttagaggctaagaatgaaactccataaaacaaacaaacaacaaaaaaaaaacaaacaaagataaaaagaacaaactaaacccaaagcaagcagagaaaatgaattaacaaaaataaaaacaaaagtcaatgaaaatgaaagcagaaaaacagtagacaaagccaatgaaatatcaataaaatgcataaatctctagctatactaagcaagaaggagagagagagagaagacaaaagctatcaatatcaggaatggaagagtggatatcactacagaaaaacaaatgactgtattaccacaaatttgtgtttaaatcagggttaaatcaggaattaaatggactaattccttgaaacatacaaactaccaaagcttggtgaagaaattagataacttgatttgtctcatatctattacagaaattgaatttgtagttaaaatacttcaaaaaagaaaactccacgtccagatggttttactgagttattctcccaaacatttaaggaagaagtaacaaatctatataatcttttctcagaaatagaaaagaaggaaatacttcacaacccattttattaggctagaattagaccagcattaaaaccagaccaatatcccttatgaacataggtgaaataattctgaacaaaattttagtgaatctattccagcaatatttacaaaggataatgtaacatgactaagcaggatttgtcttgggaatgtaaggctggttcaacatttgaaagtcaatcagtataattaactatattaataggttaagaaggaaaaccatgattgcttcaatagatacagaaaacgcatttgaaattttcaatatctattcatgatacaaattctcagcaaactaataatggaaggaaatttttttaaaactgataaagcgcatgtagaaaaaactgtatagttgatttcacacttaatgggaaaagactgctttcccctaaaataggaaacaagagaaagacttttgctcttaccacttttttacaacattgttctggaaggcctagccagtgcaataaggccagaaaaagaaataaaaggcattatgtagaaaattccaaggaatctctaagaaagctctagagctcataatcataattgactaaaaagatcaatatataaaaattaattttggccaggcatggtggttcacacctataatcccatcactttgagaggctgaggcaggcagatcacttgaggtcaggagttcgagaccagtcaggctaacattgtgaaaccccatctctactaaaaatagaaaaacttagccaggtgtgctggcacacacctgtaatcccagatactcgggaggctgaggcacgagaatcacttgaacccaggaggcaaaggttgcagtgagccaagatcatgccactgcactccagcctgggcaacagaacaagactcttatctcaaaaaaaaaaaaaaacaaaaaaaacaaaacaaatgtatttctatatactaccaataaataatttatattgaaattttacattatgccatttataatagtgccataaaataaaatattaagagtaaatgtaatatcagcaggatctatatgttataaaccctgatttaaaaaaaaatcccaaagaaaggccaaataaatgggaagatatactgtgtttatgggatattcataagatgtcaattctccccaaatttatctataggttcaatgcaattataatcaaaatctccacaaaattatttatatatattggcaagctgattctaaagtatatagggtaaagcaaaagaacgagaatagcaaaagaaatttgaaaaagagcaaagttggaaaactcataccactttatttcaagttagtgtaatcaagcgtgatattggcaaaaggttgaacacctaagtcaatcaaataaaataaagcccagaaatagacctatataaatatggtcaactgaatttctaaaaacatacaaaaggtaagtcagtggagaaaggatagtctttttaacaaaattaactcaaaatgaatcatagagctaagtataaaatgtaaaactgtaaacttttaaaggaaaatataggagaaaattattacatccctaaattaggcaaaaattctcatattaacaccaaaacaatactttcaaggaaaaaaattggtaaattagaattcattaaaaattaagaatttgctttgcaaatgacattgtcaaaataatgcaaagaaaagccacagactaggaaaaaaccatctgtgaattacatatatgacaaaagacttgtatccagaatataaaaagatctcaaaaatgcaacaataaaaacacaaggaaatttttaaaagaatcaaaattttgaacagacacttcaactaaaatacatatgtatggcaagtaggcacatgaaaagacagtcaacatcaatagacatcagggaaatacaaactgaaaccactacctgccaattaggaaggctaaagtttaaacacaatatgacagtacaatgtattagtgaggattcaggccactggaatatttgaacaacagtttggtagtttcttacaagaaacttaaatacacacttacgatctgatccagcaatctcattttaaggtatttatccaaaaaaatgaaaacttatgttcatataaaaccattatgcaaatgtaatacagcagctttatccataatcgcccaaagttggaaacaaatgtcctttagtgaatggatacacaatgaataagcaaattcagccataaaaaggaacaaactattgatacatgcaacatggaagattctcaaattcattatgctaaatttaagaagctaggctcaaaaagctacatatggtaacccatttacacgctaccctggaaaaggcaaaactacaggaaagaagaacaaatcagtggttgccaagagtttggagtgagagaagttgccccaaatggggggcagttagaaggaacactttgggtcatgaaacttgattgggggccaggcgtggtggctcacgcctgtaattccagcactttgggaggctgaggcaggcagatcacgaggtcaggagatcgagaccatcctggctaacacggtgaaaccccgtctctactaaaaatacaaaaaattagccgggcgtggtggcaggcacctgtagttccagctactcgggaggctgaggcaggagaatggcgtgaacccgggaggcggagcttgcagtgagccgagattatgccacagcactccagcctgggcgacaaatcgagactctgtctccaaaaaaaaaaaaaaaaaaaaaaaaaacttgattgggatccaaaatcatacaactatacactaaaatcagtgaatattaccttatgaaaattaaaaattaggaaatcaaaagaaaagcatacatataaaaaatagttttttctaagcatttctcatttgtaaggtgttttaattatgttgtatgttgtctcatttcacccccataacaaatctatgaaagaggtacttttatccccatgttaacgtgaataaacccaggtttggaaaagtcgagaaacatacttactgtcatatagttaacaagtgactgagcagggatgtgaagccagattcctctgactccaaggtctgagttcttcctcctgcacagtggtcaattggctagatccacataaacagcatgcacaaactcaccactcacacatacatacccacagacacacaccacacagatgggatacatctcacaatcacatatatggaatgagtgatatgcaaatataaaattgcattatttttatattattctcattttatataaatcctaccacgaggcatagtctgtctcattcattcattcatttatcatcccttcatttattccctcatttcctcaggaaatagcttcctttgtggcaggtgctattccagactctggagatactacagtaaacaaaacagaataaactcaaaaactctaaaatgcaacaataaaaaacaaggaaatttcaaaaaggatcaaagttttgaacagacctttcaactgaaatatatatgtagttaatacacacacaaaaacaagtaaataacaagtgggatatttggtagtgacaagtgctatgaagaaacactaaagcaaagtaagaagagtgagtaagaggaggaactgttttagagacaatgaccagggaggcctctctgcgaaggggaattgaaacagagaatggatggaagagaggcagggagtattgggaaggtctgggagaaggttttgccaggacacaggaataaccaggagaagcccctgaggtaggagtcgcttggcacgtttgaggtacagccagtgggctgctcggcttgggtgagcttgcagggctgagagtgggaggaagccagggaagctgtagaactttcctacttacggtgcgtacttgtagctgttcttcaattctccagtataagtgtatctccctggttaattgcaaattatttacaggaccatgctttctattttttaaatgaatctcagtctgtacctggcacttcactgggcatggagctaatgccaaataaaaacgtgatggttgatgagtgctgttcatacacatttcccagtggttctacccccggaaggcagctatgtgatcaataaataggacgccaggagagtgggaatttccagcagtacttcatactgtcacctttgagacctatagagagttctgctgagggcaagtttttgtggtataggaggtcatcctgatgagggttttttttttttttttttaatggtggcttttagcgtaaattggcagggattgatcaggtgtttcctctaggctaatgctccttggggatcatgggatgtggtctgcacactcatctgagaagttccagtaatggcaaggcagtcaccaggggacccatgtcctcagaggacctggctcctcagagaaactgcaggttcactgggggagattatcaggactttagacctcaggatgaagagacacactccaggaggggctgtggatagttactatggtgccccagaaaggtgtcagggtagtgcatggggaaagccccccagggtcctggccagcttagaggcaatggggaggagcatgctgggcagactgtgcgggatccagtcatgatcagcctagctcctgaggggctttgcgtggcacaggtgtgaggataagagcaaagattccagtaaggaacaaagagacagtgagtctctaggaagcctggacttttgatttagccagacttgggtttgcagcctagctcctgcccagggtagagtaagctcctttcaccaccaccgccattataggggaatcctagcaaatctatgagagccagaagctagacacaatgcctgctgcttagtgctcaccatatacttgtccttggatagccaatgtcaagttaaatttgccagaattgtcactctgggccagaaagagctgtgtcctggcaatggtggcagggagtcaccagcaggatcgggtaggacccatggtcaccacagtggctagtgctgtgaggaggatggagatgcaggagagtttgctcccataggcaagcaccatggtggggccactgagactgagaccagcacactgagggctgggcctggcagtggcccctttgcacaggcagaagagcctcctggaagaggactcagtctgggcccactatgggggctgactgcttgtaaggaacggaatagaccaccaggggagaacacctcccacatgaggtagtgccagagcaagacgctggacctgacaacaaagccttcagtggtgaagacagcagagactccaagctccctgtgaaggaagcgactcatcccatccctagcccagctcctttcctaaggaggaaaaaggtgagaattccaaaaagaaaaactctgtcagtaaattctaacatgcgaggtctcaaggagccctactcggcccccgtccaacagccagtaacacaaaaagctggccgctcagagaccacagtacagtctgttcttaggacagaagagcagatgggtggcacacaggccataaccaccaacatggagttgctacgccaggtggagccagggcctcactcctgcaccccgtggagctgtgacagctggtggcgggcattctggtgacaagtgagccatgagcaggcttgcgtggcacagagagcgggctcgttcttacatacccatgagacaccctctggagagtcccagaaatactggcctggagcttacaggtggaggaggtgtgaaggtctgcaggtgcaaatgaggccaagcagtcagtgagatttaaattggtcctgttaacctgacctcatttgtatcctcagtatggaggcactttgggaagataaggcaagaatagtgatgatcagtaatagcatctacttgttgagcacctattgcaagcaggcactaggcttaaaactctaaacatatttttttttactctttatcccaaccctgaaataaggacatttgagacgggaggaaactgaggctgagcattcatgtaaaggttgcggcagcatctgggagaggtgtgggaaagcacaggaacaggacccaaatgttcacagcagaagcagtccctagcaggggcccttctctggcatgctcactgctccctctggactcaggaggagtctccaggctccaggaaggacatggggcaaagctctgctttttgacctgggcatctccttttgagggagtggtgagttagccaaatggggcatggaaatgactgtgaaaatggaatggcagctgaaagaaggccatgatccaggaaagggcatgaggagggcaaactgcaaaagcctgaggcactgcagggatgggaatgttgaagggtataacagcacatcagggtttccatgactttgatgcaaggggaaagcgattttcacctcagactcaaactggaagtttttctccctaccaaaaggcaggatgccagagaaacagaccttttccctcctgggtaggagtttggtgtttctccagtgctccactctgacctagcagggagctagcagagaccatcccacagtcacctcatccagcagaggattttccacatgtgccacgggctctgttcctcagcgacttcaataacagaagttcagcatttggggggtgccaggctaaaggaagtcaatcaagcttcttgttttgtgtttcattttgcttttaccctagcattttccagagcctttaacatgctaaaacgaattgtcactcaccaggagtggagatgcagccggtcctgaatttatctgaaaaatgaaaatctttatttggaaaatgcttattaacatcttagcgaattggtgttctggggaagatgatttaggaaaatctgctctatgcatgtcactgcctgcttcatgattgcttactgcttaatttgatgcaactttttttttaaccaaaagtcaaataataacccaggtttaccatttgcaaagcttctccctactcccaacacacacaccttcctccttcttcctcttctccctttccctctccctctccttttcctgccctttactgtacaagaatgccttgaataaagaaaacctataaaacagaaatataaatttggaagtgattatttaattggcctttgatttcatgacaggcaaaaataagttggccctcaatttttttttttttttttgtaaaaaatgatactttaaatactaaaggatttaaaggatacttggtaaatatttgttggtttaattcatgaaacatgtggatgttatgtgaaaatacattatctgtatcccagaaataaaaaaaaatatcctttttctggcctagagcataatacttcagccctgggggccccactcacctggtattctatgtatatggtgccccctgcagcagccctgggctcattacaagtaacactgattcttaggtgttctatgcctttttaccaatctctttagaggaagcagatgaacatttagaattttaacagggaatgtttacctgaggacagaagctagatgaaaagatcagctggaacccagaacacatatttttcctgacaatccagccaaatgtgaatccagggactcggtgtaattcatcagaacaaagcaacactgcaggcaggttgtgtggtacccatttgcctttgtaataccgccatgctcaattccaaacacagtctgtcaactcatcggagccccactggtgagaaagccaaggctggcagcaggtttggtgccacctcttggtgccagagccacctgcacacagcatggagcaagggaatagccagggtgccctggatccagttccttccagaagccagcagccctagggctcctccatcccactcccagcaagaagaagctgccatgaatatgaaggtgggaagaggaagctcagaccaggggaaggcttgggctgtgtgttaattcttctctggtccccaggacccaacacagttgtctggttaatactgcattaaatgcagttaattgattctagccccatttccactaagaaattcctgagtgctctcagaaagttacttctcttggagcctgcagcacaacaaaccactcagaacttggtgctataaaacaacagcaagcatttgtcattactatctttcacttctttaggggttgatggggctcagctaggcagtttttggtcctcatgcagtgacaatcagacaatggctggggctagagttctcttgaaggcctttccattcatattctctggtgcctgacttgggaagacctaaatagctggcggctggaacagtcggggctcctcaggcacctctgtctattacaatgtgctccctccatgtggactctctgtcagggtagctggacttcttacatgaagtcacctgtacccggagacaggctggtggaagtcaataacccattgtgatccagcttcacaagtcaagcagtgtcacttccaccatattatatgcacggagacagtcaaaagtgctgcccatgttccagggcaggagataggtctctcttcttgatgggaagaatgttaaagaatttacagacttgctttgaaacagagccttaatttctccatatcctctaaatgaggataataataccttcttttttccctaaggtataaccccttcataaccttctattataagtgtttgatatcctgatatttctttctccatgccagaacatactttcagaaaaagctgaaatattctttatagtaggatgtaaataactgataaggcttaatatggtaccattgccaggaactttagtcttttcatagatcgcaacatatttaaagccaatggaatatatcacggcattttgaacatcactgaacagtactcaggcagagatctgtgagcttggaaatgaagcacctactcttacaacctacctgaaaagatgtttactgttgcctgtcttggtgaaagagcaataagggactttgagtttgggagaaagaattcagaagaatagttaaaacctccagtcccaagaacagacctcctctctacccccaaccacttttaaacgcagacacgagggacaaactgaccacatactttgaagattacagtagatcttgaactagtaaagagaatgtatcatatgaggttaacagaatcagaaattttggccagtgaagccttatcatgtctgtcttaaaacatcattttgacaaatatttcttcttgaacttaggtaatttttgcagtcgtttaaaataaaagtctgaccattcttctttcgtaagaggcagacttggaaatagtgttgatcattacttaaattgctgtcccttcaggagttagatttccaaaggaaaaaacttaatataattcttgtcattcacttaaaatttactgtctatttctcattgtgattatctttaatagtatgatattttttattttatctctcacaccatagtatttcatttacttttaaaatggtcgtctcatcaggttctaagatcaggttgcttatttgacaggcaaaaatactcgtggattctaaattatattttctccacagcatgttattatgaagtcaccagtttagtatttgacctcaaataacactgaggtccattatgttaatatgcgctctcactatagtttaagtttattacagaatattctgaaagatccaaatttattggtaactcatgggcgaactcccattttaaatcctctagttgtttagagtcacagcaaaactagcaacttgcctttcaacatttgcaatagcataatgtggctttccacaagccacacttgtttttaaaagtatgtgctaaagaggctgactcagcattctgagatgctctggcattgtattacccgcccccaccacaaaaattttttttctttatctcacacctcaaattacaggttatttgtatgcaaaaattgcagatagttcatctatgatactaactcctggcaactcaataaaagctttttagtaatatgtttttcttaatcgaatattgtgtttcttttataatatctacaaactaattgataaataatctcacacttttaatcattttactttggaacatactctatttattctccacactaaaatattgggcaaaaaaaccttttataagaagtgcagaaataaaattgctaaagtctaattataaaacaaaaatatttggggtttgattttaaatgttttaattagaaaaggaaaagcagttttaagtgcagcttgctatatagccatattcatatgaatatatattattatgttaacacaataataactctttgcccttttcatatggaaaatagattgtgaaaaacagaatgacctttgttctaccaaatgttaaacaataaaagcatatcgttttgtctgaccatttaagacccatgatcacttttaaaactcaacaatgcttagttaaaaagtcttaattctttgtagtctgtgctacacatacaaagattacacagatttcttttctaaaacttttaaattattttctagtttcactagaaacaacaggtgtaagattctatttccaccacaaggtgtcagtccacggtaatttaagcttcaaagggctttaaactaatccaaggaaagtcagtgactacagaaaatacttatattaaaacatgctttgttaaacggatgcttgaaggcggcatgctagttaagagtcatcaccactccctaatctcaagtactcagggacacaaacactgcggaaggccgcagggtcctctgcctaggaaaaccagagaactttgttcacttgtttatctgctgaccttccctccactattgtcctatgaccctgccaaatccccctctgcgagaaacacccaagaatgatcaataaaaaaaaataataataattaaaaaaaaaaaagtaaaaaaaaaaaaaaaaaaaaaaaaaaaacatgaacagtcttcggtgccctagcagtgaataaaaaacaatcatggaaaatgtggttgcgcgtttattttcctttgtgttttctactcagcttagtcctgagaatgttgtataccaaatccccagaattttgcaattcatgtctcagaccctatcttgaggctggttccaacggagagaagtaaatcccctgctcaagttgtctttttctaaaaccttggaatattaacagttaactttactttaggtttggaatacttcattgagctaggatatgggaagctgcacttaaaagctaaggcaaggaagggagggacggagtaaacatggggtttaagggtttttttttcggctggggagcagggtttgtgcgattaaaggtacacaatttgaacaattcagggagcaagtcactctcagaaattcagcttcggattcctcaaactgtcaatcacagccacttcaggaccggctgttaggttttaaataaggtggctgggcgcggtggctcacgcctgtaatctcagcactttgggaggccgaggcgggtggatcacgaggtcaggaattcaggaccagcctggccaagatggtgaaatccccgtctctgctgaaaatacaaaaattagccgggcacagtggcaggcgcctgtaatcccagctactcgggaggctgaggcaggagaatcgcttgaacccggggctggaggttgcagtgagccaagatcgcgccaccgcactccagcctgggcaacagactgagactccgtctcaaaaaaaataaaaataaaataaaaataaataagctaacgtgtgggagggtttgtaagctctaaacggtctatctcaaagtgtgatctgggaatgcttccatatctcatgggaacttgttacaaatgagaatctcagaccccatcccagacatactgaaccggaaactgtgggcggacagcccaacaatcggtgttttaataagcccccgggtaatcttatacacgctaaagtctgagaaccactgctctagagaaatgcacaaacgttccttagtggagattaaacaaaaggcgaggggttggagggcgcgaaacggacctcaggtgcagggcagacggcatttgagaggaaactgggagaggccggagtgcgacttggggagtcttagcctccaaggacgttccggaaccctgcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtgagtcccttgaatcgttctcactggccgtttgctcctcgagtccgcccgcgtgtccctgcaaggctgggcgcccgctcccagtcttgggaggggtgtagcgggtcgcaagccttctcgtgacctggacagcggccctcctgggcgagcgctgctcaattctccgcttatgcgcggctctggggcgcgctgccttccagcccagctgggttgtggccgggccgggggttggggagagccagggactcacaggaagccttttcgctaggggcttaaggttgtggtagattattaagtttgtgctcaggttggattttgatggcaagttttttaacgtggcaaagttgccagagtttgctgtgcattgacgaatgactggtgcacagtacttaaaatcgtgctacttctcgtcttcgggtttcctggtaacagaggttttcatttttagtccttagaacactggccctactctttcaggatctgggtggggttcaggttccctccaaaatagtcaatcaaggctttaaatatgtaattctggtcaaatccactggaaggtgtttgtagacataaattttttgtacacttccaaatttcttactttgttacttttgtaaaatacatttccctccacatcctgacgtgtaataaaaggttattcatttaacatgaatgttaagcacagagggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggatcttgatgtttctctttgtatatatgtgatgagtttgaaatatttgtatttccttgcagattttattcaaagcaaaaaaactttttaaaatgaatctctagcactttctttatgataaaagtaagcatgaccaaaaaatcacatctgatttgtcagattatgtagcattataaataatcaagggctttgaaataccagttgttgctacccattatacaggtatcattagctatgaaaagataattttatctgaatctacaacaaaagtgtaataagcatttacttacgattgttaaagaactttcatttgtctgtatccaggttttactcatggaacacctatctccaaaaacactcagactatgtctatacaagtaaagcagcacagtaatatcagatacacagccaggcaaaatgaaactcaggctatccaggagaaaaaaagtaaattcaataatttccacctgagtcatgtacaattcagtttaacttactttaatgcattggtaaaagtataacataaaacatttcctgaaagaacaaattatacattagctgtcaggacttgctaactcaactgtttgcttcagaagtttttcataattagcaaaagtaatcacaaactttatctttcatagtggtgagccatttattactaaagacaatagagctaatcgtgcaaattaggaaaatcaattaggctattcagtaagtggagtccagtttttctattttttgttctattgcaaaggatgattattcattattacatgggggataaggaacctccttgggcacaaatttgaactctgcattattggagttcagacatacagagatatattcgcaggcagtgaagaaaggagttgagagcagcaattctgaactggagccagggcagacaagagtgcccttgagaaaaaactcagcataaaagaaaaagaaatctaggactctagaattgcaaaccagattcatcaagggaacaacatactatgggaccacttaactaatgacacatgtcattccgtaatcaaccagctctgagatgcagcagtcaagtaccatagtctcacctgcatggcaaagtgccagctcctccagtactgagaaggagaaatcaagtttcaaccttcctagtaccaagacattatagaggctgcagcttggaattgtttgcaggtgaagtggcacctcagtgaaactttcagggacaatagccgagttctggcttgattatgggagccctgtcttgttagccatggtaacaagcaacaataggcctattctgaaacacagaatatacctttttgaggattcctagttataagagaaagggaatcaacaagggccttaaaagcaaggcacaaaacatctagattccatttttactcatagattggtaagaactaaagcattcacactttgtagcttttctgaagtttttacaatggttgggtaatattgttatgagccaaataaaacaataaaagatgtctttaaaagaacaattataatgttctggtataagcttgaattttactcacctcgccaacatctatagagcatattccatatgccaggtcagtgctaaacagaggatatatcaagatagaaatgatctagtctctactcgcagtcatggggaagacaaattttagtgcaccaatggattctaaatgtactggtatcacttaggaagaaatgaccggttccctttacaagagcaaagccaggaaagtataaggttgagccagaaaaaaataaactgttgtttgagctgggtattgtgtatgtaaaagttcctcagaatgggagggcagggtgtaatgtgatgtgttggaagacctagcttagagtggctgcaacagaatatgtgaaagaaataccagattacatatagacaaaggatagataggtcaaggtcattgtatgacatgaaactaagtttgggttttgccctttagggagtagggaagccattaaaaactttaaataggagctaaacattattcgggagctcctacacattattattttaggcgctaaacatgatcagatttgcattctagaaagaactatctgtagactatccaggagattaatttgatggtgaggggcaaagggtgaagacaagttagaaaacaacaaaaatatttaaggagacaactgcaatatcccagggcagagacaataaattcccaaatgaaggtcattacagagaagaagataaaagaagagagctaatgaaatatgataggaagatagaagttctcatcattcatgaacaatagaagatgaggaacaagggggaggaaggcatttagggcagagcttctaggattcttttagcttggataacttaagaatgataccattaaacaggatagaaaaattccacagaaggagcagatattttaaccaaaacaaaaacagtgtgtgctctgtacattgtattgctgtttacaatcatctcagttgttaaggaatgcagtgtgtttttttagtttcagggtacacaaatataattatgaaagacatatagtttgggaagcggaaaggaaaaggtatttttcctgctcctttgaaagggtaatttttaaataaaacttttgatatggtcaacacacttatatctggataattatagatatgaacgtagatatgagggtcactatgctataacacgcacagggtcctcctggagtagaaggaacagcgcctagaaaacagctggctgtgagcccagtgccttccttctccaagcagagctctccttcctgaacaaaatgagtccacctggggtttattttctttaaagatttgctcaatagagattttattatctttggtttaaaataaaagttaaaatgatatatttactattttaatgagttacatttaatgttttatggcaacaaaaaagaaatatctgattctgatgtgatttttcagatcatagactacatgtctaaagaagcctataagaaattatggcctatgaagtgtggaatctgagactgctggcaagatggccgactaggaacagctctggtgcacagctcccagcaagatccacgcaggaggtaggtgatttctgcatttccaactgaggtacccggttcatcccattgggaccggttagacagtgggtgaagcccaaggagggcgagccaaagcagggtgggacatcacctcaccagggaagcactaaggtcagggaactccgtctcctagccaagggaagccattagggattgtactgtgcacaccagcccagatactacgcttttcccacgttcttcacaaccctcagaccaggagattccctccggtgcctatgccaccagggccctgagtttccagcacaaaactgggcagccgtttgggcagacaccaagcgagccacaggagatttgtttcataccccagtggcacctggaacacccatgacacagaaccgttcacccctgtggaaaggaggctgaagccagggagcccaagtggtctggcttggtgggtcccaccccacagatcccagcaagctaagatccactggcttgaaattctcgctgccagcagagcagtctgaactcgagggaggctcaagcttggtggcgggagtactttcagtactggcttatcttcatgtatttctataagaactctgttttctctcctattaaaactgctattacacatcttccttccactaaaatcaacaatagtgtctccacttatacccagttggtagattttccttaggaaatagatgcaattggaagagaatgagttcatcttctcaccaacaaaatctcttgattgatgtacatgcgtctggtacccatatcttctgcatattacaacagaaaaattatccctctcccagtctatgtctaactcaaagagttttggtcttaaattgcactcatttctcttgtgtcatcaatttacccctttctgctggattattcccattaatactcaagcattagattaaataaataaataaataaaaatttggaccaacgtccccctgtagtttctacccatttctctgctaacctttaaaacaaaattactatagatacttgccactttgatattaatttacctattcagctttcttttggttagtatttgcatgacatatgttttctcatcctattatttacaacctttctattttcctatgtttttagatgtcttttgagaaccgtatatagtttagttttttaaaaaaaaattcagtcaggcaatctttgcttttaattgcaacctataggcctacatatttaatgtcataattgatatatttggacttcattataccaccttactatttgcttcccatttcctcattagttctatgttttttttctttctctcttatatgacctcatttcagattgattgagattatttattatttcagttttcccttctcaagcaagcatactttatcttactatttttagaagttactctagagattataatatcatcattgacatagcagtctaatattaattggcacttttacctcttcttgttcaatgtcaggaacgtctaccctttaacttcagttaacccccttttgacatatatgctattgttgtcatgtgttttaattctatatatatttaaactcaatagaaattataattatggttttatatttattgagatttatacacagttaccctttcggttaaaaaaaaaatctttagtgttccttttagtgtgtaatgcatgcctgctggaaaaaaaaatttttttcacaagtttttgttcttaaaatatctttattttatcttcattattaaagaatacattttagatgcttagaaatctaggagggcagttattttctttcagaactttgtagaaagtttcattgtttctgatgaaagacaaaaaatctcattctaaccattgcttcaagagatccctatggctactttataattttttttttttttgcgttagttttcagtacttttgctatagtgaggttaactttggttttcctattagttatcttagttagggcttgtaggcattcttgaacctggagtttaatacgattatcagatttggaaaattctcagccattatcttttcaaatattgctgatgtcccatttttctctctcctttttcaggatttcaattacccatgctagatgttctcattatatctcctattttataactctgtctttttattttcttttttttctatacttcctcctgggtaatcctacctatttcttaattctctcttcaattgtgtctaattggttattaaatctatccactgaatttttagttttagttctgaggtaaactcagttttataattttaatttgttttcatagcttccaattttctgtcaaatttcctactcttgtccttaatctccttcagcagaataagaatcttaaaggtaaatctattatcatctgaagttcatatgagtctgtttctattgtcaggtttttttctccttatttttcattaattcattttatgtcctaacatgaactggttatttttactgagtgctggaccttatagttttttaaaatcatacaaataatttgaagctatgatgacattatgttactccagagagaatttgtgttttcttcagacagccagttaggggctctaacaatgtgggaatctcttaatccaattttaagaattgagtttacttaaaattgggtttaagcccctgccaaacttgaactacttctggttcacatttattcctaagagtaagttccctgagattccgacccagagcttgatggagagtggctccaagggctctcctccttggcatactctggattacagattttgttccattagtctcttgaggctactaaaagtactgttcaagacttgtaacctctctgttacctcttctagaatcccctaatggaaaagtaaacctcagtgctgggtttacctctcttgggttctttcttcctccaagacttattacccatcaccattttgttagctactcaacaccttcaggcacagagtttttataattggtcttgcttttctagttgatcccaggtttggtacatataacccaggaatgaccagcagcagaaatcactagagagagttgattacatttgttatctctatgtccccctcttccattttctctcttctattctgtacaattttatctctcactgttgcactacacctctcttgtcaagatgaccaagtgataaaatctcagtcctcactttacttgctcacccagtaatatttgacaagtttattcctctctttcttgaaacattttattttcttggcttctgggaaaacctactccctgagtgacttttctgtgtcatttgctggctcctcttccctttcctatcatctcaatgttagcaagattgactctttgatgtccttttcttctctttttataaccacaatagaagtaatcatctcctttaatctcatggccttaaatattaggttggtgtaaaagtaattgcttttttccccattactttcaatggcaaaaatctcaattacttttgcaccaacctaacaaaaaacatcaaaagtatgttgatgagtcccaaatttatatccctaggctttcacctgagctgcagcctattacatctgcctttttgacaacttctcttgaatatctaagaagcatctcaaacataagattctaaaggcaaaatcttaatttctttcccattctcgcccagttgctcaagacagacactcaggagttatctttggtacttccttttacttcatacccatatcccatttaccagcaaattctacgggcttgaccaccaaaatatgttttgcatccaactgcaacctcactaaactcatcgaggtccaagtcacagcaatctctctcctaggattcttgcaacaaacttccaaaatggtcttcctgttcccactcttgccctcatcccctgctaccactagcagaatattttccacccagcaaccagtgtaattcttcaaaaatgtaaatgctatccggtcactcctatgcacaaaactctccaatgttttcacataaattttaaaataaaacccaggctctttaccatggtctacaaatccccaaaacatctggaccctgctcgctttctgaactcatctcctgccactctttacctcactcaagccactcacattccactggtattcttgcgtgtcttcaaaaataagctcattcctaccttaggcccttcgtattctctatatcctctgtctagaatgttctacctatgcctcagtttttacatgattagttttttttcatcattcacatctatgttgagatgtcacctcttcagagtgcctttctctgactactctacgtaaaatagctcctttcctgtatccttttcctgggctttatagttttcattactctgcatattatgtcttttataggtgtacttgtgtttcctggttgtctggttctcctactcaaaagaacagagattttatcttatttgtgacagtattctcatgacttagagcctggcacatcgtagaagctcaataaataattgttagatgaatgaatgaatgaggaacatggttgtgttatcaataaatggttgagatagtagtatttagaaaacaaaaatgacttagataagtgattctcaaagtacgctccacagaccaggagtaccaccatcatctaggagcttactagaaatgcaaatcctgggaccccccagcccagacctactaagttagaaactggagataagcagagtgatctattttttatcaagaccttccaaagattctggatgcatggtaagtttgagaaccactggtttcagggataggccaaacctagcctactacctattttataataaaattttattggaacacagccacttgcattcatttacgtgttatctatggctgcttttgcactacaacagcagtactgagtacttgcaacacagacattatagcccacaaagcctataatatttactatccagcccgttataaaacaattttgattacctctagtttagatcaacgccttatgctatgtaattacggcaaagtaaacacatacgattcatcttctttttcaccgaaatcccactgaaattaaagaaaagctatggctaaagaaggcaccatagcatactgaaaaacagaaaagggtagcatcagtggaccagattatttgaggaatttccaggacataaaaaacatctcggagagaggagacaacagtgagatcagattaaaagaaacaagtatagagactgcaccacaagattcaaatagaggctattgcaaaaagcagcaatagtttctaagaaaaccgcagatgagtattattttccaagtaagcaagctaaatcaaccaccgagaaaacattgggtgaatcattaaaggactaccatcagaagatctggccagtgacccttctacccaaagacttgcacagctggctacagatctcatttataaacaaagctaaaaggctttgggaaaggctcatggcttcagtattggagtctgagaagcagagtacagcaagactgccacagtgacagcagaggcacaggaagaaaagggaagtctgactagagcatttgccaccaagaaaaagtgtcatgtacaggtctctaaagtaagagtactgaaataggagactcccagaatagcttcaggaaaaagtacaaggtaaggacaggaagcccatgtttacccagtaaacaaactacttccccatagttatggattaaattatgcccccccaaaaagatatgttaaagtcctaatccctggtacctcagaatgtgaccttatttggaaataggttattgcagatgtaattagtcaaaatgaggttacaatggagtatggtggtctctcaatccaatatgacttgtgcccttgtaagaagagagagatggccgggcacagtggctcacgcctgtaatcccagcactttgggattccgaggcgggcagatcacttgaggtcaggagtttgggaccagcctgaccaatatggtgaaaccccgtccctactaaaaacacaaaaattagctaggtgtggtggcaggcacctatagtcccagctactcaggaggctgagacaggagaattgcttgaacccgggaggtggaggttgcagtgagccgagatcgtgccactgcactccatcctgggtgacagagcaagactccatctcaaaaaaaaaagaagaagaagaagagagagacacagagaggagaatgccatatgaagacatgaagacacacagacacagagagaagacaatcatgtgaaaggagagacagagggccaggcatgatgattcacatcagtaatctcaacaatttgggaggcctaggtaagagaattgcttgaggccaggagctcaagaccagactgagcaacatagcaaatccctgtatctacaaaaaaaataaaaaattagccaggcataatggcatgtacttgtagtcctagctacttgggaagctgaggcaggaggatcacttgagcccaggagtttgaggctgcagtgagctatagtgcactgcagcctgggtgacagagcaacaccctgtctcttaataataataataaaaagacagaggcagagaagctcgaagaagaaaataatctcctagaggctttggaggttgcatggcctgacagtacttagattttggacttttagcctccagtactgtgaaaaaataaatttctattaagccacttagtttgtggtttgttagggcaaccctaggaaactaatacagtagacctccgggccacacattctactgctccctctttatcaccaaaagtggaacccgaattaacagacaatcaaattatcaccaaatacttggggaaaattaacatcattagaaaggatcatctgattcaaataactgaataactaaaacttgaagaaaattaatggcagcaacagaataagactttttaagtataatttatttggaggtattcgagaatatattactttaattagcaaaaatatgacagctatgaaaaaaacagaaacaattgggattcttggaattaagactattattactattttttttttcttagggatgagatctcactatgttgctcaggctagactctaactcctgggctctagtgatcctcctgcctctggctcccaagcagctgggactacagaccagcatcaccacacccagtttagttacaaaatattttttaaactataaaaaactattctgcatagtaaaacactgtttattaagttaaaaaaagaaaaacactcatggaaaacaacaaaataccttttggcatacaaaaagacatgcatatttaagaacatatatgaaatatcttaaatagaaacaatggtggggagaatgggaacacgcgtcaaggatgaaagttttaaaaataaacaaataagctgggcatggtggctcacgcctgtagtcccagcactttgagaggccaaggcaggcagatcacccaaagtaggaagttcgagaccagcctgaccaacatggagaaaccccatctctactaaaaatacaaaattagctgggcatggtggtgcatgcctgtaatcccagctactcaggaggctgaggcaggagaatcgcttgaactcgggaggcagaggttgcggtgagccaagatcgtgccattgcactccagcctgggcaaaaagagtgaaactccatctcaaaaataaataaataagtaaaataaacaaatgagcaatcctaagccaaaagaacaaagctagaggcatcacactgtcatgagatccttggggtgttgctttgccagccggaaaacctctgtggctggtggcacatttccccaggtttttactcaggcccactgggctcattccacccacctggcctggcaggctgtgcttggctcacaccactggcccaaatctcatgcctaccaaggacgagccaggcacagagtagcaaggggtatgtgagtgagagtggggttcagccactgggcacagccaggcacaccggctgtggtaaggttggcagctccaggtgccagcatgggtgccagctccctatgaggctgcatctggaccaggcatacctgaagcagcttccacagctggcaccagggaatgcggtagcacccagaagcttggagatgccaggaatctgcagagcctcagagagggtggcacagccctggtttggggagctcctaggtctgggatccccaaagggccacagctgtctctccttctctcttctttctttcttgttgcctgcaacgtggtgagcaaggggcatatttcatccctgtttttgttacagctcttttagccctcccatttggcaagtcctgagttcttgtcttgcatccaggaagaatgatgtacgcaaacaagtggaggtgagcaaggtgaagaggagctttattgagtgacagaggagaccctggagtgggtagctcttctccacaggcagtcatctgatcatctccttgatctggctgagcccaggggttttatgggcttcagaggggaggaaggggtggtggttggttcatgggtggccatggggagcccagagaaagcaccataagttcccatcctggctcttcagccaggcctctggattcaggccatccatggctcaaaggtggggcttcactagggacctgcctctttctgccctgcctcctgctgtcatccatagcactcaggctgtttgtgccaagaggcaactgcaggccagtgccgagctgccttcagcaacccccctcaccctctcccgtgcttgttgatacccaaagtctgaagggcgccaaggcagcaggggtctggtgtgtcagcactgctccaagcatgtgcacccacccagattgtgacagcacccaggctcagcctcaattttgcttcaagatcagagcaggcaccaggagtggggagaagccaggctgtgggagcagacacctccaagcctgagggggcagaggggcttcctgggcccccaagaacacaggtatgcccaggtccacagctgtggcttgggtggctgcagctgtacctgggaagcttgaggcttctgcactgccaattcggaagggcatgaggcttctgcctgttcccagctctcaccagctccatgaagctcaaagccaaggcagcgcctccccacctgcagctggtgtcttcgcagccaccactccaggcaggcggctgctgccatcaacattacccgacttaaaattatattacaaggctttctatcagggtaaactgtcagtcaaaaaaagaacaaaaaagaaatagaaaaaaattatgctacaaaaatatagtaatcaaaatatcatggtactggcataaaaatggacacatagataaacagaacaaaatagagaactcagaagtaaagccatgtacctccagccaactcatctttaaccaagttgacaaatgtagaagaatgaaactggtcccctatctctcaccatatacaaaaattaacccaagatagattaaagacttaaatttaagacccaaaactaaaaaaatcctagaagaacacctaggaaaaactcttctggacattggcctagacaaagaattcatgactaaggcctcaaaagattcagaggggtaggaggggagtaaaggatgagaaattactcagtaggtacaatgtacgttatttgggtagtggttacactaaaagcccaaactttacctttatgtaatataaccatttaagaaaacgaacttgtattccctaaatttatacaaattaaaaatgaatgaatgaatgaaacaagacacatgggcaaattataaaactgtgctatgaattaagatggtgtgattaactatttacacccaggatccaaaaaggagaaaactttacatattaatagggaaactaatttccaaaatagatatagctgaagattaatttacagaactaaacgtctaaactgagggattctcccagaacacagttcaaaagaaaaaattcataaaatggaaaactttaaagaagagttaaggggcatgaaaagagacccaaatgatctcaaatacccattgtgtaagtttcagaaggatgcaatagaagcaataaaataagaaaacaaataaataatggagggaaatttcttggagctagagaaagacactagacttcagagcaaaacctctgtaagatgaaggggctgaggagggaggggaggaatgcacgcctttgcaagcttgatggaacttcaggccaccaaggataaagagaaaaatcccaaaaacttccataaggaagaaacagacttttttctttggaaagaagaatctgattccaaataattgaggagacaaagtaggtgattatgcacattgctaagatttggctctagaaaaagctgggcagtagatggtattgctagaagggatgtcatcaatagtgagctaagtgtactaaaattatcatttttctcacaaagcttcatgttctgaagggaaagaggcaattataattctggtcccagctataaatgggctggtgccaatgtatcatcacccaactgcttctctaaaatccagctagcatccgtctctcataagaagcagcatttatacgaagacattctaatgtctacacatctataatccaatatctgtaatataatctataatctaatatctgtaatccaatataatatctgtaaatgctaactagcatcatttcaaattataaacccctatgaagtctccctgataactgacaatgaagccagcatacggagacttttccagagtcatgagcttgtgggtggcagaacaagggctgggaggcaggcctcctgactttgtagccagtactggtgccaccatgtcatgctgacagctcagcaccaatccttctatactctcgtgttttctcctgtttgtgataaagtatgtacatctgtgtcattggaaggcttggagaagagtccaaaggtgcaaaacaaagcaaatctccccacgcctggcagaatcttcagtcctggcctaatgagctcaccagctcagtaagttctgcgactgcttcgggttaccaaaagaatagagtatgtaacagtgctaggaaaagagacacttaaaaacccacatccaggcattgttcaatgactgctcataaatactttatggcaaaattctttctggtggcacagaaggccatgaacaatctgacacctccattagtcacctctgttagtcaccactacgacttcctgacccatctctgggtttcacttcagtttttagatacccagccctaacaattaagcaaaacttcattgatagttcctcttcaaaagtatttccagaataactattaaaatcccatggactagtcaagatagtgagatatgcttttgagtgaacagccaccatttcttccttttagagatttattttttaacttaacaaaaagcaaatctaatgtgaaacttaatgaaaattgtttcaaaaacttgaaatgcaactacaaaatagcccattattgcctaagctttctatacttaactagttttctaaatctatattacataggctagagaaataacatattgtttttatatgtacaatccaaatctagtctctccgaattttctttaaggccaactattttaatataggccagtattttactctattattcaatcgcaaaccacgtttctttcctcacagtagtgcattttgacaaaatcaatcttttcattcttttcagcaaataatacagaaattgggattcattcatgagaagtcagtgaaaataaaaatgatttcagattttctttacatttgtataatatcactagtagaggaggaatggctttccagaccacttgttaggaaaaaaatatgagtgggaaattacactaagcctatataaacaattccaaagtagaattctcttttctccttggtaaataaatgcttgattttcataattcaacatataattttaaactagggcaaccaaacttgtgacatgaaaagaggaattttattgttaagttacactggtatactgcaaagtcataccaaaaaaaaaggagcaaaatatattttttaataatcttacacaagaatgctcaagaatcttctacatgaggtaactacagaaaaaaagaacactaggtcagctgaaggctgaactaaatttgttccataaaagttggtgagtttcatttttcgcttctaaggggataaaggaaaaagaatgtgcattgtgtttaagaaaacccagaatactgccaaaagtttgccacccactttggcattctgcctttatcctgaaagataatttcttctccattataaacagcctatgtgagatgaactgtcaacaagagggaagctagagtgagaaacagagaaaaagaacagcatcatgcaaggaaagttatgaaacaaattgactcttgattctctcttggcttgcctttcttaatgcaaatagaattaaaaagtcaaatagccctaatgttagccaggtgaagtgtggttagaaatggttgactggaaattcccttgctttcatcaaacaattgttatgtgaatattgcatcagcttggtccttttgatgttcctacatgacttaagaaaactttgtatttccagtagtgtatttccaatgacaaaaactctgctgtgtgattttagaaaatcactaaaattaccagtgcttttgctagatctttcacagttgcaaaaacaaatgtttttgaacaaggctctatttttcatgaaaatattcaactgaatgcagggaaagtaaatgcaaaatatctagggaaggcaccaatcaaatcatgcaagaagagatttttctagacttcaaagaaaaagtattcagtgactccaaggtgtggggcaagggaggcaggggagtgatgaatttgttttctttgcattgttccacttccttgtttgctgtgttgcacaaactctattgaatatcaagatttggcctcttatgaataagatacttaatagagaagaatgtcagttttttcaagcccataaataccttttaaatgttcttagaattttacaattggatgaaaaagcatcaaaaaacatagtttgtataattttatcattaaaaatattttccattattattcaaggagttcattgatgctgaatacaaaatgcctaagatttattatttaagtttatgagctaaaggaaatcttagtgtttatctagcctaacttccttgttctacatttctgttttgttttttcaaatgatgtatcttgtttgcttcacgattatgttaaagaaaaagttttttttcagaaataagaaatagattataaatttttaaaaaggaaagaaaattgaggaaaaagggaattaaaggatattggataatatagagaaagatatttatagggcataaaatcatttctagtggaaggaggacacatgggtttgtcattgccagagcaccttttgtttttctgagcattttgtgagatggccaattttacccagcatagaatcgagtaagaatgaaactgaaataatttgcaaagttgaaagttgagtgtgaccataagcctccaatcctagttccagcctgcccaccatgctgggaatatagtttggatatttgtccctgcccaaatctcatgctgaaatataatctccaatgttggaagtaggaccttgtgggaggtgtttggaacatgggagcagatctctagaagctgagcaaatgccagcaccatgcttcctgtaaaacctgaagaaccatgagccacttaatcctctttttttataaattactcagtctcatgtgttactttacagcaaggcaaaaatggcttaataccttgggcatgctccagtagagattagaattcacatgaaacaacaaatgagaaacagggagaaaactattaagaggtctatggtagggaagattgtggctattgtctccatttacttttagaatttcttcgtgtgtgtgtgtgtgtgtgtgtgtgagagagagagagagagagagagagagagacaactagtagaaacagagtaaccaaatctcttaactggaaatgactttatatgttgtattactaaaagacgtccaatttccaacatcctgaatatatacagtgacagaggacagataactcactattttatggggtagtttattcatttttgtaaataccagccattgttcttaatattgttatcaagggtctcaacccgaaaataaattcatctcccctacccatctttcgcaacaacaaagcaaaaaattccccttccagactttgtcacatctgttaatgacatagccattttatcgaactcaaaaactttgtgttcccttgcatttaaaaatccagttatcaagtgttgctaattccaatttggactccgtagcatccattcctacccagtttcgtttacagcataccatcacttctgctgtacatttattcatcacacagacaaactctgatataatatggaggaagattatgcaagggcatgaatactaggaggaaccattgaggaatatcatggaggctggccaccacacaaggtaacagaatagatgaccactgataagatcactgggaagaggacatctttctccataggtctagaaggaaaagttctagagataactctgtcttagtttagatcatgtgcccatctctgaaccaataattatgaccagagaaatggactcccttagttaaccagacttgggtcatgtgctctacctatggctttttttttttttttttttgagatggagtctcgctctgtcccccagtcttgagtgcagtggcgtggtctcggctcactgcaagctctgcctcccatgttaacaccattctcctgcctcagactcccaagtagctgggactactggtgcctgccaccacaccggctaatttttttgtatttttagtagagacagggtttcaccatgttagccaggatggtctcgatctcctgacttgtgatctgcccgccttggcttcccaaagtgctgggattacagacgtgagccaccgcacccggcctacctatggcttttgagggcaaatggtgtcatctccacctgaatcactgaatcagaaaagaggggatgctgaacggaaatactacatatatcctctattctacctcacatttcaactgctttcttggtcttctaaacatcctcatattactgtctctatcttccttttcaaacagtacatagctgacaaattaacttcagtaaaactcaacttggatcatatgttttcttttctcaaaatcttccctaaatgggtcctcacacttaaaaggtaagtccttagtgcttacctggcattcacacttttctataatctcaacccagattcttctggtctaatctacaattttatacctccctaaaaaagtcaatttactcactttcttcctaaaatgactttgactccatggccttgttcacattgttcacattcttcattcaccaagaatacttttctctcttctttcctgttcaaagtctacccattcttcaagtgcaagtcagagtttacttccatatagatttttatagtcatcccagcctgaaggaactcctttctctccctttcgctctcatggtatttttgttgtatcattcttaaataatgataaatgttttattctattatgaattcatatttcaataagtaacacatattatctagctatccatattgcaaacttcttaaaggcaaggacaatggcttatatttcttttcattctgtgagagacgtagcttgcatttaataaacatttattatatatctggataattataaatatgaatatagatattagtgtcactatactatggcactcagttttaaaaagaaaccttcaacacactagcttcaaccaaagtccacaccagacaagagctgttcagtaattagaaagacactacaattctaaaacgatgtgcacttactactacatagctgcagaaaatgagttgctacttttcaaaatgaacgggattgctgaagcaataatctagattattttagccaacagtaatatatatatatatatatatatatatatatatatatatatatatatatatatactcctacttcaagctagctatctacaatggttagatatatcacgtactgctattttgctcttaaaagagtttgtttgaactgaagcatagtcagcacaaattacttctgggaaaccatttctgagagaatttggctctttacatctttggccagaattccttgagttttggcttccagtctgtattttgctttcctggtagaaatgtgtactcctagtatcttgctggcaaggatgcctctgccaaaaggaaatacacactactttattcatgaaaggacgggaacactctcaggtagactattggcatgtagtctaagtgaaatgagcccacccatcattacaaccttaccaaatatgtaagacacttccaagtattgtggataaacactcctaggtgttgtgcatatacaaaatcatccagaagttaccctagaaaggatggcaatacaaagtagtatgcatgttccaagagaataataataagtgtcataaataattacagaaggtagagtttttttgagtttggaaagctcaggaaaggtttcaaaaggaaacggatctaaccgatggatcatttagtaaagatggacgatttagtagagtcccacaagagtcaggactaaaaatgacatattctaggccaataggatagaaaaagagggctaacatagaggcataataagtaaaataaggtaggcaatttggaaatacactagagaaaagctttaagattctgtattttatactatagacaatggagatttttgagttttcaagcaccagcaaaatagtgttttaataccaaattgagatataattgtcagttttttaaaaaaaaagttttctaaaaataaaataaaatcactaaaataattttgaagaaaaagataaattgaaaaagatcttttggattgttttcaaaaagatagaaaacatgcttttggaatagaaataacgcatagcttggaatggaattaatgaagctcaaagtcagatcatgagtaggaagcatagaattcaagcactttagaggctggaccatgaaaggtaacattataactaaaataattcagcacttttattcacatttagtgcttttttcctgattataaaataacccagatatatggataggaagaatcaatgtcatgaaaatggccatactgcccaaggtaatttatagattcaatgccatccccatcaagctacaaatgactttcttcacagaattggaaaaaactactttaaacttcatatggaaccaaaaaagagcccgcattgccaagacaatcctaagccaaaagaacaaagctggaggcatcacgctacctgacttcaaactatactacaaggctacagtaaccaaaacagcatggtactgtaccaaaacagagatatagaccaaaggaacagaacagagccctcagaaataataccacacatctacaaccatctgatctttgacaaacctgataaaaacaagaaatggggaaaggattccctatttaataaatggtgctagggaaactggctagccatatgtagaaagctgaaactggatcccttctttacaccttgtagaaaaattaattcaagatggattaaagacttaaatgttaatcctaaaaccataaaaaccctagaagaaaacctaggcattaccattcaggacataggcatgggcaaggacttcatgtctaaaacaccaaagcaatggcaacaaaagccaaaattgacaaatgggatctaattaaactaaagagcttccgcacagcaaaagaaactaccatcagagtgaacaggcaacctacagaatgggagaaaatttttgccatctactcatttgacaaagggctaatatccagaatctacaaagaactcaaacaaatttacaagaaaaaaacaaccccatcaaaaagtggtcaaaggatatcaacagacacttctcaaaaaaagacatttatgcagccaacagacacatgaaaaaatgctcatcatcactggccatcagagaaatgcaaatcaaaaccacaatgaggtaccatctcacatcagttagaatgtggatcactaaaaagtcaggaaacaacaagtgctggagatgatgtggagaaataggaacacttttacactgttggtgggactgtaaactagttcaaccattgtggaagacagtgtggcaattcctcaaggatctagaactagaaataccatttgacccagctatcccattactgggtatatacccaaaggattataaatcatgctgctataaagacacatgcacatgtatgttcattgcgacactattcacaatagcaaagacttggaaccaacccaaatatccatcgatgatagactggattaagaaaatgtggcatatatacaccatggaatactatgcagccataaaaaaggatgagttcatatcctttgtagggacatggatgcttcatcctactcttcaccagttagagtagttcccttaagtacataagcaaacagctacttgcatcacaaattattgtaattgtaacaaagtaatctacattcctaatgacgctgcatcatgaagaaaacataaaattaaatagcacgcaatctatttaagagatcttaaagaaataataatcatgaataatttttaaaaactattggacaattatctaaataattccataattattctgaataaatgataagctgtgatcatcctaattagcttgggaaaggttttatattagaataacattcaaaagctgaaaaaatatgaaaaattaaggtaataataaagtaacataaaataaattaaaagttgcaattacattaaaaatcactgtggccataattatgacctgtagacacatctggaatacaagaacacaggcacagaagtcacttaacaaatttttctttttatgagtgatcagcaatgagtattttaacaggttttaacactacattcaaacattatcacacttaaaaagagggcttattattgtatcaaaatatctttttggcaaaaagttaaagcataagttgaaatgtgatgagtacaaaatgattagggggtataataaaatcattattcatcttaatgcttcattccagctagcaatccaagttagcaaaagtcacaggaaaaacaaggattttaaaagttgagtataagatgagaaatactaacaactatttttggcacctgtttaatgctttgtggctctatacatttcttaacttttcctgcttagactctctctttcagtgagtctttattctagtattcatcctttcccaatccagtctatgtgctctgaaggaaaattacctcttccctagccataggggtggactctggatcaaaccatatctgaagcttcctcatcactggatctttcaattatgaaactaatacacttcttttactggtcaagtcatttggaattaaattttatttcattagaaaattaaattatatcatatataatgtgtatgaaatatgtatacacaattaaaataataataataaaatgaacactcatgtaccagacacccagcttaagaaataaaacagtgttcagagctcccctaagtgccctgccttattataactggcttcccatcccaaccctgagaggtacacaccatcctgaacttttggtttatgatatataacaaatatcttttcacaatgtgactaacctttttcagttcctctatggtttccattcattatagagagtttttaattttaatgtcaaatggatacattttttcctctgctagttcatattactgtatgtgtcttatttaatagacctatcctggctaggtacagtggctcatgcctgtaatcccagcactatgagaggcccaagtgagaggatcacttgagcccaggagttccaggctgcaggaagccatgattgtgccatttgaaaatattatagatagatagatgatagatagatagatagatagatagatagatagatagagatagataaatagatatttttctatgttttcaagttttccttttcataataagtattttattttattagaattgatttttgtggggtaaagtacaatttcacatttttcataaaattatttttcacaaagtaacataatgtaaccaaactcaggtttggctggtagctgcctgaaaagccaagtgcacaagaggcaaggtgtggtggaaggaaagcagctttattcaaatgccagcagttgcagaaatggctgggctcaagctgcaaagaaaccatctcaaatttttaagctaagtgaaggagtttacgaggggaaacacatgggaatgggagtagtgcagggtgcaggcctgcatgtgttgttcccatggttatcttgagctattgcccatctgggtgtggctggccccatctaggttaccagatgagttgtaaattaaccacctaaagaggaagaagtctgcagctaggtctccatatctggtttgttttgagattagctggtggagtttctaaggaagcctgtagtcagagaaacatgcacggtgcaaggaagtttctactgggaaagagggagaagcaaagagcttcaaagtacatttcaaagctatattctgagattggagaaataaaatctaaaatgctttttaaacctaagatactcagttacaaaaaacaatagttcttccttcctgctgacatacaaggcctgctctgtcataaatcaagtttttttttcctctatgcctgcaccagtttttttttaattgaggaaaaaaatatatatataattcaccatatttaccattttaaagcttgcagttcagtggtaataaatacattcatatttgttattttccctcttcatcccctacaccctcttcttaacctctggtaacccacagtctactgtctatcttcatgaaattcacatgtttagtgcccacatacgagtgagaatgtgagatatttgtattttacttaatgtaatggcctctagttctatccatgttgatgcaaataacaggagttcattcctttttatggctgaataatattccataatgtatatataacacatttctttatccatttatacattaatggacatttaggctgattccatattttggctattgtaaatggggcagcaaaaaaacagggaagtgtagctatctcttttatacattgatgtcctttcttttggatatatacccagtagtgggattgctggatcatatggtaagtctatttttagttttctgaggaacctccacgctgttctccatagcggctatactaatttgcatccccaccaagagtgtatgagggttcccctttccccacattcttgccagcatgttattgtgcctgggtcaattttaatgctacctattctgttcccttagtctgtctaaccctataatatagaattttgtagctatataattatcctcggtatctaggagggcaaatcatactatattgctcttcttctctgggaattttgtgactattcttacctcttgctcatccatattgatttttgaattaatgcatctagtgccataaaaaatcttgatgggattttgacagaaactgaattgttagatatatttggaaagagcagcattttcacaatactgagtctttgtacccaagattatgaacgatctttggatattctttaatgtctttttccatacggtttatacttttctccatgaagtgcttacatatcttttgttagatctattaatggatacttggtattttcaattgccataataaatggtatctttcttaattgcattattaaactgctcatagctgatgtattgacatgcaataatttatttatgttaatgttttaaattgagcaatcttgttaaactctcttattaaatctcataatttttctgtggacccttgggttttctatgtaaggtcatttcatttatgaatgacaatttctccccctccttttcaatcattatacttcatttctttttctttcctcactgcagaagccaggactacaagtacaatgttgaacagtgaggtgatagagagtgtccttgccctgtttcttatttaagaacatgcattcaacattacctcagggagtgtcataaatccttacggggtgctgaagggggatggtctttcttctgtaccatcttcctgctggctttcagtggtgaccctgcctaacaggggacctcatatgggcaagatgattggtggtagccaattttaaaagaagacaacaagcttttgagccaggttgtccggctccagcttattcccttagcctgtcaatgcagttagaaccagaggaacaaagttacaggagctgaccaaaaagctgaaggaaagagttatttcttggtccttctcaaggggaggaaaaaaaatactgaaagcagtgacacacagcaaaagtttaatttttgagatatgattctgagaaatttttttaaaagaaacaggtcataaaattaaaagtaaaatattttgcaattttagtgagagaaaaacaatactttaagaaaactttattttaatatacgggaccaatcttagaagattattataaataatctctttttaataataaccaacttaatcacctacaaaattccttttataaagtccacttcatgaaccttatgatgacttgcacagaccatctatgatatgcttggagtttctgacttgtcctaaacttttctctttcttaaataatcagtcattttactttaggacaaaagtttaccatagaagatgcttttttatataaaattattctcttttttaatcttccttaccaaaaaatacatcttcatatctatatctttcttcaggtctctctttttcctacttactgattcctttctagcttacctcataattaacatttttagtccatagtttgagttgacctttagataacctctgaattacataaaattattattttcttttttaataagactagaaactgggagacatctggcctccaatgcttcccagagtgatgcagaattaaacaacccaaagaacaaaaatcattaagagcagaaagaaaattgtaagtgtaaagttcagggcatgcaagcatagggcaatgtgcatcagaagctgctgccacaatagcacacaggactctctattttactggcatgttgcaaataggcctagtttccacacaggaaagagtgtgctattcccaccagggatatccctgtggtaggtacttgtagaactacatgaggtttattggtgtttatcccagatttattagctggtatgcttgcatcccactctccccaagggtcaaagttcttaggcctcatagctgaataacagtcatcagcacaaaaggggttacagtcttcatcagcactgtaatgggagtgattagattgacataacatattttggaatattaaagtaataatattccattttatcaagaattccagttttggcccctagaccccatgcttcctttcctcttctgaaactgttaactgggtcttgaattatagctgcacccctattttgaccataataccattcctagcagggaaactgggcaacttggcactaccagaaattcttgttgaaatatttgggttctttgttttaaattgacaagtcagagaaggagtaaaaaatctagtttgtggcttttcttccattctgataacacttatagaccgagaggaaacttttcctgcatgagcagtaaggacatagtagttttcccctgtatcaaaaagaaactgaatttggatgcccatgctgtccagagttacctggggttcctcaatggtaattatgatattcctggaccaagggtggtgagggagaccctgggccccttcagtcttcatccagttcctccctttgcattgcaagagttttgactggccaagcccctagatgggagtagggcagtcaatcctctagtgccagagatcatgactggtatctttgcactgatggcaggggcctggtgggagtctgatacaatccttcatccaatgtccattctttttgcacttgaagcaagggttactacatttgggccctcacaggtttccctttgacatcttttgggcctttagggcattgccaatgacagcagccataattttagcttgtcatttattttccctccctttctctaggtcacaattgttgtataccataaaagcagtatccagaagctgtgtctgaggccctatttccaactttagaaacttgcatctaatattaagggcagactggcttatgaagtgctgagctataagcgctttcccttgttaagaggctgggtctaggttagtgtacagttagtttaaccagctgtaaaacatagccgggatttttctccttttcctgggtgacttccctcagttattccttttctcattcttccatgaaaggtcaaaacccaaagacaaggtttgaaaaccatttgcaaacttcctaggattttcagagtaactctctagtttttctttacattgctgtgtatctgttaccaaaaaaggggcttggactagcattgggcacactggccctgccacctctctgagagtaaataggcttggggggtggtgtatggggtaccttttctattgtgcagaggactcagcaggatttctgttgactcttgtggtttttcttccagtgtgctaggtgaagagttacatggaggcagctgtggttccctctgagagactggtgacccctgtagcagagaattatttatgatgtctacacctgtcttggaactctccttttgagtaccttttcttgaaactttgcatatagatgggttctactaggggaggcattttatctcctgtgttgttaaatgcacacagtgaacaggtttgacaaacttgcttagccactgaagccatattagatctgatgaagagtttgtttaccgtggctagtatggcatccctccccttgtggaaggagtcatgcaaggtttttatagctttccactgggctgcttgagggagatacaattttggccacatatgtcaccagagtctttgtttttgacccccttgctctttttattagttgtttttcttgtactgtgtagttaggttttacaggggaattagcataaggaaacaaagctaaaactggttggtattgtattctgagggttgccactttggctttcttatcagccttcctgttttccagcactatgggctaagtgtttctcatgccccctacaataaattatagctatagcctttggtagatatatgcttctaataattgaagaatttcagccccatgttttatgggggaatgcctgctggttagtaattctttttctttccagactgtggcatgaacatgaaccacaaggaatgtatatttggaaactgaaaaaatgttgagctttttctctttttctaatattagagtccaagtaagagcaatggtctcagctttttatgctgatgtgcctggaggcagcagctggacctcaatatgtgttgtaatttactattgcatacccagcctagcattctccatttgacacaaaattactgccgtctgtgaaccagccatcttcaggatctgggagaggctgatcttttagatcaggccagctcatatatgtgtgtacaaatatctgcttgcaggaatgatcactgggcatgtgggcagtagtggagctggattcagggtgttacaagttttaaggataacttctggattattttaaaaacatagcctgatatttggttaacttttctcctgtcatccaaatgtgttcttttgcctccaagattgatttaagctggcatggggttagtacttccagtggttgacccagagtaatcatagtggcttcctctactaaaatagcagtgactgctattgcccacaaggagcttggacatctcaaggacaccctgtccaatttatacctttccttttttttttttttttttttttttgagacagagtctcgctctgttacccaggctggagtgtagtggcaccatctcggctcactgcaagctctgcctcctgggttcacaccattctcctacctcagcctccccagtagctgggactacaggcacccaccaccttgcccagctaattttttgtatttttagtacagacagggtttcaccatgttagccaggatggtctcgatctcctgaccttgtgatccacctgccttggcctcccaaagcatacttttccttttagctacatgtaaagaaaaaggcttagtgaggtctggggtgcctagtgcaggagccttactgacagcttgttttaacttagtgaaggcctcccttatttttggtgtgcattcaattggctcattctctggcccccacatgactgcataaaggagctttgctataaatccaaaattgggaattcatattctgcaaaatccaaacatccccagaaaaggacaaatttgtttggtgggggtgggtctaatccacatatggcttgcacacgctctggggatatctgttgggattgaaccgtcccccagtgattgaggatgcagccaagggggaagtcgggtgagattgaaactgagtttcttgtcttctgtctgtagagaacaaggaaaacttgaaatttagagcgttctggcctagggccacacactggggcgtcccccattgaagggcctatgctggggttgagggccaagagggcatcccctgcttgggcctcttcatgacatgccacatgtctctggccttagatgggcatcagcaccacttgaagaaggattccgccatatttggtgacctatgattaagtttccctttagtccccaggtgctgccctcagcttttggcatctctgtagctggccaaaatagttttcttccccaaatggtttccttaactattgtggtaactgtagtttgaagggcaaggaattgcagactccccagcttgaatttgttaaagattggcctcttgataagggaagagaatgccctctgaccagataaactacatgcagtgatttccccatggatccgctgcacaacttaggcaatgatccgagagtctccaccaggatttttctcttagcaccaggtctgctaaactaaaacgatccagatctggtccctcacaaaagaagcagggtttttttccttatttagctattgcctgggtcctttgggtcggggtacagtaatttcttgtttcaacattacgaaaacaaaaatcagaatgttatgtcttgccacacacacaaatacctcacaggcacagggatttgtcttgtgcctggtgaagcctaattgctccgttccccaccagcttatcctgtccgagtcttccagcaggggggcaccctagtggctcttaactacccatcttgtgcccccaaagagtgccatcagaggaaagaatcagaaagcaaaaccaaaaataaaaatcccaaattggcgcttacctcctggctggcttaccaaaaatactacgttaccagctgatgttgcaaagtcccaggttcttcactgagcaaagaactggacatgacacacaaatagcaaagcagcaaaagatttattaagcacagtacaatttgcaatggactgggctgacccacaagtggtatcagccccgatttgtaacatttcatggccttttattatgtttttttactctaacttactcaactttatttttttgtgaccaattgctcatccttgcctttcccttattgcaccttaaccttactttatctcttgtaggctaattgctcattcttgcctttcccttattgtgccaacttactgtttacttctttttatctagtatgctctgcttttgtttttgttttgcttttgtttttgttttgagatggagtctcactcttcgcccaggctggagtgccatggtgcaatctcagctcactgcaacctccacctccaaggttcaagcgattctcctaactcagcctctggagtagctgggactataggcatgtgccaccatgcccagctaatttttgtatttttagtagagactcggtttcaccatgttggccaggctcatcttgaactcttgacctcaagtgatccacccacctctgcctcccaaaatgctgggcttacaggtgtgagccaccacacagccctctgcttttgttatcttgcatgttctccttaagctagcctacatccaacagttccccttcgcccccagcttcctctgctattcacctacctcaacagtgatatacttacatcgtatttcttttcattgatattggcctggtatctcttttgaatctgtaatttttagttgttctgtgctcttgagctttatgcttaacttttataaatagtatatatatgtatttgttttaacctaatctgaaaattctctcttttaaatgaatagcttattccattcatatttctggtgattactgatacatttggattattgccaccttctttttctttttttagagagatagggtctcttctgccaccccgcctggagtgcagtggcaccatcatagctcactgtaaccttgaactcctaggctcaagcaatcctcctgcttcagccgcctgagcagctaggactacagttgcatgccaccatacccagctaattttttattttttgtagagacgagggggccttgctatgttgcccaggctggtctcaaactcctggcttcaaataatcccccatcttggctacccaaagcactgggtttacaaacatgagctactgtgcacagcctatttccaccttcttattaactgatttttattcgcttcattttttatgccttttcttctttccctaaatttcccttcttcttcctcactcccagcagacaactttgcatcttatttcacagagataaaagaagcaattagaagataacttccacatgccccccacaacatctagctacttcactgcatgagggacccatctataaccctttcttctattgaggataaactgctcattctcctagccaaggccagcttcaccacttatccactaaataccatctcttcttgcctacccaatgaccttgctcaaacaattctctactcttttaaatcatcaatctttcaatctctgctggatcattcccataaccatacatatataggattgtttttccattttaaaataactttttttctggactctatcttctccttcagctaccacaccatttctcttcttcagcttacaagaaaactcttaagaagagttgcctatacttgctgtctccagtttctgttttcccattctctgaaccaattcctatcaggtaagttaccaataatcttcctttctttttgttttttttttttttgagatggggccaaagtgcagtgctgtaatcatagctcactgcagcctcaaactcttggactcaggtgatcctcccacctcagccacccaaagtgctgggattacaggtatgagctactgggccccctggcctgcacattttaaatcttgttctcatttttcattctacttgatcactcaaagtccaagctactcaggaggctgaggtgggaggttcacttgaggccagcatttcaagtctagcctgggcaacatagcaagaacttgtctctaaaaaaggaaaaaataaaaagtatttgacacagctgattattcccctttctttgaaatatttttttcacttggcttctaggacactcaattgtcctgctttttctcttacctcattagtggcatctttttagtttcctttatccttactccttctctctctcactaccaaacagtggaatactccaaaactcaatccttggggttctcctcttttctaactactcttacaccattggtgatttcatggtttgtatatctcatatgccaataactccaattaatatctctagaccagacttctcctctgaaccccagactcaaatatccaactcctcacttatcatctctaacataacattccccaaactgaattcctgatctatttcccatcctaattttgtttgacacaatctctaccttctcagtgaatggcaactccaagtcctcctgttgatcaggcctaaaatcttgccattatctttgactcttcttttctcagaccccacagtcaatctaccatcaagttctgttggttttacttttagaatacatttgagaatcctacatttcccctaactccactcctaccaccttcatctattccactatcacctttcacgtgtattattacaacagctccctaactagtttccctgcttccatccttgtctcccttcaatctatttactacactgtagccagagttagtctgttaaaatataaatcaaatcctatcacatctgcttaaaatcctccaaggcttcacatctcattctgttaaattccttatttagcctgcaacaccctaaacaatctcagcccaactgcttccccacatcctaccttctgtccaagctctctgacctcatctcccactagttggtctcattcagtcttttctagacaagctggctgttctgtggacacagctcctgtctggcctcagggtctttccacttgatttcacccttactaggacatttccccctagctgtctacatggctcacctacttatctctcacttcccactaaaatgtcaccttgaaggccattcctgtccatattccttatttatttccctttcttaatttttcctgtagcatttatcatcatcaaacatgcttatatttctatttgtataacttatgtattgtctgtctttcttcaatagaactgatgcctcatctttggcatcttggtacaaattagaaaatgattcaggcatgtgcgtgtttgctcgtacacacacacacacacacatacacatacacacatacacgttcatcccaccccatgcacaggatttggttagcagctacatttgtgtaaagaaaaaggcatgggtgggagcagagtaaaagacgaattttatccacctccagtgtccccctccccattcaactcctcagccaggtgcctttgggcagaacattatgcacatgattgacagctctaagtagaatgtaagcttcatgaagacagggatattttttgtcttattgcttcttgtgtccccagtaccttagaaagtggcacacaaacactcaataaatatttgaaacataaattaatagtttgaaaaaaaaacaaagggtaaaagttattagttgttattttaaaataaaaaactaaatgacataatcctggaaaagagggcctcagaacattgatgaagttcataaaatgggtaaagtgactgctgtaaaataacccagaaattaagataataaggcctagcatacataccaaatattggaaagtatgggaattattttactatgtaattgtataataaaaataagaacaggagaatgttgttcttggcacttttaagtcaatgacctactttttacttcttgccttgactaagatgcactacaaattttaaagtcctttgaatggtacattctttggtgatttacttttagagggaaatagttgattgttcaaaatcaataaacaggaaaaaataaaaagactatggaaagtctgtacacagtagctgtcccagtgtctcttttattaaagttttatttcctctttattaaaatgtttgcccaattctcttgcccatttatggcaagcataaactgttgcttctcatctgaatttgtgtgagctattttgaaatatttaagacattaatctttcattcagtttacagtaaatattttcactcagtttatgttttggaaaaaatatatagaactttaaattttatttagtcaaatttgtaagtctttatctttgagattgctgtcatctattcaagcttaagtagcctaccagcaatatgacaaactttcatttctgcttttctgattttcttttccatgtgactttgaaattttaaaatttacatacctaatagaaattagtttggtgtattgtatgaaactggtactataaagcattttgttacttaaaaacactgtgatcaattctggtaacatttgtttagaaataaactctaacctcttttcagagatagttggatttagagtcataaaattccaacatttcaaaggacatttccattttacttaaatttgctttaaaaataagttaactatcttaaatgtattttaaaagataataaaacagagattaaaatcagctcctgctttaatatctcctccattactaatcctctgatctctttacagtcatgaaggtcaaacatttatgtttatagaaacagaagtcctatttgtttcgtaaagctggtttattttatcaggtattaacaatgggcatcaaaaaggtgatgtaacagtatgaaagcatgaaataacgtctttgtgattttttttaaagaataaagcagtgcttctgtctggggacttgggaggctgatgagggaggattgcttaagcttgagagtttgaagctgcagccaggtgtgatcacaccactgcactccaacctgggtgacagagtgagatcctgtctctaatatatatatatatatatatatatatatatatatatccacacacacacacacatacacacactatatatatacacactaagtatactaatacatttatactatatatagtatatatactgtatatagtatatataatatatagtgtatatattttatataaactatatatagtatatatacactatacatactatagtatagtatattatatatagtatatatattatagtatactagatatactatatagtattctctatatatactatatatagaatactgtatatattctatatatatactctatatactatatattctatacatatactctatatagtatactatatatacatatattatatataaagagtatatatatagaactttgatcacagaattgatcacagtgttaagtaactatatatttatacatttatatttatactatatataatatactatttatatttatactatatagtatactatatatagtataaaaatatagcataaatatagtatatatagtatagtatactatatacagtatactatagtataaatataaatataaatgtataaatatacatgtataaatatgaatgtataaatatatagtataaatataatgtataaatataaatgtatacatgtatagtataaatagaaatgtataaatatatggtataatataaatatatgtatataataatataatataaatatatgtctataataataaagcaaagaagaaaatggtgtgctaaaaaagtgtttacaactgtaccttaagtttttgagcagtttgtataagagatacagaatatatattattgatcaaacaaggaaaatgaacatttttgggttcttgttttggttatctatcattgcacaataaattgcccccaaattgacagcttaaaacaataacttattattttcacacttcattttaaagacaattgtatttcacaactttcattttaaagacaattatatttcgcaactttcattttaaagacaatataactaaggctcaaaatggttaagcaagttgctaaagattcaaataagtcattgaagacattctaactcctgatccacattaatttgcatggcaacatactgcctttttcatttattaagtagtattccaactataactaaattatactagcaattcaactgaaattgggtatgactgatccttattaatttttaggacttaaatgtgagagttgtgaggtaatggagagtatagagcagagtagggaattaaaaaaaagcccaagttagttctagactagtgtttcccaactttgaataaaatatgactcattttaaagaaagaagaagggaaaaaaacccatgactacactgttgacttaaaacttttaaattaataaaaaatgataaaggggatatcaccaccgatcccacacaaatacaaactaccatcatagaatactacaaacacctctatgcaaataaactagaaaatctagaagaaatggataaattcctcgacacatacactctcccaagactaaaccaggaagaagttgaatctctgaatagaccaataacaggagctgaaactgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatctttgatgaacattgatgcaaaaatcctcaataaaatactggcaagccgaatccagcagcacatcaaaaagcttatccaccataatcaagtgggcttcatccctgggatgcaaggctgattcaatatatgcaaatcaataaatgtaatccggcatataaacagaaccaaagacaaaaaacacatgattatctcaatagatgcagaaaaggcctttgacaaaattcaacaacacttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacgtagtgttggaagttctggccagggcaattaggcaggagaaggaaataaagggtattcaattaggaaaagaggaagtcaaattgtctctgtttgccgatgacatgattgtatatccagaaaaccccattgtctcagcccaaaatgtccttaagcggataagcaacttcagcaaagtctcaggatagaaaatcaatgtggaaaaatcacaagcattcttatacaccaataacagacaaacagagagccaaatcatgagtgaactctcattcacaattgcttcaaagagaataaaatacctaggaatccaccttacaagggacgtgaaggacctcttcaaggagaactacaaaccactgctcaatgaaattaaagaggatacaaacaaatggaagaacattccatgctcatggataggaagaatcaatatcatgaaaatggccatactgccctaggtaatttatagattcaatgccatccccatcaagctaccaatgactttcttcacagaatgggaaaaaactactttaaagttcatatggaaccaaaaaagagcccgcatcgccaagtcaatcctaagccaaatcctaagccaggaggcatcacgctacctgacttcaaactatactacaaggctacagtaaccaaaacagcatggtactggtaccaaaacagaggtatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttctttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaagaaactagcatcagagtgaacaggcaacccacaaaatgggagaaaatttttgcaacctactcatctgacaaagggctaatatccagaatctacaacgaactcaaacaaatttacaagaaaaaaacaaacaaccccatcaaaaagtgggtgaaggacatgaacagacacttatcaaaagaagacatttatgcagtcaaaaaacatatgaaaaaatgctcaccatcactggccatcagagaaatgcaaatcaaaaccacaatgagataccatctcacactagttagaatggccatcattaaaaagttaggcaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattaaggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcatatgtgggaattgaacaatgggaacacatggacacaggagggggaacatcacactctggggactgttgtggggtggggggaggggggagggatagcactgggagatatacctaacgctagatgacgagttagtgggtgcagtgcaccagcatgtcacatgtatacataggtaactaacctgcacattgtgcacatgtaccctaaaacttaaaagtataataaaaaaatttttaaattaaaacttgcataaatatgttcaaatataaaatgaattataaatttcttatgattacagtttacacacaactataaaaccaaaacaaattgcaaaattgttaaattatatctaacatgtatagtacataataagtactaggcactttacatctatcaacttatttaatattcacaacccaatgagttggacatgattattatcgccatttaatagatgaggcaaccaagactggaagaagttaaacaacttgtccaatgtcccaaaactgataaatggcagagctggatttcacagaaaagttaacagacaagcgaatgtgaagaatgataccgttttacagaagttaaattgttccttgtaatgtgaatatggtattgactttaactgtagatcttctggctttaacatacataaattaaaatgagcgggatagtgactaatttctcccaccacttgtttttctcttctgtcaactgctaaatatatattggcacagcacaaattaatgtcatttggtcttcattttaagggaatggcttgttacaaattaagtctacatctgttctctcaagttttttcttaagacaattcctgattactatttttctttattattgggatttaattcacatactatacaatttatgcctttgaagagtacagttcagtggcttttagcgtattcacaaacttgtgcagccatcatcactaattccagaatattttcatcataccaaaaagaaatcccacactcactaagcagttaatatagtttagatattcgtgccttcaaaatctcatgttaaaatttgatccccagtgttggaggtgaggcctagtaggaggtgttttggtcatggaggggcggacccctcatgaatggcttggtgccattcttactggagtaatcccatgagaactggttgttaaaaagagcctggcacctccctcctctctttccttttcttgccatgggaaacctgctccccttcgtcttctgccatgaatagaagcttcctgaagccctcaccagaagcaaatgctggtgccatggccatgcttcttgtatagcctgtagaactgagtcaaaaactcttcataaattacccagcctaggcattcctttatagcaatgccccacactcttccccaccagccagtaggttggcaattatcaaactattttctgtaatgattttcctattctgaatatttaatataaacggaattataaaatatgtggatctttgggtctggcacctttcacttagcataatttttcaaggtttatgttgtaatccatgccagtattgaatccctttttatacctgaataatgtttcattttgtggatgggatcatatacatttcatgtacattttaatcaattaatggacatttgagttgtttctacctttgggctactatgataatgctgtgataatatttgagtgcaagtttttgtgtaaaaatgttttcagttctcttgggtatgtaactaggagtgaaattgcccaactgttttccagaatagttgcacattttactttcccaccagcaatgtatgaggatgccaatttctctactttctcaccaagacttgatattgtgatactgactttctgattatagccatctcagtaggtgtgagtggtatctcaggtggttttgatttgcatttatctaaggattaaggatgttgagcagttttttgtttgcttattagccatgcatatcttctttgaagaaatgtgtattcagattctttggccattttgtaattgggttatttctctttttattcagctgcaagagttctctcattaagatctgacaggttaatacaacaccaatgcaatgataaatgcaaaaaacagggactctgaaattgcgtggttgtactcagttataaggtggtcatccatgagatccagaatcaaatttgatgaaatggttaagattataatgttttataatttgtttatttgaaaatatacattttaaatgtttgctagagagctctaatatcctcaagaatacctacaatgtaaacactgttctatgcatagactaaatccttagcaatagacagaaggaactgagtgctctttgagtgagggaatgggcttgaccagtgtttgaagatttaaaaatgaatatgaagacatgttgtgacactagggtatgattatatttttatatttaagtagaatctgattatcatcagaaaaactctaattttaaaatccatagctggcaatatccatgaattcagcccaggtcatcaaatgctgaaagcacatgggtcagattgactgtctccattttttcttgcttacttcaaagctatgaagaaatccaaagcccttgctgatactcttccatgatatattccttttaaatgcttgaaaagttttcccttcctacaggaatcccccaaacacagctgtccttacactgagcccctattcaaattttggttcctctttctaacattggtcgtcagtcaattttgctggtctataccaactgcagatctagagccaatgcttatagaacttttctgagaattcttttaatttcagataattttttaaaattaccacaaaattagtttagaagaattcgcagagaggtacattgggagggaaatagctttgaggccctttatggatttatgaccaaagctatccagtcaaattcctccaggtatttttgctatttcctatgggtatactgaaattacacacattttaaagcttccttaatcaacttaaacaaatacaaataataaaattcagtgtcaatgagatactgaatctaaaagataaaagtacatccatatttttataatgatttttcaattgttatggaaagaaatatgagactatgtaaacagaaaaaataaaatttcttttaattaaaaaacccacattaaaaaatatatcccaagaaaatattcccatcacttattactccaaagagtaatttgttcaaggaggttaaagcagtgttacttataatagttaaagaatcagaaaatgtactttcctaaaatttagggttaagaaaactattctaggccaaacacagtggctcacacatgtaatcccagcacactgtgagagggatgggtgatgtgggaagatcacttgagcctaggcatttaagaccagcctgggcaacctagggagatcccctctctacaagtaataaataattagctgggtgtggtggcgtgtgcctgcctgtagtccagcttctgggaggctgaggcaggagactcacttgagctcaggaggttgaggctgcagtgagccttgaccatgccactgcactctagcctggattacagattcagaccctgaaaaaaaagagaaaggaaggaaggaaggaaggaaggaagggagggagggagggagggagggagggagggagggagggaaggaaggaaggaaggaaggaaggaaggaaggaaggaaggaaggaaggaaggaaggaaggaaggaaaaactagtctataccaatatataaactatatagccattaagaattataagactttagaacatgttgatctctggaaatatgtttatgaaataatgttaattataaatatgtgttttgtacagatgtacattcaagcattttaatagatttataaatccttgtgtatcattttgtgttcaaacacagcgtatttctttttttaatcatacttaaacaatttattttttatttcaatagtttctgaggaacaggtggctttttgtgacatgaacaaattcttttgcagtaatttctgagattttggtgtacccatcaccagagcagtgtacactgtactcaatacgtagtattttacccctcaccccacttccccctggagcccccagactccactatatcattctgatgcctttgtgtcctcatagcttagctccagcttatgaatgagaacatatgtttggttttccactctgagttatttcacttagaataatcatctctaattccatccaggttgctgagaatgccattattttgttcctttttatggctgagtagtattctgtggtatatatatactatattttctttatccactcgttggttgatggacatttaggctggttccatattttttgcaattgtgaattgcgctggtataaacatgtgcaaacacagtctacttcagattatatttacatgtataaatctattgatgtatattaatgtacattgacaaataaatgtaaggtgatgttaacagaatttcatgtttattgaattctttggttttaaaacaaagcagcatttcacaaaaattattctattttattataagcactgcttacaaacaaatttgttcaaaacaaatttgggggtttggggaataggttaggtaaaatgtttttaccataggaattttcagagcctttaatttattaacatacattgtggatctctaaaatgaagagatttctcttattgtttatctcaaaatctactatttacatcacgacttacatttattttgtgtaaataaatctgcataaatcttatttgcacttgttactaatttatcgttttcaccaaactgtaacttctatcaggacaggtaaatatatctgtcttcttcaccactgttcctagagtgccagccagggcatatagaagtggctcaatatttttgaagtgaatgacttgctagagcagcatttaggcaaactagtgcctaaagtcacacattttgggaactaccactctaaagttatttaattgtataataacttcaaaggaaaaaaatgtgttaatgcccctaggccactagagatccatttaataattattgcttcgcttcagttgagtcacttactactttagggaacagaagagatttctcagagagcacctcatgacctggaaaagtcttgcaaaatcattttcatactctgcatctccagctgaaaaacaatgataaaattagttaccatggaagttaaaggaatcatgctttgcattaacaccaacagtcttctggaacacatttggtaacattagatttcccatcaaagatatttgtttattttaatagttcaagcatgaaaaagagatatcccttttggaagctgcaaattgttgactcactgattctcatttaggaaaagggatttcacattactttatctattttctcaatagtcaaagcccatgttaagagagcttttaaacatatttaaaatatatggcttacctacatgttttacatgataatttatggttatagaagttagaaagtgcaatttcttttaatatccccgtggggaagttatataattctatagttttttaaaatatatggaaaagcaatatactttccgttaactgctaagattcatgaattttctccacaagttctccagaggaactactagaaaaaactccacgaatctcattatttgacagttttgttgaagtgaaattattaaaattgatattagatttaatgacttgtttccagtaaccaaaatggaaagtattctaccagctgtcgatggttccacaccctgacacatcgttaaaaccttagcttctgcctaaactttaaaccttaataatatttggcggtaggggaggggttacatttcaagtcaaacaaaggatgtatttccaaagcagcatttacaaaggttaatctgtgtatggactacaaaggggaaagtgcagtgccccagtgatcgatctaagacccccctctcgttgttgttgttgttgggtttttttggtctggttaataaaccacctagagggataatttttaaacttaatttgttgaaatggtactttactaatgtatgaaaaaaatttccccaaatttgagaatttttggtaagttgattttatatttgggaataaagatctcttgcttcttctactgacaccttctacacaaaagataaaaggtacttttacttggtaatccgcagggagaaaatttacagaaacccagagccaaaggtgctctcaggggatcccctgaaacattcaaagccattgcggccccagaaggtaaatggctttcgcaggaacacaggtctcctgactcacggcctaaccttcctttcccccacaccaaagctcgcgcggcaccagctagagtgaaggtcaaagtcaacagaataatctctgcagtccagggtctgtgagggtcctcctatccgagggagttttcatgaaagggcatttccgaacattttattccaaggacacagtctagtcaaaagacgtttgggatagggtaaacatgaggcaaaagaacacttacaaaagaaaaaagcgcagtttcttggaggcttgtcagaagctaagactggggagatgagaaccagggcccttggcgagagttggggtgggaatcgcgtaagaaaagcaatttctagagcggaaaggtgaccccacattacaaaaagaaatggagtagaaaaataggcttgactattctaaagctgcttcagaaagaatctccggaagaccacggaggaaccccgcaggggagccaggcggatactcagccgctcgcggtagaagggcgcgcaaagctgcggagccgcgtgtgtggagctccccagtgcactcactgctggctccccctcggtgctctgggcccttcccagctccctccacacagcccggctcccttcacacacccccgccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagtatttgatggaggccttctaatacttttctgagttatttcttttcagaagcatccagaaagcaatacatgtgatagttatggaggggttttgtttgtttttactaaaatagtcatttagaaaaacctccatttacatttattttattacattatttcattttactagcattcattaagcatctttaaatcagaacacacacaatattcaagctattctgtaaactccccgtagcagaaattttgtcttatttactactaaatccccagtatctagtataatgtgatctatgatggatactaaagagatattataataaataattacccatttttacagaaaattatgttttttatcatcccgcatccatgcagccatgcctacatcctcttgcctcttcctcatgccttgcctcctggccagtggcctagcgctaccctgttgtcctaaagagtttctgctgctgctgccactaccaccaccaccacactgctatatgttgaggagtcctgtacactgtgccactgacaaggagtaactgacctttgtgcctgtgcaccagatctgtctgtggaggttctggcttccccagctgctgcctggaaatgcttaggtgctaatatcctgagaggaggattgtcaggtaaaatacaggactctcagttaaatttgaattgcagacaaacaataaattactttttattataagcatgggctttttaaaatttttctaaatctggcaaccctacttaaggagtgaactttgatcaaggaggtacagcacaaaatgaagctagtagataaattctcccttcctttcccccagataggctgttctaaagtgcaataattcataagaccttcatgaaaatatcctcaaagaccgagcaattaactgcacttgttgcaaagctatgacaagctcactaacacctgtgtttgtgttcccttctcctactgcctcacttccatgtttttcctcacttctgtttctcagagatagtactccccatagagtggcagcaggtgagtgttggtgttgtttgtttatggcaggcttggggaacctagactagtacagtacttttggtagtggattcttctaatgggaagtgaaacaagagacaaatgatgactttgagaaagtcaggcacgggaccctgcagactcaaaatccagatttgttgagacccctgagagtagaaaaacccctcaggggcagattcacattgatcaaatgtacagtcatacactgttaaatcaaaatagtaactcagcactactgtgtgaaatatcagtgtcctgtaggcgagaataccatttgtgccttgattaaacatactttattcttgaatctgctgtttataagaattgaagttataattcaaaagatactgggatctgttatgggctgaactgtgtttcctcaaaattgatacattgaaatcctaactcccacactacctcagaatgtatttggagataggatctttaaagaggtaaagtgaggtcatacagttgggccctaatccagtatgactggtgtcctcataagaagaggagattaggaatcaggcatgcacagagggaagaccacgtgaagtaaaagggagaagacggcatgccaaggagagatgcctcgagatgaaaccaatcctgccaacaccttagtcttcaacttctagcctccagaactgtaacaaaataaatttctgttgttaaagccacccagtctgtggtatttgttacagcagtcttcaaaaactaatacaaggttcatagaatcaaaacaagtcaatttagatatagaactcaaataattaatgtcattggaacaaacctgtctgattaatcttgctccacaacaaagacagttctatcctggggttattgcactataactacccaccatttaaacacaataaatagttgttctaaaatctcgggaacatttttttttcatataattattcccatgtcatggaactgaagctttgggtaaaagcgctttataaattcttcttttaattttttttactttcaatttgtttacttttccactaaacacgagtagttcctgcagcttcctacttaaaaatcacttgcagtttgggttattgttagtatacctttcattagaatggttgtcttcaggggtgactattcttttactttcgttttctgttccacgtgcttattcttcccaaatgtacattaatgattctgttggaaagaggtaattacttttgttttgtttttaggctttgtttctgtgctgtcaacctgaaaaagttttttaaaacagtgaagtataggctgggagcggtggctcacgcctgtgatcctagcactttgggaggccaaagtgggcagatcgtttgaacccaggagttcaagaccaacctgggcaatatggtgaaaccccatctctacaaaaaacaacaaaaattagccagacacggtggcacacacttgtagttccagctgctcgtgaggctaaggtgggaggtgggaggatcacctgagcccagggaggtcagggctgcagtgagcagagatcacgccactgcaccccagcctgggtgacagagtgagaccctgtctcaaaaaaaaaaaaaattaagtataataaattctggttttgtatgcatttcttctcttacagaatttccctaaagctaacctactaaaaactatgactagatttcatatgtgctataaacattctttatttaaaataaattactctaattcagaaaggaataacatttgcttgcacatttagaacatctggcattagagactataaaattcatatatagtctcaaatacttattagacatattcttaattcaagaatatataattattcatatgattagaaataattataattttactaaacattgctaattaggcagagtacaaacaagaaaaagtcagaaggaaaatagaaccacaatttgcaatatatttattttaaaacatttttagctttctttgttacttttaaaagtaaaacttgtaagtcaatatattattaaaactactagttaatctttaagtctacaggtgctactaagaaattgcaatttgtaacttaacagagatattaaattctgtagaattgttaccacattcaagcatttctattctgtaggtataactcatttcccatgtttctctgctatttatctttttgctgaaataatttactccttcagtagtcatttcaccctttcacccttctgtgtttttgtgtcataacagaagaatcactaaataatgattaaaattaagtcaacataccaaatataaagttaaagcttttatgaagcttaatctttgtgcacttaccaagaagaaaagtaaacccactattatttgggaacaaaggacttggaaaatccacgaatggaataattagtgaaaaccagttttatggatgctgttaaaactactccaaagcaataataatgacaacacacataaacatacacacacacacacacacactcacacacatgagcagtgcttctcaaattttgatgtgaggctgaggatcttgagagatcagaatctcagaatggagattctgagtcagtaggtccaccaggcggcaagagagtctccattcctaacagagtccctagtaatgccagtgcaagtagcccaaggaccccattttgagtagcaaggacctggagtatttaccttactttggataacttacaaaatgctttaatttggcttcaaatcaaaataaaaagtaatttataatccttgaaatcttttaatgaacattttttgagtgactagtatgatatggaccaggaagtcccaaagtatgttctccagaccaatagcatcaacattgtttgggaactggttaaaagcacatatccttgggcctcacccagacttactgaagcagagactctgcaggtagggcttgagattctgttttaactatttctccagacgattctgatacacattaggttttgaaaactactgctctagacagtatgctgagggtctggggtgcatatcaaagtgactctcaagaatctcagtacagtaggaaggggtccaattgctgaaccagttgataccattaagtatgtgatgagtacaaaaacggaatgacagacaaggttgcacccaacacagcaaaggatgtaaaggtttcctagaaaatgtcatgttaactgaatttcatagggattagccatctgaagacggtggcatgtacaacataatgcaaatgttatgcgggaggaaacctgctggcacctttcgaaaactgcagtaattcacccaagatggctggctgtggggtgtttgaagactcctctacccttgtccttctcacctgtccatgagtaaaacaaataccgttagagctagaaaaaaaaaattacaaagctgagtctattaacttgccaagcaagagaacttactccatgaagaatttcactgaggagggaaagtcaggggtttttaaatgttagaagtggggagcttatggggcttatgctaattaagcattggaaactggcactctggatatggggcagaatgaatatataggtctctacaccattggttaaataaaataaatatcccattgttcactagtcaggaaagtctcttcagttaggtccagtgaggaaggtgcctgtctaaggttactgaggcttaaagacccttatcagcttcagcctgtgctgttaaaatacaagagtcagttgatgtctcctaggcaagctctactttaagtggaaatttttcctttcccctccctcctcttcatctttcctgatcctgagatgctaggatgaccacacaaaggatatgcaaataatccaattgtcagctctctgccaccatcttggtttggggtgccattccacaggattccattgtattcatccaagtagtttcagtctcctttcgatgtggtttacttggactgtgtaacagcaatttaagtcatatgaataaaacacttaacatgctttgcactttccctaggtggaagcaaccttagacctactaaactgccctctagatgtaataaggcctaagaatggttctaaagatatctatcagtagctaggcagcagagtggtgcagcagaagcatgctgggcccataaagataccaatgagtagctgtagagatgaaagaaaaacaaaaagaatgtggaagcctaggcaagggggttgtaaaaagaggagaggggtcaacagtgtaaaatactacagactagtataacaggatgagaactgaaaaatgttaatagactttgaccccaagtgttggtgatctcacagtttcagagggctgaggatgagaaaagcggaagaatgactagaagtgtggaaacaggtgctagaaatgctcactactctcaacaaaacttggtctcttcggctaggatttacaatcaaatgctgccagtcctaatctagtgttaccatttttcttttagggccagaaatattcaacgtctgaggcagaaggaaccttcaaaatcacttatcaacctcattctagaaatgaggagagaagctctgagaagtgaagtaatatttattttcattgaatttatatgtaattttaaattcataaattctatggaagatacaaaaatgcacgtttaaatcttgaataatttttgaaagtttaaaaaacagattaaaagagttagagttttttaaattttcagttatggtgtttgagttattaaattatactgatgatcatcatgagaagctttccattatagtcttgacccttcttgtattattattcagtctacaatggataggcaacaacatgtcaactgaaaaatcataagatctataaatttagaaaggagactttgtttcttataatgagttacaacctgcaggctggccattctgcaggctgggaagcccaggctcccacagagacagtcaacaggcactttgaaggaggtggggttggagcagaagctttatgctgaatgagttggctaaacagacatattcaacagattgtaagaagagctgtgaatcttcactaagaggggtgctgaataaacatgcatgtgacatgcatcccatgctcactgtggagtggaaacttaacatttaaatgcattacagtccctatacatcaaaaggagaagcagagacatgaatgtactagtgctcagtctctgtaaacctgccagaaccagtccatagtgggtggtcttttatcaggggaaagttactgaatcggtcccttgtccaatcaaacctgcagttatgacttgtggaacaggagggtcttgttagtcaacatctggccatggatgagctgcaattatttcaatattgcttatgtcgagggcagttcttatttaacagctagagaaaaataaaaacattgcagcagttaaaacaaaggttattctttaagtgtaggtgtgagtgacttaactcttgcctggcatggccttaggtcttgcttataatttgttattgccacagagtccattctgttagccttctgatctccattttaacattaatgctggtcagttgttgagtctaagccctcaaagggagggggagccgagcttggtggcatgtgcacctgtactcccagctattcccgaggctgaagcgggaggatcgtttgagccagaggttggaggttgcagagctacgatcctgccactgcactccagcctgggggacacagtgagaccctgtctcaaaaaaccaggggtgagggggacgtgaaaagggaggaggtaggggggtatagcgaggcgtgtccgtccttccgtcccgtcagggcgaggaattcagcttttaaggtttatcgggggtcctcttggccaaaagggggtccgttcagtcggttgtggggcttaggatttaatttttagttctcaaacagtaataaagataatgataatcttgaccatacgggatgctgtgccaagcaccacttaacaaacactgtcatctcattcaatcctcacaacagtcctattttacagatgagaaaagtgagacttcaagggataactcgctctagattcaataaactgactcaaaagccttttaacattctgtacaataccttttatgtttgtttatttaactgtccagttgggccactaaagtacagataaaagctggggaatgtaagcgagactggtcacttccctggggtgagagaaacgctttcaacactatccgtccatcgtatcacgcctaacgtatcccatagacatccctcacccctccacccactcatgcctgtttgaagcaagactatgaagaccgaaacacaccgggagcctaaggcaccactccccgctacctaccgaggtgcatcctgcaggctccttaccgcaagcctgcaaactcgccctgccgggcgcggagtgcaattaggctttggggtggtttggctctccggctttccgtagcctctggccccgccccctagcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggtatgagcaggtgtctgtgctttcagaggtggagggggtgggagtgaagtctcgagacggggtccagacctgggggtggcaagggtggaactggggacaggagtgaagatgggggaagccgcgggatggagattccaagcgcagagctaatcctgatcccccaccccctgcgaactgcaccggttgcgaggggctggctgttgtcaaccatcctgtctggggaccagcgctgtgtggtcctcctggagggtcctagcaaactgagtaggcggggttttgccgcgcttcttcgaaaagtggtcatagagctacagggaggaaaggaatcattcttagcaaaatcttgatttgatgacctgatcagtttgaactgaactttttaatacgtagatccctgttaccgagtgatgttcttgatatagatgtaaattttcccatgcttaaatttgctgcgactaaagcctgcacccagaggggaggaaaacgctgttaaattagaaattaagcatttttaaaatatgaaattggaagctggttgttacacgttgggtcggagagaaccgggagagaatagagttgatttgttttattatgcttgtactgtatttggttttgggtttgcttttgttatgaatacaaaattcactcttggaagttgatctgttgagaaattccatttgaggcccttggatctctattcgaggcggaggtgtttagaaaccccaagttgtttgtttcctactaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtggtcagttgactggggaatagagttgagctctctgaggtctgacatttacgcagtaacctgcggagcaacagcattttgcatgaggagaaataggtgttaggggaatttgcctaatcgattttgtggacctattcccctctgggcggggagaattttgaggaacaatagctctccactccctgggctgcaagaaagatcaacaatacagccatactcccaggcaaggggcaaaactgaaaagtatgtgaatttgataactgatggctctcagtcttcctttacttgctccaagaaaaattgggcaacgttatacaaggcaagcaagcgtggatttttttttttttttagggaaaaatactttttaaaagccattgccaaaatagtccaaaacataccaaatgaaacaagtatacctgtgtatatgtgtgtgcattttctccccattttaattttctttcttttctttcattactactgctctttccagggcctaggattctcttccaagaagaaagcaatcaatttgcattaattcatgtttctgacttgttaattactaattctaagagtagtaacattttcgaagtactgaggaaaaaggtagtttctccccaaagaaatagaataggaactttttatagctgggagaaatcttagtgatcctcagccttcttgttttttgcctgtggttgtttttacaaatgagaaccctaagttcatgagaagttaactgagttactcagtttctttactcatagaatgggggtctagagaccctggaacgaaaaaatgataaccttttaggcctctgccttaggccagtttaggaaagatcctgggaactgtttccagttctttcaaaccactgcacatttgcaaacttctcttctgcctgtgtgtgcttctgagacagtatatcctagtggctaaaggtgagagtatcacaactacttcagttcattgtcagcttcatcacttaccagctatgtgaccaaagaccagtatcttaacctttctatcaaatggagataatgacagtactcatgtccattgtaaagattaaattaaataatatatataggccgggtgtggtggttcacacctgtaatcccagcactttgagaggctggggagggcagatcacgagttcaggagatcaagaccatcctggccaacatggtgaaaccccgtctctactaaaaatacaaaaattaggtgggcatggtgatgcacgcctgtagtccagctacttgggaggctgaggcaggagaatcacttgaacatgggaggcagaggttgaagtgagccaagattgtgccactgcactccagcctggcgacagagtgagcctccgtctcaaaaaaacaaaacaaaacaaaacaaaaagaaataatatataagcaaacttatacaataatatagagaacttatagagagacctatatatataattgaaaacaagcagttatcaacatcatcattgtcattgtcatcatcctttatccagggaactagagctcataaagttatttgggccttaaagctaagggattctctagaattctgattgttcccactggcttccaggatgtgagagtgagactggatgcccctgaaatcttacttgctttaatgcagatttcggtctgctcactttatcccttcagagatgtttctaagttgcagctggatttcctaatatagaaatgctactttggctacctgggcttttgatagctgttttatatcattttctttattacagacctaaattgaacctttcagttaccctaaccttagtttttagtaattaaagaaataggcttgaatattgctgcctaaggcagcaggtaaaatgtacgggttattttgctgatttttctgtgtgtatgctttacttctgcattaagtggtatttttttcctgcatctttcacaaaaataactttgtaaaaggcaatagcgcctataaattctatctaagctactacaaatgatattcacagagtattagatttttctaactttaataactttgaaatgttctctgatagaattatggaaaatgtaaatatagattatgagtaaagttattagtaaatagggaaaacaatagtttaggaatctgggattttgaattgttattttcattccatgttgtgaacttctcatagacatattctatgtaaacattatatcttcaaattttctctctataaaaattttgataatccctactgtagtgattccagcgtcttcttttttaaagtgattatcatacttttccagtttcgaaacaataaaatagtaccagaattttggtggccattttctaattgtgaggaacttaggacatgttgcttgccctttctgtgtctgtttcctcatctgtaaaagatatttttagaaatgcctacctcatcgaattattgtgagaattaaagtatttgtaaggcatttagcacagtgcccagcacatacattccaagtgccccataaatggtaactttctgctattattaatgactctagtcataacagctttattaaattattaaataaattcagatgatatttacagggttatatggtttggctttgtgtccccacccaaatctcatctcgaattgtaatccccaggtgttgagggagggacctggtgggaggtgattggatcatgggggtgatttcccccatgctgttctcatgatagtgagttctcacgagatctgatggttttataagaggttcttcctctttgctctctctctctctgtctttcctgccacctgtgaaggaggtctttgcttcccctttgccttccgccatgactgtttttcttgaggcctctctagccaggtggaactgtgagtcaattaaacctctttcctttataaattacccagtcttgggtgtgtcttcatagcagtgtgaaaacagactaatacactgggtatcaaaacctaccaaataggaagatagttctcagattgtttttctagtattaatcccagtgtttatgtggctctggcttcctacaggaaggtagaggtaatgtagtttaaagggtgctttatcccctggagagtgatgggattggcagtgaaattcaccttaatcatatgttgaaatcacaagatatctaatttatctattttctatttagttttgttcccctcattctaaagtatcccaaccccctttagagcagtgcttctcaaattttaatgtgcatatggagcacatggggatcttattaaaatgtggattctgattctgtaggtcttagatgaaccccagcactccgcttttctaacaggtttccaggtgatgcttgtgctgctagttggaggacctcatttcccactttgaataacaattaatataatgattagttgactggcgtaggtatcatgcctgaacttccttgctcaaatttgctctccctctgagaacccatgagaacttccacaatcttttagttgatatcatatcctgtcactgtcagtaatacttccatgaactgtgtgcttaaaattgtctagccttgtttatagggtttttgcaagaaataacctctgtagttggctgcatgtgtctatagtgccagctacttgagaggctgaagcaggaggatcgcttgagcctaggaattcaaagctagcctgggcaacatagggagacccccactctttaaagagaggagagagagagagagagagagagagagagagagagagagagagagagactccttggttgtccattgaggagtcaggcagagaactaaggaacaaagaaccagagtttctacattagacagacctgctggcccatttattattaatagctacgtggctttaacaagttaggtcccagggcctcagtttcattaagagggataatagtgctacctttacttggtagatttgaagactaattgagatcaaaaatgccagacacatgaaaggaccactataagtgttagtctctttccctgtaactgagtatcaaatgagcaggtttctccctctgaaatgtccctgggtaaagtgggaaataagttcatcctataatttgaatgaagtaagtctgattgtcttcaaagcaatttattaaacttttgatcttaaaaggttttgtgaatgcttttacaatttctccataaacatcttaagatgatagtattttggtatttacatatgtatgttctgttttgtttctattctctgcttgtgtgatctcatttacccaaaatcttcaattgtcacgttaagcctatgattcagaaacctctgccccaaatttttctcatctccaacccccaacacaaacctcttcctccagcattccctgtctcaggaaatggtgaaatcatttatgtaattcctcaagccagggaattgtcttcagctttttccttctttctcccactgcgtccagtaactcattaggtcttgatgaatctacctcttgatgtttttaattccatttgctgttgtctataccagttgctgctacctattcaaggcccaaagttacaatctacctccaacccagtcttctcccagtctacctccaaatcagtctcacacagcatacaagatgatcttttcataattaaattcttctggttaaatcttgtggaaataaatgaaggctaccacaataaacagagactgtttattcagcggttgctatagggagggattcagccactatcactttttggcagagactccaatgcagcctgggaagctttatagtggtaaaaagaaaggtgtgggggaggcttcaggtctactctaattgtaggttgctgacatgggaaagctagaggtggactagctggaagtagggtatcctctgtgattgacttggaaagcatatttggctttctctggttggtcttaagttggaagcagagggacaaaaaccgggaaagctggcagtcattggccaaatcctgacttttctgagccaattgcagcagaggttgttggccagagttattttgtcacatatagtctgaccagttttgtttatatgttcagtctcaaaccattcaatggctttttaagatccttgtgttacatacaaagccttctataaaatcccatgccagaccaatagctgcatgaggtgaggacattgttattccccacacctagcacaattcctgaaacaaaaaaaacctactaataaatagttatagaaggaggaaaagtctagggaaggtagagggagagagagaaatctttaaaaatctgccaagcaggtaaaactagagtaacatgaaatggataatgcaagataaatctaagaggaatctatgctttaatctttactactctctgttcttttaaaaattatacctgctcatttggagaaaaaatctgaaaatacacacaaatattagaaagaaaatcctgcaattggggtggcccaagtgcagtgctctttacagctaattgattacagctagttacggatttcttccttttccattcccactgcttcccttgattagccttaaaaaaaaaaatcctgcattgacatttcattccaatatccttgtctaaccttctaaacaaatatttcagaaaaccagaaaagaaaaacccactgtgtgtgtgtgtgtgtgtgtgtgtgtgtgtgtgtgcatgcgcgtataaaatctgagagtgtaggaggaaaagagaaaagacagctgaggtagtggtggatatcactgccaaatccccaaatcttaaaaggcagaagtctatttaccaaaattttttgtaacagtaaatttaactatttaacagtaatatttaacaatttttaatggtaacataagaccaggtatagattagtatttagtaaatcctttttaaaattattttaaaaagtaaaaatggctgggcatgttggctcatgcctgtaatttcaaaactttgggaggctgagactggcagattgcttgagcccaggcattccagaacagcctgggcaacatggcgacactctatctctacaaaaactacaaaaattagcaaagtatggggtggtgtgcctctgtagtcccagctgctcaggaggctgaggtggaaagattacctgagcctagggaggttgaggtaagcagtgagccgtgattgcaccactgcactccagcctgagcaacagagtaagactctatgtcaaaaataaataaaaataaatataattttgagtaaatgagctcattcagatacttactccacagacttaaagttagcatgtttcattacaaattgtttttgatgccatgacatctcagttaggattaatttctaaaaattgtttttgaaagaaatttcttgagatcagaatatatgaatttgtaatttttaaaggcaaggaaatactaaaactaagacaatgaataatgattatgtagaagtatggaaaagtatgtattgcagatttaaaactcagaagctgccatggtattaactaacactaagtgaaattgtgtaaaatacttatgcatgtaaggaaaaacaaaatatataaaaataaaaatagatgcatttactacatgataggaataagtaggattttttcgcttttgtttgtatcatcattacatcaccttttcaaacatttattttaaagtagaagtaagcgtgaaagcaggaaagaggatacaaaggaaactgggagagcttaactcctgtaatgggggtaagcactgtgacataaccctgaattaagataaaatgtcaggtagcaaggcattaacccccaagataaatatagtcaaaaccacacttagaatttgtagatccctgtatcatcataaatactttacctctgatcggattatttcatttttgttgttgttggggttgtttgttttgttttgttttgctatttgtatttgtttgtttgttttttgagacggagtctcactctgtcacccaggttggagtgcagtggtgtgatctcgaatcactgcaacctccacctcccgggttcaagcaattcttctgcctcagcctcccgagtagctgggattacaggtgcccgccatcacacctggctaatgttttgtatttttagtaaagacagagtttcatcatgtttgctaggctggtctcgaactcctaacctcagatgatccacccgcctcctcctctcaagcgctgggattataggcgtgagccatcacggccggccttgttttgctattgagttgtgttccttgtatattcttgttattaatcccttgtcagatggataggttgcaaatattttctcccattttttgggttgtctcttcactctgttaattgttttctttcctgtgggtacactttttagcttggtgtaatcccgtttgtctatttttgcttttgtggcctgcacttttgaggtcctacccaaaaaaacctgtgcccagactagtgtcctaaagtgtttccccaatgttttattccagtgacttcttagtttggggtcttatatttaagtctttaatccattttgatttgatttttttatttggtgagacataggagtctagtttcattcttctgcatatgtctgtccagttttcctgacaccatttattgaagagactgttctttccccactgtatgttcttggtacctttgtcaaaaatgatttggctgtgaatgcagggacttatttctgggttctctgttctgtttcattagcctatgtgtgtgtttttatgccagtaccatgctgtgttggttactatagttttgcagtatattttgaagtcaggtagtgtggtgcctccaggtcttttctttttgctcaggattgctttgggtgctcgcggtctactacttaaactttggatgatagtacccatttccttccccgtttacctatgaataactttattataatatagcctcttcttggttgcattttccaaatctttattaagcaactaacaatattatatgtcaggcccagtgttggatgccgggagtgcctgaaagcaaaaaaatttttgctcttgagagaactttggggcagggagtggtggggaacgaacatgtagaccctttcagaacaatgtgatgggaattttaatggatataaacttagggtgctatgagagcacggcatttttctagcctttttcatcctttgggaaggtaacacctgagcttcgtcttgaaggacctgtgggaattaaccaaggagaggaataggaatgtaacaacatgagtgacaacagaggagatgtgagaggcattaatggggagtcattgaatagtttagacgggtcatgttcagatttcagttttattgttctgatggtagaatagaggatggtgttgaagggtgcaagagtggagtcgacgagaacagcaggaaccccttgaaattaagtaagagctaaaaactgaataaatcagtaagatggaatggactcaagaaatatttaagatgtaaaatctgtagaacttggaggttcctgtttttttaatgtggatgactggaagaatgctggtactaactgagataaggggatacctagttgagaaaagcaatctcctacctatagtttagaagctactcttaccatgtatctgcataggcaaacttagtgtaatgtgtatacaagataattttatttctcaacttatggaagtactattattctaaatattttcttgggcccttcagggctgatgaaattttaaaacattaagattatacaaaatactagaattcaggaggggttttttactccaaaatctatttatt

SEQ ID NO: 88 - DNA, 48211 bp, Homo sapiens
aaggctacctatcacttgtagcaggaaaacaacttcaaaggagaacaaacgatatagtagaaatagttctgttcaatattagtcaatgttaatacatatcaataaatatgtttttctcactattaatgataaaatgacaatatttgtttcaatttgtctttaagcccagtttactttaccaagtgtctgcttgcctgcagttcatgctttttgaatgcaagatcatttataaagatgtatcctaaatcccaaatacaagggagacactacataaatatttttgaaaaaaagagtgaataagtgagccctttaaagtcggtcagttacaaaagagaattcaggtaaaaataatttactagcccctcacttttttaaagaaatagatatctaagttattttaacactatattgttaacatactatttacatgatatttgtaaaaaggaatatgcttgtgtttgtgttctaagttgcataacaaattactacaaacttagcagcatttaaaaaacaagtttattatctcagagtatccactggtcatctacagatgcatgataaatgagtcctcagctcaggtctaatagggctgcaatcaataccaccaccaagggctgcaatcttctctgaggcccagagtctttgtcccagattactggttgtaggcagaggttccttgctgtcgctgggctaaaatacctgctttcttgctgagtggcagctaggagctgttctcagcacctagagtccacttagcatttccagctctgtggtcctttccataacatggcagtttgcttcttcaaggccaacaagcaagcctttctccagttgctatgttgtagttagtcccatataatataattcaatcactattgtgactctcccataatgctgagcataaaacataatctaatcaagagagcaataccgaaccagagtcaagggttcctcttgcactcaccatgacaggattacacagggcatgtacattaggcgaatcttggagaacctctttgaattctgcctaccacggtgctcattactgggtctttttcttttgcttacctataaaggaagacgctggccttttcagaactgactcagaagccttaagaagacatatcccaaatctattttgctgcttctagaaatgatacattttcaattcccaaaataaaatttgctgcattgaagagtccaatttttactacaaatattttcacaaataagtgtcctttattttacgtatatatttcagtatttgtgagtgaagtttgtcactaatgaatttgtattcacatacttgaaagctaatctcattggttctcttaatttaaacttgtttgagggaaataaaatccaatatgctggctatacagtgcttgctgctaaatataattttctagcatatttaatagaacgtttcaaatagtcaaacctataaaacagtaaagagtaaaaagtctaataattagaaaagggtcctcttttttattaaaatgcaagtttaactaagacagttacatgtttactatagggctagattattttaaaaggtaactgttttgttagcattttatggtgtgggttatacaaggatgataattagaaataatctaagacacttttttttgccttctcctgtacttttaaaatcagaaaagggaagaacatgaaaattattaccttatcttgggtatgtctttttaaccatataatgatatcatgccaaggctgttatcagacatcgcataaccaggaaataaaaggacagaattaaacatgactactaaaaataaactttgtgagaattaaccttcagacaactgcaagtataaagtatagtaagtataaattagttctctgcaaagacaatgcattgagacttttttctatgtcagtttttacaaactggttttctagggagtactaaaaataaatatttgtcactaaaactaaataaacctaggctgaaaatgtgtatctatggttaccttaggagcaggcttgaataacttcatttttcttcattgtattatagactgaaacggcaaagaatgaccacagtttccattaacataatttcaaagtcaaaccttttgatgaaaaatgtatcctactgtttaaaagaaatttaggatacttttaatgcttcatcataatgatacaagagtgctgggaagggaagagtgtggtccctttaaatgatatgcaagcggggaaggaagtgctggggagcggagggtgtggtccctggctggggctccaccctcatgaacctaggtgaggacagtcactcctgccttagttgcttttcccgactgtcactccaaatgttgcttttcccgactgtcctggcccaccacgcccccatcctgggcttataaaaacccaagataccggcaaggcaaagacagaagctgctggctggagagaggaacacataggtgtaagaagacacaagcagctggtcatcaagagcacgctgacactctggcaggccatcgacctgccggacaaggcagagtttggccggagcagtgtgaggaaagccggggctgccgagtggcccaactccaggtgaaaatcatctcccttctgagtccctcattggaggagagttacttccactcaataaaacttcgcactaattctccaagaccatgtgtgatccgattcttctgctacaccaaggcgagaacctgggatacagaaagccctccatccttgcaacaaggtagagggtctaattgagctggttaacacaggctgcctatagacagcaaactaagagagcaccctgtaacacacatccactggggcttcaactgtaaacattcacccctagatcctgccatgggatcggagcctcacagcctgcctgtctgtatgctcccctagaggtttgagcagcagggcgctgaagaatccagccactccaccggatgagcccccagttgaaacgagaaagtttcccttgttccagtcacctgttggtacccatggccagcacctgccaaggtcgccaggactcagggataaggggtggagtgtgaaaggagggcactcactttctctttccttcacaccctgagtttttgctgaaagaaggaatggaatgagggacgcttctatttcctgtctttcagaatgggcaatcagttctcaccactgccagctcatactcctctggagtgtatcctgaaccactgggactgctttgaccctcagaatctggaggaaaaatgccttattgccctctgcacaaaggtttggccaagttacgatttacaggaagaactgtcttggcctcaggaaggaaccattcatttcgataccatctgtcaattggaacttttctgtagacatgaagacagatggtctgaggccccatgtgtacatgctttctataccttgcaaagccatctagacctttgctgacaatgtaggattgatccagccctcctgtttgccacctcaggaattccctgggcttgcatggggcaagcccaggaaattaaagatatgagtaccagaggcacccccaaaagaggagacagctctctctagctctgctcctccctctccgggtccaccctgacttccctatccagcttccgcctctcacttgctccctcctagaaatcctcactctagacaagtcccaatctcaggcttgcccctgcaacagatgcccagtgcatttgggcccagtaaggtccaggcccctttctccttacaggatttaaagcaaattaagggggatcatggcaagttttcagatgaccctgatagatatatagaggctgtccagaatttcactcgaatattcgaactctcctggagagaggttatgtgacttaaatcagaccctgacagacactgagaaacacgctgctctgcaagcagcagagagaattgcggatgagctttgcctcacatatagcatcagggaagggggtgaatactattcaactggaagagaagcagtaccagtgaatgaccctaaatgggatcccagtgatggggtggaagattagaagaggagtcactttcaggcatgcataatggaaggcttatgtagaactaggaccaagcctctcaattatactaggttgtccatgattgaccaggaatttgatgaaaatcccactgccttcctggaaagactaagaggggccttggtaaagcacacctctctatctcctgattcagtcgagggacaactaatcttaaaggataaatttattactcagacagccccaaacaccaggagaaagttgtagaaataggccctgggaccagatagtacattagaggacctcctgaaagtggctacctcagtcttttataatagagacaaggtggcctgggaaagagagaggagatacaggtattcccagggtgcacctgttaactgctaaacatatggcaagaatagttatctctcttctaaagtttaacctttcccaatacaaggtttaatttctttcaccagagtgaaacagctcaggtacaatgttgttggtattatattttacttcttgtctctgtaatctttggcactaaattctttccttgtaaaatacacgcttaatcatgcatacttaaccttataaaacttgttttttctctcacacctagaagccgtcaaaatgatacagttctaggaaaggaagagcatggtccctttaaataatacgaaaggcggggaagagaggtgctggggagaggagggcgtggtccctggctagggctccacccccaaaaacctatatgaggacagacactcctgcctctgcacccaaatgttgcatttcccaagatcactctggcccaccacgcccccagaccctagcaaggcagagacagaagctgctggccagtgagaggaacacgtaggcagaagaagacacaagcagctggtcttcaagagcacgctggccgaagagcacaccgacagatgctggcatgccggcaggccatcgaccggtgggacaaggctgagtctggctggggcagtaggaggagagccgggccatcgagcggcccaactccgggtgaaaaccatctcccttctgcctcccccatcagtggagagctacttccactgaataaaactttgcactcattttccaagcccacgtatgatctgattcttcgggtacatcaaggcaagaacccgggatacagaaagtcctctgtcattgcgacaaggtagagggtctaattgagctggttaacacaagccacctacagatggcaaactaagagagcatcctgtaacacatgcgcactggggcttcagaagctctaaacattcacccctataccagacactggattatacgctttacttatatcactgctttttttttcctctaaaaaagtcactgccatgaggttggagccccacaaactgcccatctttatgctcacttacaggtttgagcagcagggcactgaggaagttagccactcccccatcacgtgtcctgcgaggaggacaagggaacctttcccatttcaataatgtgcactatacattgatttggcactttttacttatacttatggtttatccagggcttcctacaaatgcaagaaaatggtataattttgtgtctcgatacaatgtttgtatatttactacagttgggggctacaatctaatctgaagcccagagtcttcttcccagattactggttggcagaggttccttgcttttgctgggctagaaagcctgctttcttgctgaatggcagtgtctaagatctcacaatacaccttgtgattcaatagaattcttccttctgcctttattgagcaatctttaagcaaagttaagcaggagtcataggaacaggaatatctagtaaatctatagtctttcagcctttctgcaatgtagcttcgaaataatgtgtcttgcatctcaatggaaaatgtagggatttgaaatttaaatgactttttcctataggaagaataaaattgattttaacaacatcaaatttaatgcagttcacacactcatgaattatttattaacacccctaaaacatgttttccataattaatttatcatttcatacatcaactaacaattattctgagccaggtatcagtgatagcattagctaccctaccatcagttgttcctgatggaaatgttcagacttcagtaaaccaggcagaaagtactgaaaagacagagaaaccttcaaagtagcatcacgctgtgcaaagtgtacattctctttcttttcagaaatgtcctagcaaggaaattttgtgaaccttaataccatggttcttgctcctttaccaatcactattcctaccttagtcgtattttcacagactttatgagtaagatgaatggagtcaggatgggcaagaatggtatgacatgagcaaggtggttcataggcagtaagtagtactttcaatgtgcagaaaactgagctgggagaacagtctgttcattatagccctgggagtccagtcatgacccatggacaaggaaaagttagatgattcagctacaacatccaagtgtagtggttaaaagagtctctgagaaacattagacataccaatccaaagtcttgttcatacagatttggtttcggaagtaagaagtgaaagtagggatttgcatttttaacaaacaagccaatgtctttcatgaccagatattcaggttttccaaactgtgtgactcagtatagaaatacaaagatcgttagcttcaatgacactcaggaattcaagaagaaggaaaaggtattttgaaagccatatataaagtttattttaacttttatgtagaaaatgtagaaataataattagaactcctaatgataaagatgacccattacaagacacctgaaaatgtttgactgtcgccaagtgtacctgtttcaataaatgaacatctgtactctatgttgtagtaactgaaataaggtttcaatattttcactttctggaattagactcccaacccgtctacaatattttacacatgtttagaaaacatagtatatatagaattaaaggactgaattaaggaaccaaaagttttctggtactgaactatttgaaggaacattgtttagaacctctgaaacatttctttaagcaatctcagtggtgaaaagtagtcacagaattttaacatagatttttttttataccagacactgtactatatgctttacttttatcactgctttttttttcctctaaaaaatactcttttggggagaagagcctgcatgccccaaggtttcctaagttagtcccaagtgaccagcaacactggtaaaatatcacatctgaaaaaaatctatgaccattccataacataatataatcatatatgaaatttaaaataccatttagattatttaatacctaaaccttaaaataagttaaaataagtttcagtaagatcaataatatttatattgtggctttccaatataaattgtttaccatcacaaacatcctggttcaccactccatatctccatagccataaagagtaatatttcacaaattcctctaatatttagaacaattccaatatgtcagtgtcattagtcccatttaatgcatgagaaaaataagtcttaaaaaacaagtcattttccaaagtcatatgcaaatagggcttataaaatctatgatttcaaccattgtccatttgaccttaaagcccatactattcccattaaacttcttgtcttatgaaaaaggagcttgatattagaaatagtaaaagataacacacaaagaaatgcataaatggtgaaagatttagttaaaaatactgttttaatatgttataactgtaaaagagcaagacttcatttactgcttaataatcagcaaatattatacctttagtggctacaatgtacccagcactctaataagaaccaagtgatagcagcaggggcagacaaatgcctaggaagacaggggcaggtcctcagtgaaacccaacctccaagtcaaaggcagtttaaagcctgaaagccaagctacaagtcaaatccatggaccagattgagaacttgtcttcccatttggtgcacttgcctctgattgatccccacccttcacctattttacatatgtctaccctttcctaattggttttctacactgccatgcctgcttttgagtgaagccttttctttagcctttctttgcatactcacaaaccaatcagcacacactcccttattctaagcccataaaagccctagactcagccacactgttgggagaaatctccccaggcgtggggaaccaccccagcatccttttctgctaagagctgttccatcactcaataaagtccttcgccactctcctcactcttcaattatcagtgtatcctcattcttcctggatgtgggacaagagcttggaacccaccaaatgtgagcacagagaagcctgtaacatcatggctgtctgccctctgccagtggagggcagctgccccacttgacagaaacagtggtagggctgaaccagccccaaagccaccagccaaggtggggcaaaggcattgccagctaggtgtctctggcaggcaaaaatgatcaagaaaagtcctgtgtcacaaggagagtaagatactgtttttaattcctaaagagtgagtaagtaacccaatgataatttttatgataaatgtccagtataaagtacagaatctatactctatatttgaaactaaacaaattagatgtatagtcaaagcctgcctccataagtgggtgaaattccttgcatatgtttttatggttatctagctgtgtcttaatttgactaaaaagttgtgaactattgtgacaacttattatgatatgtctccttttcctatatctataatcttgaactataatgtgactttgtacctcttctcattaaaagatggaattgtctttaatacaggtggctttacaacttgctttggccaagataacagtagcaaaattgaagcgggaacatacttgaaaattgctcctgtgttaagcttgccatctcactgcctggggaactctgatgtcatgtgaacaaccctagacaagccagctagcggataacacacaggagacacttcatctaccccaaccatcccagaccaaaatgttataaaccagccagccccacatattattaccctgtagatgataacagctgtgaaaggatgaggccaaataagaacaactgcccatctgaaacaaacccaaagtttttactcacaaagcatgagtgaaataactgattattgtgttaagccttaaattctggggtagatgtttacacaggactagataactgatacaactggaaaatagagagttccttcagcatccaagtattgaccataagagagaatgagaaacagcagctggaaagagggggggaaaatgatgatatttacatgtgaatgattgacagtagatggaagcagaaagttcagatatatcctgcctgataaattctattatctgcatgaaatgagaggttgggtcttctgagaatcaggtggtgagatagtgagatgcatgagagtaataaaagtttgaaatatatcttgagggaaagggaaacagagatgtcaagggactcttgaaaatgcttaatgtcctactgaattcagggaatctgaaattgttgggggatttgtcatagattaacatgagccattccctagaagttattacacttttgaagtcccagagaaagtaaaaaggaagacagctagcagaatctaggggtcttacttcagcaaatattatacccccaagcaattgaattcagtgaaaatctgagtccataatttggctcaaaaagagaaatctttaaaatgatttcctaaaccaaaaactaaactcctatcaatatccctgtgtacagccatcagatatcacccactggcaaacagggaagaattttgagaggaggttattagttgagactatttttgagatggttctgaattcttattacccaatagcttttatctatagtattctaagtaaaacagccagacctttaataacaaacacaatcactcccatataatattctaactgagattttggactagcattactgacatttaaatatacttatgtgattctatagctgagagtgagacatcaaactcatatgagcagagagtagaatggtgtttattagagactggaggtgggggaatgcggagatgttggccaaagggtacaaagttgcagttagatagaagaaatacgtgacaaatatttaaggtaatggatatgttaattagcttgattcaatcattccacactgtatacatacaacataacatcactgtgtaccccataattttttataattgtaatttgtcaaaaaataaaataataaaaaagaaactcccatccttaatatgaatattctaattcaatttcctgggaataaaaaggaaataatttttacaaatctctggctagtcaacctcaaggattaggtaatcactcttctcccacatgatcaaaacaaaatttcctaggtttcagacctccctttaattacaatgcaggatcaataaatatcattaacactataatgcatcatctattttcttcttattgactcttttcttttccttccttcctttcagtccttctttttatgaattttatttaatgcttccatgtgactaaaaataatcttttgccaaaagtttaaatgtaattagatagttttgttgccatattatgtccatcttagtcattctttaccacattattctattttgttcatgaaaatcaaattagtcgatatttttgttaaacagcatttttcatggtttaaaaactgtatcagtttgctattactgatagtagtagtccttactacgaaatattagttttagttagttatttttgtatttgttaatcatcttgcaagctaggacaagagcctgatgaaataaaagattatctgtcttactcattgctgtcacctacacctaaaagagtgcctagcatattttaaatgttcaataactaattgttggaaaaacaaatgtcactgtatacctcaaagtttcatggcaaaaataaatactgatgtgtagtaaattgtaaactaaaaaacctatttctaaaagatagaaaaaagttaacttctgagttcaattttgaacaaagcggaaaagtgtccatagcatatacatatttgtaattcatacactaatattgaatgtaattccacaaaagttttctaagagtattttgagcaataacaacatatttttttgagatggagtcttgctcttttgccgaggctgtagtgcagtggtgccacctcggatctctgctcactgtagtctccacttcctgggttcaagcaattcttctgcctgggtcttccaagtagctggaattacaggcatccagcaccatgtccggctgatttttgtattcataatagagaccaggtttctccatgttggccaagctggtctcaaactccgacctcaagtgatcctcccacctcagcctcccaaagtgttgggattacaggcgtgagccaacgcacccagcaacaacattcttgtaataaagataaagcctctaagtaggcacaattgaaagaaagcccacaattctattgtatatgtgttaattttctagttatagtgggacatcagtagtagttgataaattcataatgtatacctatttacagaatgtttatgatttctcaaatatttgtatgttttttgcatatgttacagaatttaatttttacaacagtcttccattttataatagctatatatgtatacacacacacacatttatatacatatgttgtttttcaagtatagcatttttttcaacttagggttgttttatttttttttacctattgtttcttatgccaaaaaagcttctcttccacatattctcatgatttgctccctcactttattcaagtcattgttcaaatatgacttcctcagagagcttttcttgattacccacctacaacatgtccaatgctatttcttacatgatatttcttgcaatgatttgttgtatgatatttcttgtatgatgcaatgagaatataatattaaatacctgaggagtgaaactatctttctcctgctcaactgtttccgcagcagctaaatcagtgatcaacaaagagtagatgctcaataaatattggttgaaatatggaataaaataagttagtgaaaagctgggacacagaaagctttggtttggacatagaaagtttggtttttgaatgctctctatcaactacttgatagaagagtctgtcttctaccaacctacgtgtatctatctatctgtactcacattcttacattttgcgattccaatggacttggtatttcctgaaccaaccgttctgctttgaatattacatacttcatctttctcgtagactttgctttggcagttatcaattatctctctggcatcttcatattgaaattcttccctcccttaatcattaccatcaatgacaatacattaccattattcaaacagtctctcacagaagtttaaaagtcttcaatgactcctcattctatttcagttatttagccatttatctgatttccttcaaagcaaaacttttcttcacagttcctcctaatacgaaatagaatccgattaattccactcaaatgtcagcctccagaaatgtgagaaataaatttctgttgtttttaagcccccaaatatatggtattttttacagcatcctgaaacaagacaacattttaaaaactgaaacactcaatgtaatataaggggaaaaacccaagaatgtaaattagggaattgaaccattgccaggctaaacacctcaagaaaaatctgaaagatgtagtttggattaaaccaattgaagacaggtttagaagatggatttatccttctcccttctggaaaaagaagtatcactgaagattaagaggtcaccttggaaggttaaaaaaaaaaaaagaaagaaagacaatgcaatccaataactatatcttactgggaattccaagtaatggaggctttacccagtgatgaagcatctgtggacctaccacttatacatatactcattctttgtcagcgataaggagcatgaaaaacagcgagactgtttctggttcatttaggaactatagccaaaagaaaaagaaatagaagaagagcacgattctctctgacagagctggcagcagcacacagccataccaattatcttgagcagaagccagattcaaatgaaagttatatagataaaaaaggtagcaccttaaaataccataagaaagaaaaaatgttaacaaagcatttcctctcaagattgccttctctatctataattgctctcaagttgatcaatgacaaaataatggtaatatatttgtgcttaccagccattcagtttaacttttcataagggatctatatagtgaatttcaccaaggcccagatagattcatccttttaaatgataaaaacaaatttttaaaaggatggaactttgaaaatattctttaatatgagaaaaactttaaatttgtgatgaaactggaaattttatttgaaagatatttattattagaggtagaacaacaatttaaaaggaacttttaaaacggggtcttttgtggacatgggacaattaaaaaatataaaattgtaaaagcaaatatcagaagataggagataggatagcagattgggttgataaggtaatagtctaaagcattccttgataagtcattatgagtaaggaggctaatattttggtggagaaagtttaatatagtcaaatataaaaggaacatcactgaaacattaaaaaatgaaaaatgtaggagagtgtaaaaaaatccctaagatagacaagaaaagaacaaagggattaatgtacaaaataatttaaaataaagatgataaaagataaaaaaaattttacttacagttaatttttcttatgagagagccaaacaaatattatgcatgcagtgaataagatagaataaaaagaaaaataagataaaggaaattttatctctcagtcaaaggtcagcacataaaattaaagaaaggggatattttataatgaaatactctattttaaaagcaaaaaaaatcatctaagtaaaattaaagcttactgcaaaggtacttgtcttactctagatgttgtaacaaaatatcataaacttggtaacttataaaatatatgaatctatttctcatgtttctaggggctgggaatccaagactaaggcagattcagtgtctgattagagtccactttctcacaaatggcaccttcttgctttgccttcacgtgatggaaggattaaactagcctgcttgggttcatgttattaggatcctagtcccagtcatgagggctctgctctcatgacctaatcatcacccaagtgccccacctcctaagggcatttagacaaaagataagtatttttttaaaaatacttttaatcaatacaaaagccaaatcagttgaacgtttattttaagataattattttaatatagttatcattttaatcattgtatttaattggtctccaaactgcaattacatcttatttagatgaagaaaacaataagaattaattttcatttttttttaattttggatgaagtgataaaaaaatttgtagttgcaaatactataacatctatttcaaagaaacagggacattaatgaactaaacattctcctcagtaagtaacaaatagaactcaaaacaaatcaagggtcatctgatggaattattgagaataataaagcaggaatctaaacacttaaaaagaaaatcaatgcaagttagtcaaaatagagttatttttaatgaaataatgaataacaaaatatgtccatttatgatgttctttatatttactattctatttctctggggttttttccattgattttttttctgtttcttcttaattattacaatataaagagttttatacatattgacttgatatatgaataaataacttataattatgtaaaatataatttatatttgtgtcatacatcttaatggattttttatttttaataggttttgagtgtctagctggctctttttttatttatacatagagatagtactgctgaaaatatagcaaagcaagcagcaggcattcaataaatgttagctaatagacttcttcatcatcatcgttatcaccatcttttgtcaatgagtaatccaatttggttcccaagaaattcctaatgaagggagaaactgtctgtatcatggttaaaataatgattttctagacagactgatatccatgtgccttatgagaatgtactgtgaaaatccacagaattgagataaatctggttgataatgaccattgtgggaacataaacccagggattgaatctcacgttaataggacagtagaatctaagaaatttgccaaattattaaatgtgaaagaggtggaggagaagtaggtaatattttgaactgggaagttggtaacactacattgctatgaatttaaataagaaagtagtaagatggagctaatttagtaggaattggaaaatgataaattaattttgaaatttttgaatttgaatttttcttcttaattaacctaggtaaatatactctcataatattgaaactctgagttttaaaaattgtaaaaaaattgtcagaataattataaatgcaatgacagaatgaggagtcctttgaggataaaagacagggcataaattatcatgcaagaatataaactttaaagtgatatgtttacatgagctttttgtcccctaagaaataaactgttctggcaaagacttcatagtccaacaatatggcatattcttaactattcgagaattatatcagagtataaaactttggcatgcctaaaagtatttggaaatgccatcagagcctgaaaatttggctagtcattggttactggaaactgtatcatagctaggaaatacggcctcctcctgtatatatagaaattaaatcagagcctaacaacttggcatatccaaaatgatcttggaatgttaccacagtagagtgatttggaacaactttaagtatctggaatgccatccctgtccaaaagcttgatattgcaccatactcatcactttcaaaatatgttctgtgataacatttataaatgcccttgacattttaagactccacaattctagataatttcatattttacataatctataaagatcacgattgcttagtttatccatcctactaggataattttgaaagtaaaaggagcactgtaatcctgggaaagtaggcgaaaattgggactgttatgggcaaattttttagtatgtggaatggatcttaatgtataggcataatattacgacacagtagcgaatgacagaaatccacctcacctttagagttactaatttaaacacaaaggagaaaaaaaagaaaaatgtcttggcttacaataccagccagtccacttccacccccatcaataaagagtttggggcagatagaggtagtactaatatatactacgaatttctatcctgggatgcaggatccacttgtgtttgcatgacaattacactcatgccagaaagcccatgaggttgaaaagtgcttccacatgctgatttggattcacatcctttgaccctacaaatctgagaggaaaaaaaaaaaaaaaagaggtattctccagatccaattatttctgtgaaagacttgtgggtgtgtgttattaatcatggctgggagggtagaatagatattttgaccctgtcttggttgcatgcctgttttttcagtaaaggtgcaaagtatattttagaagagtgcctgggaaggaagacttaaaaaaaacagctactaatgtcatttacttatttaaaagcaatatggcatagcatagataagcaggggtttttttctgatttgagagtaagtttttattcttccttttttaaaaaatatgtttgtttccacaggtttctggggaacaggtggtatttggctacacgcataagttctttagcggtgatttgtgagattttggtgcacccataacctgagcaatatatactgaacccagtctgtagtcttttatttctcacccccttcccaacctttccacctgagttgccaaaggccattgtgtcattcttaagcctttgcatcctcatagcttagctcccacttatgagtcacaacatatgatgtttggttttccatttctgagttacttcacttagaataatagtctccaatctcatccagattgctgtgaatgccattaatttatttcttttaatggctgagtagcattccattgtgtgtgtctgtgtgtgtgtatacatgtatatatatacatatatgaatacatagactgttttgtgcagcatggtcatgttgatgacattgattcttacaatctatgagcatgggaagtttttccatttgtttttatcatttatgatgcctttcataagtgttttatagttctccttttagagatctttcacatccttgcttaaatgtgttcctaggtattttaattttgttgcaattattataaatgaaattgagttattgatttgattctcatattcatcattgttggtatatagaaatgataatgaattttatacatggattttgtatcctgaaatgttacagaagtaatttaccaaatccaggaatgttttagaggaccatttagagtttttagaaataagatcatgtcgtcaataaacatagataagttgacttattttccaattagtgtgccctttatttctttctctttgattgctttagctatgacttccagtactatattgcataagagtgatgaacatgggcatctttaaattatctgacttcaaattacactgaaataatatgtacaacaaccccccaggacatgtgcttacctatgtatcaaacctttacttctacccccaaacctaaaataaaagttaaaaaattatactacaaggttatagtaacaaaaacagcatggtgctgggataaaaatagacacatggataaatgaaacaagataggaacatagaaataaagccacatactacaaccaactgatcttcaacaaagtcaacaaaaacatgcactggaaaataagatacactattcaataaatggtgctgggaaaattgtatagccatatgcagaaaaataaaactggaccaatatatcttaaccatatacaaaaattaactcaagataaaagttagataacctgaaattataaaattcctagaggaaaacataagagtaactcttctagatatagatctaggcaaagaaaatttataactaagtcttcaaaaacaatgcaacaaaaccaaaacagaaaaatgagatttaattaaactaaaaagcttctgcacagccaaataaatgattaagtaaaaaggcaagctgcaggatgggaaaaatgcttgcgaactattcatccaacaaagagctaatatacagaatctacaaggaactcaaataattcaacaaggaaaaatctaccctattaaaaagtgtgcaaatgacataagcagatagttttccaaagcatacatacagccaaaaaatcatgaaagaatgctcaacatcattaattatcaaagaaatacaaatcaaaaccacaatgataccgtctcatactggtgagactgggtattactaaaaagtcaaaaaacaacagatgtgaggatatggagaaaagggaatgcttatatactgcttgtgggaatataaactagtacaacccttatggaaaacagtatggagatttctcaaagaactaaaaaatgaactaccatttaatccagcaattccagtactgggtatatactcaaataaaaagaagcaattatatcaaaagatacctgcacttgtatgcttattgcaacacaattcacaatagctgtgtcatagaatcaaatcaacctaagtgtccatcaaccaatgagtggataaaaaaattttttaatgtggagatatatatatatatatatatacacacacatacatatatctatatatgtgtatatatatgtgtgtatatatacaccatgatataccactgagccataaaaaaggaataaaatcatgtcttctgcagcaacatggatggatctggaggccattatcttaagtgaaatgactcatatacagaaagtcaaacactgcatgttctcacttgtaagtgggaattaaacagtgggtatacatgaacatacagagtgtaataatggatactggagatactaaaaggcaagtaaatagagaggatgagggttgaataattacctgttggatacgatattcactattcaagtgatgagtacactcaaagcccagacttcaccactacacaatatatgaatgtaaaagtatgcacttgtgcccactaaatctgtgaaaataaaaaattaaagaaaataaaaattaaaaattataatatagttaattgttaaaaataaaagctattccaatctttttctcacttttttgttgttcaaaatatgacgatgtaaaatgtttgtttaaagattatttaattataatttttgtatttcttttaatcttttaacttttaaaatttgacataattgtgtatgaaaagagagttgtaaaatgctaggcagttccattaacccctcatctagagttttcattgaggtatcatgtttccttagtcttccttcaatctttgaaaatcccactgtctttagtttgcttgtatttgtttgtttgtttatgatattgccatctttataaagtattggccagttattttcttgaaagttgctccatttgcttttgtgttttttttgtttatgattaaatagagaatatgtattaatggaaaggatgccacagagggaatattcccttatcagaaagtacttactgtaacatgtattactggtaatacttttcttgatcacttagttaaggtgatatctgctagtaatctctatggaaaagtctttattttttcattagtaattgtaaatatgttagattttgtaagactatttccacttttccatttgtaattacaaaaacagtgaggaagattctttgactattcaaatattatatttctgactcaaatcctactgacaagttttactaccatttggtagatatagcctacaactattatttctgatatgacatttccaatagtaattttctatttctctcattcattctacatttactgattggaatctggctgtaatgaagaattgtctcttatgcctattgagttttttattctgttattagtttataaaaccatggactcacggatatctgtttgcttctttggattgaaatctgatgtcatgttatctatttagttgtttaaattgtttctactttgctttccccagcactacaattaacccgttctccacagagccctggtttgtttaattgaaaaatggcatttagaaactaatgtatgagtgtcatgattatagctattgcagtttcactgtttctggtcctttatagtggatagagtttgggaatatagagagagatacgtacgtaaacaaatacaagcttacacgtgaatattctttaatctacctatgttgtgtgtgtgttccaataaaacataaaagtcagcaagtcttataatgtgatgtgatgaaaatgcaatagcatatatatatatcctatatataataccatataatatatagtattataatatagatatactatctatagtattataatatatttagatatatatctctctatataatgctatactatatataccccaaatgcatataataccatatatttactatatataatactatacattttgaagacatatagtattatctatttattaatatatatttactacaatatagtatgtatatatctatacatagatacagatatacgtatatatctatacatagatacagatatacgtatatatctatacatagatacagatatacgtatatatctatacatagatacagatatatgtatatatatttacatagatacagatatatgtatatatatttacatagtatacatttagaagacagaaagatatagatacatatattatttgttctgtatatgtgtgtgtgtacatatatatcttatatatccatatctatacttatatttatagatgtatctattttatatctgcatacatagagggtatatatgtatttatatttacattttgtacttttatatgccaccttacaactataacacttccacatggaaaatgagaaattacagttgatcaattattggaataaaatcaatgtcttatattcaaagaatgttcagctaccacactttcattacatcccaagatttgctgaagtgttatatcaatctaattaaataataaagtcatataattattagttaaaatctttcttactcatgcagaaaattaaattcttactcatacttgctctttttgggtctatacatagtaaaaatatgtttgcaatacataaaaatatacatatctgccattgcctttgattttagcaattgctgcagattgttgtgattttgctgcaatgactagcatcaactgtgaagaaaggaatttttaagaacatatttaaaactgtaaaagctatattcttttaatacctcacttgaaagtttttcaaatatctgcaaccacacaaaaaagacaaaactgaaattgagaagaatctccatctaccgactctgatagataattgtatgattttcacatagtgaactttttataatttttgataaaaatacatagaacgggaaatacaatagtcctttcaggctacaatatacaggaatgacctcttttgtatttgttcaatgtcatatgttatttgaatttaaaatgttttggataagcttaatctggatatcaaataaatgaatataaatgtatgtgagctagcaccctgtctttatttataaaatctggctattttcaagctatattttatggttgtcactagtgtcaattacatgatctgcataataactactaattaaatgcacaagttggaagtttagtttaactccacagtattattacattacttttcaataatgacaccagtgttcttcacacacacacacacacacacacacacacacacacactccattaaaaacttactgtagagatacactatgtgtttaccaaactcaggaatccaaacactacttacttcatttaagacatacatgtagcataacttaatatattgaatttccccctcattaaattatttgtttcaagtggaagcaagcatctcaaagcctgccttcgaaggctcatttatcaagccagagtcatccctaataataaaatgaaaaataacataaaataaatggcagaccaatgtacctgaaaaagatacatacaaaaatcattaacagaagggtactacttcataaacaattgggatttgagaaatacagtgttgtttaaaattttttaaagacaaacaaataaagaaaaaggtaattcactattttaactgaagaaaattatataattacattatatcatgaaatttaaagtattcctttcttaaatatatgatagtattcaccagtgtaagcaaatgggcttgaaaattcatattttagaaagggctttatattaatttaaaatttaatgtatctaatatgtatgatgcatacttcattttgtatcttttcttttattagcatggttaaggtacttttcaagaaattggtgcatctcatttaatttatcaaatatattgacataaagttgttttataattagtatcttttatctttaacacctgtaaaatctaaaggattgtcccctctttcattcatgatattggtaatttatatttcctacatattatttcaaattaccttaaaaagattcaacagcctattaatcttttacctgctttgagttatgttaattttatctattatgtctttgttttctgtgggtttgcttcattcttacttttatcattttcttcattctatctgcttgaggtataattttctctcctttttctagcttctggaagtggaagtgagatcatttttgtacaattttttcttattttctttctctttctattctttgtcatcctttttcctcctctttttttccctttctctccttttccttcttcttcttcatttttaacgatcatttgccactatatatttttgtctaaaaaatcactttacctgcaagtctccaattttgatgtgttcttaatgcaattccattaaaaacatattctaattttctttgtcttttctgttttgacccattgattatttggtagagtattatttaacttagaaaaatgtcatgaatttctagatactttttattgattgctttttacctttatttctacacttgcctgcaaatgcaacatttaggtcatctttgattctgttgttacttcataatagtttacaaattttttacctgtcaatttttagttgtatggtcctcttagatgatatgttgtagtgttttaaggagtctgaattatgttttcttcacttaatgattgatgaaatttgttataattgtcaaataactggtagatcttcttgggcttttgtacagttttattttctttatataaagatttattttaaaaatgtttatttcgaccggttgcagtggctcacacctgtaatcccagcactttgggaggccggggcaggcagatcacgaggtcaagagatcgagaccatcctggccaacatggtgaaacactgtctctactaaaaatacaaaaattagctggtcctggtggtgtactcctagatttcatctactagggaggctgaggcaggagaatcgcttgaacccgggagacggaggttgcagtgagccgagattgtgccactacattccagcctggtgacagagtgagactctgtctcaaaaaaaaaaaaaaaaaaaaaaaaaaagtttatttcactatttcactttcacttttggtcttagttctggggcatgtcttttcatctagaatatattactaactcctaaattagtaaaatgaatgaccagagctcagtgggatatgtttcttctcgctaggctaggctgagattccaacacgcttcagccctgaataactttctatcaacattagcttctcagtcatgcaacaattagaatctactgggcctcagagagtctccccgtgcatgtgcagcctagtctcgtctgaagaaccataatgaacctccacaaaaattgttgatcacctgctctgctcagctcttttttctttaggaaactgatcctgaaatccaactttggaagaaacctgcttcctcaggctactgcgagctgaaagttctgcttatctttatctcactgtgctatgaaaggagatttttctcagacagaaggcagagaaaatgtagatttctttatatatttacccttttcaaggatgagggtcttgcattgtttatcatacagtacatgcaaatagttgttacatatatttgtcaaatgttgtaagtataacatcaggagggttattctgtactaattagtcaatcacgtttgaaaacatcaattagtaattacttttcattagcatttattacacatgtatcagtcttatgatattgtatatgtgctttaggatagactaaattttaaaaagtgattcaatttaagaaagttactaattaaaagagagcacaaggtgatatgtagccatgtcaaaatatataaataagatgggtggatgattaatgtttcagaaatcttagtaacttgattaagaacattgactcagaattttcagtcccacattaataaatttgatcccatctccacagcacatgagctgctttgtttgtttgcttgtctcaattacccaataactccaaatctcagttaccaatgggtaaacacgactaatactattaatgtattaatactattagtgactattaatagcaaatagtcaatatctaatacatgcaattagaactaaaaaagatacagtagaaggacaacgtatgccactttgtcttcaagaatttgtgcattctgggttgaaagagggagagaaagaaagggggataaggagagagagagagagaagtttcaccttaaggtattctactcaaaaagcatcataccagcaagagggaggatggggtgagttctacaatgtagaagtacacaccagcaccctgggtttgtatctaactcattccggttatctacagctgcataactctaacgaatcactacaaatcttagtggctaaaaaccaattacaatcattttagttcctattatggttcctatgggtcaagaatttggaagaactcggcttgatgattttggctcagggtctctcatgtaggtgccatctggcagtggctcaactagacttggttaatattctggtctccaatccagtgtattactaacatacaaacaaggacagcattaattatatgtagtcacctgatgtcctgacttagaatttgactgcattagaagatattctctaatgtatacatgtggttttaataagtctgttacacatactaagaatttttcataaatttgtaactagtatatttaccattggactttttaaaaatttatagattaaagtggaaaaaattcaattgtctttaaagatctttttagaaaagtaaaaaatcaacactttggaagtttagaaaattgatactttgtgagaccagcatgcattttttagataatctcagaattcacttggttattggtaagtcagcacagctggtacccatgatctttccaacaagagtatgtatgcttaacaagaaaatgtatccttaaatatggattttataactcagtgagtaaatttttaaaatgcagaaaatctgtaaataaagcctattcagaagtctccaaaggccagctatgtagtacctgctaacactataaaaaaatatactttgggtaagggcaaagcttaatatatcaaggtaaaattttgcttaaatgaagtaagtagtgcttatattcctgggtttgctaaaaacattgtgcttctctataataaaatgttaataaaatttatatatgtgtgtatgcatgtgtaaaaatatatgtgtgtatatgtgcccatgtgcatgttcatgcataaaactgcttgaagatgttaattatgagctgcatcccatagataatagcaagcagttccagtagttgcaattaattcctctagaagcttttaaaagagcatgacaataggtgattataagtctatcttttcgtgccccactaactattattgagatctcatgcctattggatgtctatagaatttgtaccatatactttattatcaactttttaaagcaacactttgacaaggatatgtaggtctctgtattagttagggttctcctgagaaacaggactaactgaagatattaatatttttatgtctatataaaatgttttatttttcatctataaaagtatttattatttttgtatttatataaaatatttataatgggcaattagttcacaggatcagagaggctgagaagtcttactatctgccagctgaaaattgtggacctaagatattcagagagatcagtctgagtctgaaggctggagaaccagggtagccaatcccgtagtctcagtctgagagcatgcaaaggccagtgctcagctctcattcaggctggaggagtgaatggtctctccttttatcttttgttctattcaagccctcaacagatttgataatactcatctacattggtgagggtaatctgctttactgagtccactcattcaaacattcatttcttccagaaacatacagataaacatatccaggaataatgtgttctctggcaccacatgtctcaatcaagtggacaaataaaattaggaattatagtctccaaattaaatatcaaaactttataatgaatatcaaaacatggtttgaaatgcagaatgagagctatttaacattacttggaatggaaaaagatgcaactctttaaagcacaaataacatggtaaagtatccatatttaatttacaaactagtgtcaagaggcaaaaaatttaaaacattatttcttgtcacagatatttaatatgtttgtgaataagcagatgctttgtaggcaataacgtcttctgtgataacagcgagggaatgtgtttgttgatattcacacatttaaaaatgtctgctagtgattctgcctaacaattacttttataatgtaactttaatcttctttcctttagtgttgtattaaaatattgcacaatatgttgaggtgtaagtcatttccttacatatattttaatgtgagacatattgattaatgaagtatgtatatgatagtgtttccattttgcagatgaagaagctggacattttgtcaatgtaagattgggtaagcaccagtcaatgttgcaaagaattggtggttagagaagaggactactgacatctttcaagtttctctgacttgctaagagagagacagagagagggagagtttttgttgtttcagtatctttgttcttattttatgatcttaggctagcctcttgtaatttgcatcattttatatttcacctttgataagattagttaacgtaaaagattagttaatatgaagttttccttgctgacaagttagatttttaagattataaagctaagcaagatggcaaatctaccaaagtaagtgccacatttaccaaggcctttgtctgtaaaatatcagctgaaacaaagttcatttgaaagaaaacaaaaataataggtacttgtgaataaatcttatttggatgtaaggctttgggagatgcaacgttaagatgaggtcatactgaactaaggtggactctaaattcaaaatgactgaggtctttaaaagaagacacagagacacagtcacatgcacagagaagtgtgctacatgaagaggaggcagaaacagaaatgatgcagcttcaagtcaaggaatgccaaggactgctgacaaccacgagaagctagaaagaggcaaagaagggtgcttctctagaactctcagagagaatgtggccctgccaaaaccttgagtttggacttctgaccttcagaactgagagaataaatttccattgttttaagccacccagtttgtggtactttgtcaaagcagcctgaggaaacgaatacatactgtaaataatagttatatttatccagaaataattactacttttgattatcatttattgactcaaaacagactctccaacatagaaccactttgtaatcaacacagttgcattctttcacatttgttctaggtagaatttcttagtggtaaaatgtcggtttacgtttgtctaaaatgtctttatttatttgaatttcaagaaagcacctcaacaaatatttgttgaatagttgagtaaataatagagttaaataacaaactttaaaaaatcatactgatccttttaaaggtctttcaattttaaggccgggtgcggtggcccacgcctgtaatcccagcactttgggaggcataggcagatgcatcacaaggtaaagagatcgagaccatctggccaacatggtgaaaccccatctctactaaaaatacaaaaattaactgggcgtggtggtgtgtgcctataggcccagctactcgggaggctgaggcaggagaattgctggaacccgggaggtggaggtcgcagtgagccgagattgtgccattgcactctagtctggcaacagagcaagactctgtctcaaaaaacaaaaaacaaaaacaaaaacaaaccaaaaaaaaaaaaggtctttcaattttgaattgtcctaaaaaaattagttttaaaatgctatgactatagtagcccagcagccagcacatttttacattcttaactaaattttatgttttgcctatttattttattataagccatattgtaaaattttatgtgcttataaaaactctttataacctaacaggtaaagtgaagccatatgtgaggtgcaaatgaccttatcaaataattagttacttcatacttactgtaatttacaaagaatttcttcagtaattttatatttattcaaacctacagacccacatgccttgctaaactcattgataagattgctttttaatagtgttaagaaagagtaactaatttggccaggtttcttcctttctggctacagttctttgcttattgaatgagtattgatcaacagaggcaccagggcaaaacttaaccttttgaaatttggaaatttttctcttccaaaagtactaagggagagaaagtaaaaagtctttccctccaagcaactgtagtgtcgaggtggaacagtctggaagtcttgaacattgagcagccagggcaggtgttttgtttatataaacactattctttttggaatggctcctagaaagaaactcacaggccattactacatctgtcgatcagttcattccataagccaagagtgtgaaaatccagatcaaagttaagacttgcaatcaatcatgaaattgtaacactttttttaatgcctgagaaaagttcacatacttacttgattcagttgtggttaataaattatgttttattttgaatagtcttggaaaaagtagttccaaaataattaacttcaaattaaactaaaaacttttttttatttcttgtcacataaaacaccaaagaacaaactttttggttcataaagctcaagaaaattttaactggtggtggccatgtgtaatgaaaattcatgaaccaaaaacaactttaaattaaacaaattttaataatttgagtttaaacaataaaagtcaaattaacatattaaaggtacatgaaataagatgatactgtcattacatttctaaaacagcaaacattacctcctgcataattggctatattttatacaatatgtaataataagtaatcagctatcttcttataactggcagtattaattttagacaaaagtttaattaatataaggtacctctaaatacagtttcctatgaccttatgtctaaggttgaatagatacatttacaaaattataaccacttaatcatattaaataaaataaaaggtgccaagcatgatggctctctcatgtactcccagcactttgggaggctgaaacaggaggatctcttgagccaaggagttcaaagttgtagtcagctatgattgtgccactgcactccagcctggacattagagagagaccctgtctcaaaacaaaacaaaacaaaataataataatattaaaggtgcttagttttattaaaataatgacgtaaaactgtcagttgtcaacagcacttataaatcctagtgttctggaaaatattagttaaaaatttctatgtgagatattttaatgttctttcgtataactgaaatttcttctactttaatatttttctcaaaaagtgagcatattttactataagcattgtatttaaccaaatttttacattcttaaacccaacactttaatgcatattcagttgttcagtaaacacaaactttgagctgcctacatggaattgaccaaaaatgatcacaatgtagctaggtgggcatgctaataaatcatgataatttgtgatgggttataaaagtatatatattcaaatttctttaggattacagaggagagacacttcatttcattaagtgcatagtgtatggcatgatgaagatgagaaacgacaaatagaaatttgatagtaaaacttgaagtttgattgagtaactccagagaatagttgacattcattttgattatgagtcaacaatataatatgaacatgaatttaagcaatgtttatgataaataatatcttgaaaaattacactaataatgctattctgaagacaaatctacacctgaaaaataatattttcttctgggccctatatttgaagagagaatgtacaatctgaactttattcatggcaatcagtcataattattaataatttgttactaaggcaaatgtagtaagttcttgttattttagattttcatcgttattctggatgacaatagaattttgttttgttctgttcatcctcataatgcaccatactcttccatctgtaccttcctcttataatcatcatagcagatatctagttttctcccctaatattagaagttcaaagcagagtcttcgcattcttagtagtttcattcgtatatctcgagttacaaggaaaaccttcttgaattctaatgctaaggttaagacattatgccattaattcacttatattttacttgatagtggaagacctatattcttttgcaaggtaacaactagcagttcattttactattactcttgttattatcgtcttttgtagcagcagacacagcatcatcatcttcatcatcatcatcatcatcatcctcactgttaccaacattattaagaggtctgggatagttgtatacaaaaatcttgtgtcaggattttcactatgccttgatgattctattggcttacctgtatttttcccttttgataaaagttctcttaaattgtttttttctgttattttttgccagatagacattcttgtgttactcattttcaaatttgtattactaattttttatttactgaagatcagatgcctgatggaacagcagttaaagcaatttttaattaaacatttatttattaacagagtagctgatattatcatgggcactgaaataaatatatatatgtatatatatacacacacataagtatatatatatgctgttgcatgtattacctcattgaattcttatcaatattaatgatatagtcctcctgttgaatatgatgtacatttttatataaaaaatttgaggcaggaaaaggttaagtaattttctcatactcactcatcaggtggtgatatgtccagacttgaactgtactttggtctaacgctaatacaggattcttatctacccagctctactcttatttattatgcatgattattacttgttcattttttttgtctgtctgatttgtaatttttcatgtttctgtatgcctatgattgttcttccatgacaatccaaaaaaatgtaaattctcaaaacaaattccaaaggaatcagaagccaaacaatttgatggtgttattttgctcatatattaatcaagcaaggaaatttatcacagaaaataattaccaaaaatgaggaagtggaccaaaaggaaaagaaaacaataaaagcaagtggcaaagaaaaatagtgaaaaaagggaatgttagtgcatatgtctgttagttccacaattggatagagtcttcattagcaagacaacagatttcagtctacgcagtccttcaattgttatctccttgaataagcttaaaacacctgtcatcccaaatttaagttcccaattatttgagaaataagctctgttaagtcctttcttaaaggtaaaggtgcaatgtatttctttgggaaaaaaaaagtgccatttaaaaacgatattttctagtctttagttaaaaatgcccagtatagacttgtttgcattcttacctttaaacattgactatatatttgatcttattaaattccacctgtagctttctttctacatttttgtttcacttgaattatttttatattgagttgctatagtttggtttgtgtgaccccttcaaatgtcatgttataattacatctccagtgttgaaggtggggtttaatggaagatgcttgcgtcatgggactagatctgtaatgaacaagttaatgttctccctgggagggggtgatcaatgagctctcactcattagttttccgtagagctagttgttaaaaggagcctggcacctcccctctctcttgcttcctctcttgcggtgtgatctctacacactggctccccttcctcttccgcagtgaatggaagtagcctgcagccctcaccagaagcagatgcttctaccctgtttcacacacagcctgcaaaaccatgagctaaataaacccattctctgtctaaatcacccagcctcgggtattcctttacagcaactcaaaacagactaagttcttatatcagtgtttagaatatgtaaacactgcagttcttatagcagtgtttagaatatgtaaaaaatatcagtagaacatcaaaatgagtaatctacaactttaattcctacccaaattttcagggttcaaaaaggaatgggccacgcatggtggttcataccaacaatcccagcattttggaaggctgaggagggagaattgtttgagaccagcagttccggaccagcctggtaacgtagcaagaccacgaccacgtcttgttgaaatgaaaacaaagaagaatgttagtgcatatgtctcttagtgttcaaaaatataatttatacataacaaatttcaaaattaattcaatttgtatattttaataataatgatagatataatttatttatacatatttttgtgtttttttctcagacgaattattacactgagatgactagataatccagctaaagaggaagcttgtatttcaatgacttcatcagttgtgtggttaatttgattgtactttattgtataaggaattattacaaaaatttttacatgtacaacacaatattgttataacagatactcaaatatttaaaatttagttaagcttaacattatctcactattatctttgccatttatatttgcttgcaatattgaaataccccagatttgttattagattttgaaaagtgagagtatgaaaactgaaattgtatattttattcagtaagaataaaatgaaatatatattcatatacaagttaatgaggttctttatataaaatcacagtcctcacatgaatcatgtggtgagctgtggctacttgaaaagctctaaattttttctaaccaaactgttgcactgcagacatgtggttttgtagttagcatgaataaaatttgagttgttttgtttcaaaagctaaattcaattaaacaatgatttctttttaaagtgtgttaaatttgtcatatatttaaaatgtaaagtagaaaatatgggaattctctaaataagtatatgttgttaaaaatatatttgaatgatgatcaccttactttggcttaagataattgtggggtaggggttaattcaaatttaaaaatatcaaaaggcatggtttataatatttaagacagttaattttaataaataaggataacttttactttaaaagaccacaaaacctgaagactcttgagtaagaaaggacaacgaattgaggttttaaaagtttacatagtatattaaaagccacagacaatatatacttaaataaaaaactgaaaatatttttaaagaccagtgatcaccagactctcggaatttgaaagctacatcttttgttcagttgagttctaaccaggaaatcttgttattattttgctgttgatgcttcctaacaaatagcatgtggaaatcatctagcaatttgttaggaaatcttcctcctaagactatgctttttagtttatcgactccaaagctattatgaaagacatttttccagtattaaaattcctatgatcgatgcacaatccattttagagatgctttatttttccttcctgttttcctccttacccttcttttatcttattttcttcacattgcctgagagaataaaatggtccttaacgttgactaagccccacattatgtaaatggtaatgctctcttgggcccagagaattgtagagctcttgttatatttgctagttcaggatattttaaaatttgctttagcttcattggattacaccttaatttgacatatatgaaataaaatctctctctatatatatatatgtgacaaaatttattaataaatatgctacattattttaatcttgatttttaaaatgtttaattatacctaatattttaatgattatgcaaaattatttatctgacaaatgcttctgtttcaatagttttttagtgaattttgaaaataattcattcgtttcatttgtaaaatgagccaaacagaatgttgcataataaaatttgatctgttaccatacaattgaattaatatactactattagatgtgttaggtcataagtctaactttacaatgtgctaagtacttataatgcagtatggattttgatatctaataagaaagtataaaaaattgataattttactttggactttaaaaattataaacactaaagatttagcattaattacctttctttgatagtatatattttgtctcaatatcacaaaattaagatggtctttagattattttccccgctgaactttacttttatcatactaacaattttatcaaaaaatttaaaatattagttcaaattaaaagccaaaatttgagggcaaagggctttcattattaagcatataacagcacctcagtatctttctcagtgaaggctaataaaatcactctacttacaatccaactcttataaaaagtgaattacagtaattgtatgtctaaataatatacttagaaaaagtacaccttaactaattcttgttgccttggaaatataaaatactacagttcctttcctctatgttccattttttaaattttttaaactaatgctattattttactgattctttttcaaatcattcagtttttttttacttaaaaatataaaattggcctgttatataatattaaataaaatacttagtatttttgacacttttaatttatggtaaccattcacaacacaaattgataaggacaagtacatctttattcaaattagctctcaaaactgcttagtgagcaaacaggcatagtattcatctagatgctatagtaattaagtcagacaccagaggctggaacaatttcttttaatttgatatatcaaggaccaaatggatgaaccatggtaaaaaaaaaaaaaaaaaagacatttctgggtttataaatttgagttattcttttgacaggtaaataaattcctgtgattaaaatatttaataaactttaagcatgtctctaatatttggcctgggtctattcctggtgtctcccagaaacagaccattatctaaggccttgcatacaaattgtttattttggaaaatgatctcagggaactccaggaatggaggactaggaaatgataggtaaatggaaagagtcaatacaagtatgtatcaacctgttccacctgtgtgggcaactgggtctcaatccatttgggatcttttaagaagccatgtagaatgaagttcaaaataacccacctaaaatccagaagaggggagcatttttgagaggattctttatccatagattccttctcccattgatcaagagttgcctaatggggtagcaaacctttcacaattttgaatttgttcgtgctcagattcccagtgtttctcatgggtgtccaaccctaaggtgtcagggaagctcctggacagatgacaggtccatctgaggcaaagtgatctagtatttcagtggctaaatgccaattgccctagtaatgtttgaagtaaaagatgactaagaaaatataagacatttcttttggtttataagtttcagagaaatcagaagattcatgtttattagggaaatccacccattcgtatctttgtcacaggattcctccatctttcacacccaggtctcatattaagacatatgagacaagccagcactgtgcattttgcacttttattgttatttgcccttaaaattaaatcttgggccaaattttcagaaggtccaccactgcagatgcaggagaaaggcgtgtttctacatgttgacataggactacctcgattttcacagcattcttttaattgacaattcactagcttgatggtctcatgtttgtatagccttgagactctttaacaaaagccagtctactcacggtacttttaattatcagctgccccacatgtgtgttcaggtgccactgctcctgtataaaccagtgcttcagtttccacttgaacccctttccaagctgcagccagtgtgcattagtagctatgatgctacgacatgtgctttattttcttcttgcaacttaacccaatctaccaacagggaatatagtagtacagttgacccttgaacaacacggcttggaactgtgcaggtctacctatatgcagatttttttaaccaaatgcaattcaaaaataaaatattcataggatgggaaatcttcacacaaggagggctgacgttttgtacgtgcaagttgctcaggaccaactctaggtcttgaatatgtgcagatttgggtgtctttagggtttaattacacagtgaagtgttagcaaatacctgtggctgaaattgagaaatatgtggtacaacgtgtaggtagtacagtcaactcactcctgaaaaaagctgattgtcattgcaatggtcagagtgaacactaagctgaaaaaatataaagcagaacacagaagatgcccaatatatcatccattcttctctacattcttcaagtaagatgacattaagataagtattacaaatttttaggctcactttggtaactttaaagcgtttattcaaagggcagttttctcaacttagtgaatggccaaacgccctagattttgatactttccaaattgtgtaactttctaaagttatttcatgggccttaaactgagattaatataagaaaactgaaggatatgtatgcaggttacctacattacctgaatatataagtaatgtataaactgaagcactggtttatatagaagcagtggcacctgaacgcacatgtggggcaggtgataattaaaagtaccgtgagtgaactggcttttgttagagtctcaaggctatacaaacatgagacaatcaagctagtgagttgtcaattaaaagaatgctgtgaaaatcgaggtactcctatgtcagtatgtagaaacacccttttctcctgcatctgcagaggtggatcttctgaatatataggtaatgtaggtaacctgcatacgcaggtaaaatcagatagaattttaactattgaagtataatgttaacagaatatcatttaatcacaaataaaaccaagaatatttcccacaaggagagaccaaatgttatgtaaagacctaagtaactttaaccagtagttagaggaaatatttcatagaggaaagagaattagaagcttttcagtagataagagttgcaaggtgctttactaaaagcatctccctttattactcataaaagacctttttcttggaaatcattatctcccattatacttataaaatagagatctggatgtattacacaatgactggtgtaggcaagatttagcttccctgtaatatccattggttcctccaagtgattcaaggtagggctattccaagattgattcattaagcagatcaaagatatcatcaagaagccagatagacttattgttttcctctttttataactctacagtgttttttcaaaaatgtaataagcctgttttagttccagttattttattttttctattaaaagattcaacagaaaaataattcaggtgactttttccccataataaaattggaaacaaaacaaaacaaaaagacactttctccaaataccacagtagtatatttctggttacatttcattgactagaactgggtttcatgccaaaatctaatcaattacagaaaaaagcacgttttcacattccctcaatattaatctaaagaatgtggcattggttttggaacagagtattccatcaaagctgtaaggcccttgaggagaccattaattaaaacaggtagggctttcactggagtatacagaaaagtttaaagggccttgaggacattgtcagtagtagtgtattaaagaagaataagacaaatgttattgaaaactggtagtaaggagagttatgctatagtaccagaattatttgtggtaacacgcaaaatagaacatataccttagaagttgataatcttgctaaggtgatatctatgcagaaagttgagcctaccacctaaaagaagtttacaaaaaaatgattaaggagagaggtgcactaaagagtgaattactctgcatttgagtgaaatttggaggacatgtgaagggctctattatgtaccaaaggaagagaacagaaaactcagaaataaagccatactcttgaagtcttaaagccacactcttgaagtcttaacattttataatcccaccctggccttcatcttcacattaaggttctttcttactttgagaactctttgctggctgaaaggttattctaaccctgacacaccattaaatgttgggggctgggggaaagagagataattcatctttttagttcccaggtctactgaataagaagaatgatacagaaagaattgtaccaaaggagctcacgcccatctggatcttatttagaagatgatttctggacttcaggctgattcgtaatatgatgagatcttgaaggatatgggagaagagatgaatgtatattgcatgtgaggggaatataaattattttggccagagatcatggaggaaaatcatattttcaaaatatgggtgcaacaataggccctggcccacgtaatgttttataatgaatctttaccactgtgacattaatagggaagtttaattcccttgcacttgaatttggattggcctgtgatccacttgtaaccaacagaatgtgacagaaatgagggtgagtgtttttgaggctatgtcataaaaagcaatggaacgtccgcctggcttactaggacattaactttggaaccctgagctgtcattaaaaatgtcttacttcactgaagctactctgtcttgagaaaacccagatttgccctcacggaaagaccacatgaggatgcacagagaggtgattaacaaactctcctaacttcagaaaagttctaatccttgtaataaatatttattgtatatcacttatagtaattctacttctttgatcaaaatctgaccaataaaaaccattattcatcttctcatgaaacctcaaaaaattcagatatgtaaattgaacaatgtcttcataatttaaggctgtttccattcattatttattcattgaaaataaatactcctgatactcctgtgtgcctggtacttttatctgtgctggaaataaagccccggacttcatagagtttgcaatctatttctgaatgctggaaataatcaaacaaatatatatataatataagcccaggcactgaaaagtgcaataaagaagaccaaaacaataaagtaggttaagagaatagtaagttaggggcaatcgcagcactttgggaggccgaggcaggcggatcacgaggtcaggatatccagaccatcctggctaacacggtgaaaccccacctctactaaaaatacaaaaaaattagccgggcgtggtggcgggcgcctgtagtcccagctactcgggaggctgaggcaggagaatggcgtgaacccgggaggcggagcttgcagtgagcagagatcgcgccactacactccagcctgggcgacagagcaagactccatctcaaaaacaaacaaacaaaaaagttaggggctaatattttagagagtaactgagaagtcttctctgtggtatcatttgaagaaagtaaaacatataataacttaaatattgtggaggagctttccgagagaaaaaataaatccctgagttgtaagcatgcttagggtacgcagggattaacagggaaacaagagtaacttgaacattataaagtgagaataaaagccagagatgacagtaattgatgccagattccaccgggctatagattatggcaaaggttttgcatctccttaaaatctgacagaagtcattgaggtgttttctttatggtattgacatgaaacaatactgttccaaacaggaattgttgtcaggaaccagaggcaaagggtagaaaagcaaatagattatgtagaactattccaataatccaggaaactgtggaaggtggtttagaccaaagtaatggtcaaaaagtgagaagtggtcaaaatctggatatattgtttcattatagcatacatatatatgaagggtaagccagaaaaggcttatcaagtttaactccaaggtttttggccttgtgagaaacaaagaatgagtaatttttttaacttttattttaggttcagcaatacatgtgctggtttgtcatatatgtaaattacatgtcacagggatttggtgtacagattattttgccacacaggtaataagtgtagcacccaataggtagttttctgatcctccctctcctcccatcctccaccctccaggaggccccagtttctgttgttccctctttgtgtctatatgtactcactatttagctcccatttataagtgagaacatgcagtatttgatttttaatcttgcattagttgtcttaagataatggcctcctgctccatccatgttgctgcaaaggacataatcttatttattttatggctgtgtagtatgccatggtgtatatgtgccatattttcctcatccattctaccattgatgggcaattaggctgattccatgtctgtgctattgtgattagtgctgtggtggtcatatgcgtgcatgtgtctttatgatgaaacaatgtatattcttttggttatatacccagtaatgtgattgctgggtcaaatggtaattctgtttaagatctttgagaaatcttcaaactgcttgcataatggctggactaattgaaagagaatgagtaagtttaggaagagaggaattactgaatgatgtgaagtgagatgagaatattaataatgggggagttttcaggaagataaatcaagagtccagttttgaatatattatgcctgagatgtctactatacttccatgggaagatatcaagcaagcaattgaatatttatgcttggatttctggaatactttggctttggaaattttttaaaacctgaatttaaatttactgcacttgtatagtctatctaggaaattaagaatagacaggcaagaaaaaaaaaaaaaagagtctccaggactgagctctgcagtactcaagaactagaaattgaggaaaggaagcacatcggtcacggaaccctgaaagcacagcaagcgagaaaataagtattaggaaattttttcaaactagctgaataatgtgtttcaggtataaagggattatcaatagatcaacagaagtaatatcaataaacatacgaaaatattttcagaagagacatcggcacataaaatttttgaaacagattatactgaaaaaaattaacccaatgaataaaagataatgaaatggaataaagcacctgatactaaaatttgctattgatgcaattattggttaatactagtagtgattgagtcaaagtataagacaagatttttgaaagtgaacaactgagatatctatcagcaaccaaaggcatagtaattgatatatttttaatttgtcaacattatatttatcaacttgtccaaatttaatcaacagcagagaagataaactttagtggaatatttatagtttgatatacactaaagccaaatgctgagaagaaaaacatgtaaaatgccttttttttaaaaaaaagaaacttttattctttttgggaagaggttgaagagatgtgcagaagaaattttaaagaaagaagaagaggaaattgatagtttggcattttaattctctgtttttaatgatccattttaatgatgtctagcaaattttattatggtttatattcgtaagttatctcttcaaataagttacacacaattcagcacttctttactaattggatagtattattgataaaaagcgagaaaaatgtatttgaaaccatagccattaacaaagagttgatcatatgtgtattgttaatatacctttttaaacacttcagtataatttgttaaaacatgattaacatataattcaccaatttatattcatcagttttatatatttcagttttttaattcattaatctcttatttttaactttttagtgttgtgttaataaatgtgttggcagtggaaaaatattaatatttctaaactttttattatagcatacaattttgcatttgtgataaggacgtctattacagctctcaaaatatttacttttgaatgtcttgttcaaacagagtaatagtatgcactgtgtttgtatattatacaggttaacacatgttatattaactcaaaatcacagatatattttgagcagttgtgtctaaatcaaagagaaatcatactatactttacccataatgaggtttctattttagtagcagtgactataaaagtgactatttttactttctgaaaaaaatggaaataacttaaatattggaatattttatatagtaagtagttatataacaaacacggtaaaattagagaaaaatcattactcagttactactgtaaaaaagaaatttgcctcaattactttaattagtttttcacatgagaattatggctaacatgggatgtttggactatgtaggtagcacaggagatataggtcttaaaatacgcagtgccagatgctagactgtagaaaactcgtgcagtaatcaggtatgcagaattgcaagcaatgttttagctcttatcaatgcctagataaaatgagtgttctcacatgtcagaaatatgcttgacaatgcagtgcatacaagtttatatgcatcatactttctttttcccatatgaattgtgaagaatttatcagaaatcatgtatggaggcccataatacaagctgtaaacacgtctgtgtgaggtaaaaaaaatcaataaatccctcattatgagcatatatgacacatcagatcctaaagactctggtgtttctactcacagtaaaattgtctgaataaagaagtatttgggctgggcacggtggctcatgcctgtaatcccagcactttgggatgccaaggtgggcggatcacctgaggttgggagttccagaccagcttgaccaacatgatgaaaccccgtctctactaaaaatacaaaattaggtgggtgtggtggcgcatgcctgtaatcccagctactcaggaggctgaggcaggagaatcgcttgaacctgggaggcagaggttgtggtgagccgagatcgcaccactgcactccagcctaggcaacaagagtgaaaagagaaagagagaaagagagagagagagagagggagagaggaaggaaggaaggaaggaaggaaggaaggaaggaaggaaggaaggaaggaaggaaggaaggaaggaaggaaggaattccaaggataaaacttcaaatatttaccataattctttacacgttgcaaaataatctaattacaattaagttactcaacagactatttactttatttgaattgttactttgtttctcttattttcaaattaatatttcaaaccaagattaagttaatgttgagactaattaattggtcctgttcacattcatatatgataaaaagaatcctagtggaagccaaacaaaatgtaaaatgaaagaaataagactggcagaaactttaatgtcaaaaatcattacatttgcacagaaacctgtgaatttttggccaaagttcagaaaaaaaaaaacaacttttctaaatggtcaataatactaataagaatgaagaccaacccattagaaaaaaaaaaaaaaaaaccatcccccttactttttcctcaaaaacaatactacaaatttcttgacatataaagaagtgaagagtgagtacacagccaaaaatgtacagaaaaaatatattacagatttgtgttggtagttaattagtaaaaatactgtattcttttattctgaattggtaacgtttgtgccatgtgccacttcactgaagcagtctgtaatctgttgtagtatgttttgtcactttaaatgaatcaaacagaattttaattcatggatttatatcattaaatcatatgaacttcaaggcctcatgcacggaaggggcctgacatcatggaattaaagctcatcatcagttctgggtcctcattttacttgatctctcagcagcatttgctctgctgatgacacatttctcctggatatactctctccatttggctttgaggcacaatactctcatggttttcttccaaccatagtcataatacttttatttctgtatttagacccaattcttagagattttgtccagtcctaggactggatcaatatcatcaaaatgccgcacagttgttattttggaatacccaaaatttcattaccagccagacctctccatgatctccaggcttctatacaccacttcctactctacatttctatgtgggcacctactcgacatcacaaacataacatatctgaaactgaattcctgatcttttcaccaaaacccactccttttacagacatccagtctcaggtaatggcacctcctcacttgttcttcctgcccttgtctttgcatcatctgtgattttttgcagtctctctaaaatgtcaggcatacttcttcctcaaaataatggaatttgcactgcctgtgcttggaatattcttcctccaaatatagacgtgaattaaagccttatgattaaaatctttgctcattcaaatgctaccttctcaatggagtctaccttacctatttaaaatcgaaccttctatgtcaacagtacttaaacctttctcatgacttattttttctacctaacaagcaaattatagattatatttatgtattttgttatggtactttttgtgcatataaataaatatgtatatatttagaagtaatgaatatatctacatatatctcatccatatctatatacacacacataacatgtgtgtttctcttctcattagaagaaagtcaaaatttttgctttgattgttgtgttaattactgacttccctgtagagtaattccttataccttgtacacatgactccctaaataagtaagttttgaactgatgttgaatgcatttaaaatattcttcatatatttatttccctaaagtttgattttttcattatacatccttattctaaagatatgtcacttaacgttcaaaagatttcaaaaaaaggagccacttaacacatctataatgaatgaatcattgtaaataatgtattccaattattcacatggcgtgatgttgataaattctctaaaattatgcctacacaatttctttttaataaaactaaatagcagcagtagaaatatttttcaatcatataataacatgcaccatacaatttctctttgtatgccacatattaacaaatttatgaccgtatcatctgcagcaagataattacaactctggggtgctcagtatgtaactaagaagagtttcttgttatccctgaatgaaagaccatctaagagattgcgtaactagggctgatgcagtattacagatccaactcagacttatttcaatgattgtcatagaatacagttactggaacacaagagaaaatttataatagattttttccttatattatatacttataaaatagttattaagtacacttaccattatatccctgcttactttaacatctcaaataatatacccatctctctaggcaagatattctcaaggacaagtgtatttgatttgttttagttcatgaattaatttctccatttgaaaattattctaatgttttattccaaaatgttatttcctaatagtcacctttaaaatcattatttaattaacaaaaattttcttaatacttccttccagaaactattttttattcatctaaattttcaggttacttttcattaatgtcttatttttatcttctttttttagcagaaatgtaatataaatttttgttttgaaggcatactttatggaaaaatgccaaaaaagaaggaaacaggccgggcacagtgtctcacgcctgtaatcccagcactttgggaggcagaggcgggcagatcacgaggtcaagagataagagactatcctggccaacacggtgaaaccccgtctctactaaaaatacacaaattagccgggcgtggtggcacgtgcctgtactcccagctactcgggaggctgaggcaggagaatcacttgaacttgaacccgggaggcagaggttgcagtgagccaagatagcgccactgcactccagcctggcgacagagcaagactccatctcaaaaaaaaaaaaaaaaaaaaaaaaaaggccgggcgtggtggctcacgcctgtaatcccaacactttgggaggccaaggcgggtggatcacctgaggtcgggagttggagaccagcctgaccaacatggagaaaccccgtctctactaaaaatacaaatacagttagctgggtgtggcagctcatgcctgtaatcccagctacttgggaggctgaggcaggagaagcgtttgaacccgggaggcggaggttgcagtgagcagagatcgctccactgcatatcagcctgggtgacagagcaagacttcgtctcaaaaaaaagaaagaaagaaagaaagaaagaaaaagaaaaaagaaaaaaaagaatgaaacgcctaaagtggtatgatattgggagagaccaaaacataataaactttaactattacagatttttttcaataacatacattatctctgcttgtagtttgtccagttttgtaatgaagtttatcatatactaataaaattaatcaattttctttttttttctatttccagaactacttacata

SEQ ID NO: 89 - DNA, 80872 bp, Homo sapiens
agaacaggacaggcttatctaaacaataagggatagtgagttgattaggtgattggaaacaggcttcagctttgcaactgcacatcagtgggccttgtatgttcaaagcattccgcatctaaagaagcaaacgatgctttccatctgtgataacaaggaaatgctaaagttccaatttccttgacattttattgcatttacttttatctaaaatgagtatataacattatcttatataaaaggaaagcatggtagacgagacatatcttgaaaatcttctctctaccagacatccagaaatgctaaaaaaaaatatgtaacaaccccatttaaatgcataggcaagcttgccaaaactaagagaaatcaagaaaaaaacagagggaatcctaaatcagagtgataaactggcatttaaagtttagctgagttcagcatttgctaatctcagtaacctagagatctggcttttaagatctgttgcaagccaggaaacaaaatcaaaggctgtcctaatatgagccgggggctcttgaactgctataccttcagtgaaacagcagacagaaaaaaaacaagtcacctacaaaaattgatgacaggaacatgtctatttcagcataaaaccaggtctgtaatttaaatttaccctacctgtgtggtccaggagacccaagctaagaaaataacaaagcagtcttgtgttagagaagtgcctgggctgcctgacagagccagtgcaaatcctcttcaaagggacgtgcccttaaccccatccttagagaatttcacagatcaaacaatgtgaaagtacaaaagagctaatagactcatctcagtgcaaattaaacaactgtggagtgtctccttttttttttccgggaaaagaacactttcctatgttaatgttaccccaaatacactggtggaaacaataagatttgaatgaattccccagaatttagtcaggaaggacaagacaatccaccaagtgctcagaagaaaatagaaaccaagtaggaccactggttttttcaattacatgctggagatctgaaacctgagagcactgccgactttctggaagggccaagagaatggatttaaagcagctaccaaaagggaactaagaatgattgggagttagtgactaaactttatagcataacaggaccatgattataattaaagacatctttaaagcaaatcatctgaataaatgcacacagaattggtaactaactttaattgctactgaggtttattttatgctaacaatagtgttcaatgctcagtaatctcttcctaatttttgttgtcggtatattttgggttcacacaagtcagaaaccaaagttagattgtttctaattggcagcaaaccagaggggacgggagactggtcaagtctctgagtcgtccactccaagatgcggacaatgagtgtatgaagacagactgagaatgcgctgcaaagaagcttggaagaaaatgaaggcagagaggacagacctgaaaggctaagagggacagatcagcgtccatggaaagcaggagcagaagccagtcttcttccaaacactggcacaaaccactgcctactggatacatttcaccagacaattcaccccagtgtccaagagtttatcttgcttctagaatatattgaaaagagccaccctctgaacaaatggcaaacactatatagtataaataggatgcactgaaaatagtaggcttatttcttaagctgtcatcacgaacattaaccagtaattatatttctccactttttgtagaagacataaatggcaaattctgaatttataatttctaatacttcatttttctgctcttgtaaagttcattttgaactttcaacataaaaatattaaagatttttaattgtgcacatttgaacttgtgttactttggacttacattggctgaaattgaaatatagtaaaagtgctctagagtaagcagatcagttcatcagaaggacagcctttcaatggaaagggcattcccaagctgcaccaacgaaagcataatcctgttacctgccctaacctgacagctctgaattagtctgatccacctatgtgccgtacaaagcattatattgctatgatttcataaactgaacttgaactacactttttcagagaaacaaaaccatgtttagaaatctgccacaaatatctacacattgctcttgaattcctccaggaatttccacctactcgtgctgttactcttcactctatgatttatttgtttttcagtccctgtcgatacttaagttttactctgtagggagattctcatgtttgactccattaaacaagctttgaaactgacactcgcacagggtgttacttccagaatcttcctgccagctccttgcatccacaccatgagaaagagcaaacattccaaatcccaaaaaaatgaattatttggggtgaggaaaagtcttgactatgacactgaagatttcctgaagagatccagcatccaaaatgtcctgagtggggaggaaatcgcacacctagcacccagagaaaatgagtgctatccacaaacaacccagatcctcccaagctgaggctaacctgcccttcacttcctacattattgctacatctacgcagcttctgactttccaaagtttcctttccttttctagtcccaaacttatctctcaggtttgagaaattcaattttcttgggtttgaatctcaaaattataaaagacaagtaaggttaatcttctatctcattgggcccctaaatattttaagaaacactccatcaaccacattttgatcttctttactgctgttttattctagcatttctttactcctacctctctgtttctctctctctctctccccccaaaccccccaactcccccacccctccccacacacacacacaattggagtaaatccaggacaagggcattcacaatcttaccatattctgtattcattagaccttatcttaagcactgtgttcaattcagattttgaaggcatgttaacaaactgtagaacaacggagtccagaactgctgtagaggaccagttgaaggaactagagaggtataactagaaaagatacttttttagatccttcagttgttaaaagtccctagtaatctattacaaacagattgattttaatagttctcaaccatttgctaacatgtgtttgcagtgatgtcctatgtgtttgtactcagttctctgtcttttttaaaagggaattttactttagactatacattttctaaaactagaaaaattattttggagaaaaagatttgagtattactttgaagatttcatgaagctgctgcttccaatcatctgatcacttcagatggtctgataatgttagataaaacctctttatcagtaatgcactggagtcctacagcactactttccatattcaacaaaacctctctttgcatagatacgtgtgtgtaaaaacagaacattcatactgaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtaagtatgagattctataaaatagttgataaatacaagactattggcttgctataaatcactagcagatgctgatttcaatggtagaacttctgggagtgttaacagaggtttttctaagaaaaaaagacaaactaacaaacacatattcttttgcctggctttctatatttaaaacaaaacttagagtcactccttatataaataaatcttctaagttgggcaacagaggaaatgctacagttttaaagtatattatttcattttatgtttttgtgtatattttcattttaaatgtttttcattttatatgtttagataaaaacatattataaaatcagacatagctgaattatttgtttcaaaaatcatgcattaccaaattattagttccatcctttgttaactgtactgaagccaggtgtggattattataaggtttatctgaaacattgttaatcttgattttgtagaatttttttattcttttatgttatgcttaagcacaactatgcacaaatttcttgaattttttaaaggacaagaaatttgtgtgctgtggtcaacaaaagctcactaaaatataaattgctccaaattttactaaattttatgtaacatgctatatcataaaataaagaaacatatttaaatgcagatatatgtaaacagacagaattgctttaagaaaatttatttattttcataatactttaagatttcatttaaataatggaggaaacaaatctaattctggcatactactaatacaactcaatccattaccaatgcatttataatcactctgagaattagattctatcggtgaaatgtatttctttcaaataattatcaggagaaaacagtggaggcaaaatcatcgtggagacctaaacttgttctaaacactctatgtttcgattgtaaaagtacacactagttttaccaagagggtattgaaaaacaaaaaaggaaagcaaattaatacacaatattaagataaatatagattatttaaataaaaagtaatggaaaattacaaattaaaacagtaaagaaatttttataataagccatgatattaacacaattttagataaagagttaataaataaaaatgggaataaccataatccagcatttccgaggtggaaaaagtatttacttaaaacttaagagcatttacagtaatctttgccaaatatgcattctccaggaagcacacaataatctttttgtttttgtttggttttgttattattttatttttaggtcaatggaatgtttccacatattataccaccaacatgagaaaaaaatgatcattgtttatttgaagcttggtgagtttatccacaatttaaatcagttctacgtcatgccaatttagatcactgtttcactgggaattctctttttgccaaagtagatttgtagttctataaaatatttaaagttattttttatttttatccatattgactacttgaactctaattttaagggtacaactaaagatgcccttggttggatttaactaacaaaataaatttatcaataggatgttttaatcaaatccttatcctaaagaactttacttttgtaaaaaattagaacattccctttatggaattaccaaggatatttcttagaagttctcaattgtaaatgtgagaggatttcattctgccactctatattggtgctattaaactgtcgattgagatgtattatttaatgataaatattgttgaatgtaggattgtagatacttctttttaaaccaatggttattttgcaaattctttgtcctcagactgtgaattatattttcttattttatcagatgatattctaacgctgccttttctcttctcattttagaggtatgagaattttaatttctacttctgagcatctgccttccatcttccaaaattactttggaatattttgtcattatttttccccttggttaatctcctttttccttcagtttaagccgtacatgttcctttactataatattattagtgtttgggttggaagagataataaactcaggtggtcaatctgaccttttgtacctgaagctgggttaagtattttttaatttatctctttgtttcaatgtagagagtgttataaggatgggggtggggggttctgtgatattccaacaaaatagtggtacatggtacgtgtgaatccagtagtaatcaatagagagaaacacaaacatgtggatggactttcagtcccagaaatcttagaatacaggcgggaaggcaccaggctccaggcacaggagcagaactctagtcactggaacagcgtccagtctccagttccatttcctaaaggacaggaataccagagaacttcttatagtctatttattctatgcataacaactcttagggtctatttattctatgcataacacatgtcatacacaattctgtcactaaatattttctgcaatttaatcattgatgcttttatgacattatattctatttgtattccataatttaataaatctgtaaatgtttgacttagaatgctaaccaacatataaacaactacttatatgtaatcatcaaataacattcgaatgtaacaatttaggaaacttaaagtctagtaggagtagataaatcagaaatataaataacattatatctatatatattgcttctttttcaatgtcacctaactaataagttgcttggaccaaagaaccctcactgaatcagtcatgtagctgagcacagggctactattagtgtacacagagtctttgctggaattattaaaaagtagccttttcaccacatggatgaagccccacttggcttcacacctggcaaggggagtgtggttggatctcagccttgtctctccttttggaccaggcatctccatagagagaacaacctgaataattgcatttaaagggaagctgtggctgggctgtcctcttgtcccttttttctgtaacactcaaccatgcctgagctcttctggcagccccaaccatctgggtgatacacacacccagatgtctgtaaatctctgttgtagacccaactaattctaaagctgggactcagtgattaatataatgtgtgaacaatcgaaatatagaaacatgggaacaacaaaaatgaagagaaggaggatttgcagattatatgttgacatgttgaagaatgaataaagttaatggggaaaacttgtgagatctgagatgaaatttaaaaagaggaagaaatgcggtctaacagaatatatgtttcctggtacatacaaaagaacttaggaactatttcatttttctaatctttacagttccattttagagaaaaggaaaaggaaatgagaatctgaggtttaattaatatgcgcaaggtcacacagctaataagagcctgacctcgagcatatgtctgtctggcttcaggccccagaactatttgaatatactctgtcaacttgcaggagctgtgggaagcccctaaattctagtgcatccagaaattactttaccttcactatacttcagaccttagtgagtgttgcatactaagaccattctgcttttgccaatttcattaaatttataaaagaaaatatgataacccattaatagacacacatttgagttacagaaatcaccacaataaaaggtctgaaaatgtgtacacatagctccaatagatcaagtgagaagacagtgggacagaaaaactattgctaaaaatagagggtaggggagaagtcaagtctcagtacaagatagggaagactaataatattcacagagaagacatgtgaaggaagtaaattttttcctatcctcctacttagaagataagctgcgagtcattgtgtaactacattttataggtgatcacagagatgaggaatcttgaaactcgaactaagtagcttgaaatttgaactaatgcagttcaaggtccaattacacacaggaccagctattgacagtcaatgtaacagttttttagtctcaattaatttcagtgttcattttcagtcagatttttctttctagaaaaaggtttttattttcatcacactgctgtttaaagacctcagtggattacttctactaacaaaataaagtctaacatcttcagtctggtatttaaggtcatctagaacctaactatgcacacaaacatatccctttaataaactctcccttttgcttaagtattgtgaatctctatttgcaatcggaagagtcctaataagtgaattaatctattccccttccattttcttccttcctatagatataaataactttattgcttcttggtcctcctcacttatagtagagacttacatagaaaatgaagttgatcagaccacatttctcatatgttcttatctccaaacctgcaaatgaacttgaatctatacctatattttcactagttacaagagaatagtaactatttcctgtattttcacttctccaatgtcttaactcctacattctgaattctagcccctccttcttcttcaggaacctgaaattctattggttttccttctttcttctgtgttttcaaactctgtctatgtaccttttgccaactttagagtatgtcactcacattgtaacttgactttattgtaacgatgcctcctagagagacatgcaggccagaatcatcaaatgacaagaatctgtctctctgtcattattacgtctttctatcaacagctttcaaggaagaaagagaaaaagagagagaaagagagaaagaaggaaagatggaaggaaggaaagaaagaaagaggaaagaaagagagagaaagaaagaaaagaaagaaaaaaaagaaaaaaggaaagaaagaaagaaagagagaaagaaagaaagaaagaaagaaaagaaagaaaagaaagaaagaaagaaagaaagaaagaaagaaagaaagaaagaaagaaagaaaagaaagaaaggagggagggaggaaggaaggagagaaagaaagagagagagaggggaaaagggagggaggaagggaaagaggaaagcagggaggaaggaggagagggaaggagggcaaacagaaattacaagcaggctttcatttgtcctgggcctcattttctcttgctttcctccttgtttctgtcctccctgctccactgaaaccactctcagcaatgtcattaatgagcatcttgtgaacacatctgacattttttgatcctttgctctcttaatcacttcccagcttttaacactccattggccactctttcctttttgataaactcattccttggtttctgtgatactgtgttattctgatgcaagctccttttacacagcctttctcttaaatatttgtgttcagaaactcatattgggctgtctgctttttacagttcacaccgtcttcctggacgatctcgtcattttttttgttagagggggctcctcttatgtgttttatgaaaatagcccacctttatcctgaagccaaatctctcacctcaacttgttctcttctgtctcaccttacatatccaatgggtcaacaagttctaatagttcttcctccaaaacgtctacaatctctctccttccctccatctccactgccaccttcctaatcatccctcacctgaactcctgcagtcacaccctaactgggctccctgatgacactctggccacactgccattcattctactcacaaacccatttcaaatcttaacatgtctattctgaattttaaatcctgcaatgatttcccagcttcttactgtgaaatccatggcctgtgtggctcaacgtgctcggcctctgcctagcattacaaattctcccaccactttcttgctgcagtgaacatttttaaacatgattattggttcaatcttaactctctaagcctctcagctcactgtctcattctgtctgccacactctaaattcatgtggaacataattcctttttttttttttttttgagataaggtctttctttgtcacccagactggagtgcaatggtgtgatcacggcacactgcagcctcaaccccctgggctcaagtgatcctcccacctcagcctcctgagtatctgggactacaagtgcacaccactatgcccagctaattttttttttctttttgttggagagacagggtctctctatgctgcccaggttggtctcaaactcctgggctcaagagagcctcctgcctcagtcttgcaaagtgttgggattataggcctgagccacagtgctgagcctaaattccttttatttcctcaatgggacataactcattgcctcttaatctttgctcaagttgcccctccttcactcagcacactcgtggatatcctgctggttccagctcagatgttacttaactgggctgccttcactaacccctcaagtctagttaggttctcctcctaggtgtattcacaacccctgtacttcctgtatccaagtccccatcacatttcgggattttttgtttttgttttttgtttttgagatagggtctcactctgttgccccagctacagcacagtggtgcaattacagcttgctacagcctccatctcctgggctcaagtgattgtcccactacagcatcccaagtagttgggactacaggcatgagtcaacatgaccagctaattttttttattttttgtagagacagaatcttaccgtgttgcccaggctagtctagaactcctgggctcaagcaatcctccccgcttcagcctcccaaattgctgagattacaggtatcagccactgtgcccagcccatcacatgtattttaattgcttgtcagtgaggacagaagaggacagacaagatgtatattgatcacaggcagccagaacttggcacataacaagtattcaaaagacttttgaatgaatcgtaaagactgatataaaaattcactgtttatccttaataattcattatatatgtatgtatatatgtttaacaaaccatttccagctttaaaatgtggatttaatgactcttaacaaatttgttagttgtttttttaaagtcctgagttaaaaaccttctatgatatgtattgttatgtaaaggtgcctgagatgaataaactctaactgaattttaaagtcaaagttactgtgcccagagtagataaaaccagataagcagcacccttaaaattcactcagaaggtgctttattttttatttggctatttacactattttacttgtccagttaaaataaggctcttttttaatacattgagagagctttctaaacacaagaattgtggctgggcacagtggctcatgcctacagtcccagcagttcggaaagctgaggttggcaggttgtttgggcccaggagtttgagaccaacctgggcaatgtggtgaaaccccttctctaccaaaaatacacaaaaattagccagtcatggtggcgcatgcctgtagtcccagctactccagaggttgaggtgggagggtcacctaagactggggatgtcaaggctgcagtgagccatgatcatgccactgcactccaggctgggtgacagggtgagaccctgtctcaaaaaaataaaaataaaaataagaattgtcccaaaagggaagccttgggagttggtaaattcgttatcggtaagttctaaatgaaaagatctttttcagagatttggtattttttgaacctcattgtttaataaataggccagttgagtaaagtcatttacaaatctaagcacgtatatttttataaaatatttatgagagatgagtcattttattctcctctctcctcccaactcccccagtgactgtattccattaacttcaagagcccatctttttttttatgatttataatattgtatgttccttagaaactgactgtaacatacaattattttaaatgattaaattatacaaatatatactgtatttccttagaaaaatgagcaggcggaattgttggatttgtaagatgtgcagagatgaatctaagaggcccccttcaaagtaagtagcatttaagtttctatggtaattgtaaagcatatttatcagatgataaataggtacatatttattaaactgctattgtaacatattttgttcagaaagtaaaatttgcatttacacgtgagtcatttcatcagaagagcagtcatatgttactaagattcttgttttcattattcatggtttacacttgagaattcagcaagttaaatgctttagaatctattatgaatagtctctgttctttttaaaaaacaaagaatattgtttgtgttaaaatgagattcttcaatccaaaatattttcttggttccaaccctccacatacgaagtgccagaaagcttcatccctagataaagaaggtgagactggaggaggaatcaaatgttaaccaagctcccaagtctcttcctccacacttttctataactcaaaatgttgccatttggatgagaacagtgaaaagaataatgcctgagaaaagtaacagaccattgcattggatttcctcacctgaaagaattcccaaaagttgagaacccctgttagattaaccatgagtgcctaacatagtccatgtccagccctcagttctggccacacctttttgtatggtcagagcccctggcatgaatgctctttcactaaaataccaaaatgtccaaaaaggcttacaagctactgtgtggcaaggagaaggatgctgcaatggtggtcagaggagatagtaagacccaaagctcagcattttaaatgacagtgaatgctactgcactgcacaggtgcatccaaggacaaaggtataatctgctaattaagggacagctctcctttcttcgaatgattcccatagaggatcactgtcagagctcgcctttcttctatctgccttatagactcaccatgagaaaaggggaagaccagaaaaattaaaaatcacattcatggaaagctgccagataacagttatttaataggtacttggcattcatgacctaatttaattttcattataacattgtgcgatagacgttattatccctattatatagacaataaaattggggtttgaagattttaagtaagaccaaggacaattaagtacagcactgggattagaacctaggactgtcagagactccaaacattcttcattcttttgtctgcaacatcatggtatcttaaaatgctttcatatccgtttggtatccactgcccatccgcccagaagaatggaggggacacaagggagaacttgtatcaggaaaaaaggtatttcaaataatcctaataaaggcacctggatagccatgggccagcattaaacttgtgagaacctccaaaaaaaattataagcaaaaatggggttcaattaaaaacaaattgtatttcccatttttacccccaaccgtaattactccaatcatctctccccataaatctcatgagtcttagagacaaaagaactctcttaccaacaatcatcgacacttaattttaagctaacccaacacattgatgactcttcactcgtgttgtagattttattcttccctatataatgggaatgattagaacggacaggcattcaataaaccttgcctagctctttccatttcaccagattgaaaaggttattttaggttactttttctaaagttttaacaagagaaaagaacaatgactcagatactatttcatggaaatgttttttgaaagcaatcttaacacagtacactgttaagcctcagtactgatgcaagcagtccatccaaaactggcaggatccgtctgaatttttagaaaacaaaagatatctgaccttttaaggactcccaatatttttccatgttctcggatattttttaatctctttaactaatcctccttcattgtgttaagaacctgctaatgctgatggctgttcctgcagcactaatttttaggctgctaattttaggtatagccaatggacagtgcttgcgtgtctatagccatcttcaattatctagttgttgaaagcagaacaattaagaatgcaccataaactgaatggcaataaacacattgcctatttctgttttatttccaacctttattctaagttcatgggtacatgcgcaggatgtgcaggtttgttacataggtaaatgtctgccatgatggtttgctgcacagatcatcctatcacctaggtagtaagcccagcatccaatagctattattcctgatgctctccctcctcccacgcccccaccctacaacaggccccagtgtgtgttgttctccccaatgtgtccatatgttctcatcattcagttcccacttataagtgagaacaggcagtatttgattttctgttcctgcattagtttgctgaggatatgggcttccagctccattcatgtccctgcaaaggacatgatattgtttctttttatggctgcatagtattccatggtgtataaagttacttgtatttgagaatacagtcatttgccaattcacctcatgaagctcaccaaaatgaacagagttctggaatctttcacaactattttctaaatggtaaatggctttgtttataccgtttaggtaaaatgtaacttgacataatacaccttaataaaaattaaaactgatacaaaaaaattctagcaagtaggagactgagaaaatactagctttagggttactaactgtattacatgagtgcatgcaaataggttttgtggattaactctaagattctaatagataaataggtaaacacttggctggtggcagcggcaaacagtgcataacccttttaaaagcaatttggcagtctgtaccaaaaaccttaaaaatctgcctcttttaaccaactttgattctactgctagtgccctggaattactctaatcatgtggccatggcaagccttaaacacagctgggctacatttgagtttttatggtgaaaaatgagagaaaatcaatatgctgtttgacaataattatgtaaactatggaatgccccccttgtagcatatttcaccatcaccataaacaatatgactatcaatgattatacatttgtaattataaattataacactacaaatgattaatacaattatgatgacataaaatgcataaagtataaacacacatagtgtgattacttcttgattaaaaacacacaaatacaaacataacaaaaagactttaaaaaactacatcaaaatactaatagtggtaatttattaatagggagattataggactatggttctgaataatatttattaaattatattttcaagtctacactatttgcacaatttttataatttaaaaaatttaaatagtaaaaataaaatgtaaaatatcacaggaaaataactttccaaccaaagccacacacaaatggaatgtaaatatattttggtgtcattttcaagataatataattttacttagttcaacaaaaaccttgagaatatttagcccaatcagtgctttttgtttcttttcaaagccttactttggaggaagtattacagtgggcccagtcttttgaaaatttaatggctacaaaatgtgagtattgcgtatctgtcatctttgaataactagcgagttccattcttagaggtaaaggtgggggtgccagatgatgaatgtatgctattcttctcacagccttctaactggcaactgacacagttaaaaaaagaaaacctgaaaatagtttgttatgtcaaccactattattttctctggtgttaattaaaacaagattagtcactgtgaatattcttcacaagtatatgcacaaaatcccttggaaaatatgcttaagtagtaacgcataccatagccttctaaagttagtattaaacaaaaacacttaactcgctgttcttgctgccttcaaaagtaagaataaatttgagtcttgctgttctaaaactcctccccaaagtttgtttcaactttttcagtgtctgatttaagtgggactatacatgggtctgaatatagttgtaggtaagtatcgacattaacatggtacaaataagagataccagcaatggatgtgacagagacaaagtcatgggctcagtgcaggaaaaataaaggaggacgtgcattcaaaagaatagtcaattgcgtttggggtcagaaaagctggtccgttgtagaaaatgataaaaccagaagacaggtacagaaaaaaaatgtagggtgtagacacagaaaattctcttgttgaatttggtagttttttttaaatggagttggttcccctcaatgcttgttaatttttgcctatagaaccatctttttatttaagatcccattttagcctctctgtgaatgttttatctgtttagagctatggactatgaaggagagttggctgtgctacttacatgctttaactagtggggtgtaccagtggctattctgggcaaggtaccccctgttcctcatgggggttgtcatagtcctgaggcactacctgctctttctgactcaagaccctctttagtatggactcagttgtcactgcccagcccagagggtaatggcagtaggtgtagacacttggctactcctgctgaaacacgttaatcaaccattctggcgcttacttctgcttcatccctagggctggatctacctctacaggcttgggtcaccacctgagctctcatattttgtagcatgcctttccaatgggcatttggggccatagtttctttctttgatgcaatcgccactggctttcacttttcaggtattcctcatagtttataatccaatttgccagcatgaatgtgaattttaaacaaatatatcttctgggtcagtgttagaacattgaaatgtgatgaagagacaaaagtgcatattcagttaactatattgtaaatttttgtcccaatcctctgtaatacacattttgccaccttgctagattgatctctttcttggagtttcatactcttcatctacaaaatgggaatagtatcacttatcctttcaggtttattgtgcaggtgagatacaaaacatctagctcaatgcctaatatagattaagcacacaataattggtagtttcttttaatagtaataaagtacatgtctttgaatatcattcttttttctctgctgcctaccaacaagtccaaaatcttggtatttagtactctctacaccctaacccaaaacattttctaaaatttgtctctagctatgacctgtcacataacatgccctccaccaatgtgggtcacttcattttctacttgtacatctatgattcttctcctccaggcttttgttcaaagtccttttcatctctagttactctgctcatgtttgaaagtcaaattcaagtgccactttctccagaaaactgcttagtaatttctcctttatcttctattttgttagtattaacatttattctgcttttaattgtagccagtttgtgtattgggttttttatatagtggctttctccctagattataaattccttaagagcacagcttgcctctcatttacctttcaaacccctgagagactgaaaatgtgctttgtacccaatgagcatgcaataaatgttccatgaataaacacaagaaaaatattagtgagaaaagttcaaaacaccaagctatattatgtaagtttctgtgccagtcctggaagccttattaaaaaaatgaataggcttaattatttggcaaggatttcaagtggtcatctgccttgctagaatcagcaatttagaattctagtgtcatgagaataagcaaaggctctagcaaagatgagaataggaaaacatcatactgctctttataaaagccagcaaaaatagggtaagagcctttccagaaatcatattactatgaagttcacataaaaattcaacaatcacataataagtaataaaacgaatcattctatggatgatccaaccagtaagacaaaactaaaaatacaaatattaaatgtgccagagaataaaaatgtgtttacattaaccaaggacattagtcaaatgcatgctgtagctgagatatgcagatgcatattttacatagattaaaacattatttctaaggacagtagctcagacacacacatgaaaaagaaatatatcagcctgggtctcaatagatgaaccgaaattggtttagagacgttttagggagccattaagtcatagtcatcaaaatacaattaaattcaacatctcagtgggaaaaggggatccaagaaaaccatcagtttgagaacagaagtatggcaaaatccaaaagttaattagaaattaagaatgttagcaacttagataccttttagataatgctatttaatgctacattatttgcaaataattttttacatatgaaagattttttttatatatttaaatatcaaagattttcttgttatttatatgaaacataatgtaaccaaatagaactaaagtagagagactagctagaaggctgctacaataattcagataaaattggaactcagtagggaagacaaggctgggggtaatttgcatatagatgctaacaaaagtcacagggctgtgagaccactgagagggagagttcagatagaggaaaacacacccagagatgaaacttaggtgtgtgctacttccaagtccaggtaaccagagaggtcagcaaagtggatggaaaaggagcacaaagtgaggtaagaatgacgaaaatagtgcattcttgtggaagccaaagaagagagtgtttcaggaaggaagctgtgaattgtcaaagactgctgagaagtcagctgaggtgaggaaggaacagtgaccactagacatggcaatatggaagtcaacagtgcctcaacaagagcagtttcatgggtatggtggagataggtaaaaccagaggaagcaatacacagcataaggaatcactgacataagttttgctgtggagttctgcagagaaaaaagcagagactggaagcgggaatgaggtcaataccgaaagtttgagtcaatagttgttactagttatatttgggaaatacagcaatatatttgtaggatgatggcaacaattcatggggaagaaactgatgacacagaagagagtggagatacttataagaaaaatagaggaatgcaaagtaggaatgcaaagtaggaagaagcaaaagtaggagggaaccagaaaaaaaattgtttggccatcccaaaaaggaacagggacacttgcccctcaggagagaagttataaaggaggaatacagatggaagtactctggttatttctggagagaagacggtgaatatccgtctgattaatctgtgctctcagtgaagtttgaggcaaggtcgccagtagattgcttaggagaggatgttttagtatgttttaacataacaacggaggaggtataaaatagtttctgcagatttagagaaccatgatactatggaaggctcattggttgactgggcagtgttgagtgtctgtttaaaatctgaagttatgatttcaaatgcgagaccacagttgtatatttttctctggcttgttcaggttgccccagcacacacgcagagcagatattaagccattccggataagcaagtgctctgaatcacagagtttgcttcaatcttttgatcaaaatcatctttgaatgtactattttccaccctttctaaattaccacaatcccatgcagaccaccttagaaatgccagttaaacagtgtgggattgacatactgctgaaggcaatgaaggccgctccatatcatgaaccatctgtgtgggctggtgcatcttcctcagcatcatggcacagagcaggcagtagaagttactgatggttattgttgctcccttttgtacatcctgatcccagagtcattctctcagcttttttcatctgtgcaagctcctttgctgcacagtgtgattggcagtttcctacactatcacttattctaatctctgctaactactgctgttgccatggctcccttcatcaacccttatattacctgcactgccttcctctaccctttccacttagcactttttgtcttttttaacttctcatgcacttcttcaccttgcaaagggggaaaaaaacctcgcctagaatagacatcactgtccaattagtacattttttttttggtattgctttcagaaaaccaaaaagcaatagcatttcagatataaacctgtcgtctttagtgcttcctagatgttcaataactaaggtctgcttcttcacttttcaagagccacagagagtcattttaaaacagaaacatgagggatccaaaagcccaaattgacatgtgtttattcagtgcctgctatatagcaagcagtgttgaggcacggggtacatgaagatgaataagctgcagtcctgattctccaagggttctcaggtgaatgggaggataatggaaggaaaccacagcaaagaggggtggcctttatcacttgggcaatgggaaatgttgagggggataaataatagatttttgctttaaagatttttctctaataaaagtacagaggaaattgaaagcaggatcagatagatgaatcaaggcttcttcagattcagtggtttacaaatatacctcaaaattcataaacaaaaataatacgtaaaagagaacagaaggtaacgcaataaaggtaacagagatagtgtcttcagtatataaagagatctgaaaaatttaagaaaacactagcaatgcaaagaaaaaacagacaaaagatttggaattcacgggaaaaaaagaaatggtcagtaaaaatgcaaaactgtttaagcattatattttaaaaatacatatttaaacaactacaagttactgacttcaccccattagattggagagcgtggagtaagtcagcactgacactgccattgggaatgaaaaataatgaaatccttctgaaagcaattttacaatatgtatcaagagtctccaaaaatattacatcttcaatctaaaaattctattttaaatcaattattttccctaagaaaatagaggtgaaaaagtttataagccaaaatattcaatgtaggataacttataaccaagaaaaggggaaacaacctaaaacaataataatagagtggctaaatatgttatggcctaccccatcaacagactattatatgatcattaaaaatgaaaaagagaaagtgttccctatgtgctattaactatgaaagaataagaatgatacaaaattgctttcatattataatgcccataggatcattccagtgtgtatctgtgtttgtgtagatgaatgaattctagttaggtaggcaattattcatgaacaaaggattaaaagaataaaaggaaatataccaaattgttaacagtagttattaatttactagaagttttctgcattaaaaacgacccacagaattgaacaacgagaacagttggacacaggaaggggaacatcacacactggggcctgtcatggggtggggggagcggggagggatagcattaggagatatacctaatgtaaatgacgagttaatgggtgcagcacaccaacatggcgcatgtatacatatgtaacaaacctgcacattgtgcacatgtaccctagaacttaaagtataataaaaaatatacattatatatatatttttgctattaaaattaagtatttctcaataatttttattaaagtttaattaaaaaatgaaattattgatccacagaggactgattccatagatatggaactcaaggattcagagggctgactgtatgccattatggaatattttcctctgaagacaacaatatatttacacattttattttcagccataaataacaaatattaaataggaaatttaaaaaatacattaaaataaaggaccataaatttgaaaaaaagacccacaactctttaagctgtgtttataatattagtaatattaatattaataacaaaggtagaagaaaaatcagaaattattaacagcatagaagccacaacagagaattttaataaaactgaagcttcactgtaaaactccacacatactatggtagaattatgaagtacattatccccagtggtacagattgaaaataaaatggattttaaattggtttagaggcatttctaatggtactgcaacgtagtgcacccttgggatttcctgcctggtgtaagccttgcagtcttacagaaaaaataattctggaatagatgggccactgttctgactcagccatgagaaagcccacatttcccttctgcatcaagaacactggcatgtgtcaccttgtgtgtcatagaaatactaattttagtgactagttttaaaagaacaggctagagattcccaaaggcaccactctcactttttaagggaaaagtatacactatgtatgacataagccatttcttccatcctcccaatttaaatgagcaattctgatgtttatcatcttattcactctgttcaagcagaatcgcagtcttctgagcataatgttcaggaatgagtatcatttaaaacttcagaacagcctacattgcctgatttagaaaaggcttttccaccttgtaattcacttgtggtatgaatcaatcgaaattctaaagagagcaattcagttctgactttaataattactaagattcctggaacacttttacacaaatgcattttcagccgctagcttgagtaacttgcagcatattcagacaaaagttagcctgatgcagacagaattctgtaaagtatgccaatcacatgagtccgctcattctgcacgctagaattatatctgaaatatatagcgaaatccagttcagctttcgctagtcatcacatggtaacaagtgacataaaatcctagtgatttacattaataaaggttcacttctttttcatgatacacaacagctagggtcagctccagctctattccatgtcttcattccagccttcgggctaaaggagcagctcttttctagaatatgctcttcttgtggtggctgtgggacataggaaatagaaccacatgatagttcttaaaccctctgcttgaacgtgtccatagcacttttgcatgtatttcattgactaacacaagttcaatggccaatgctgacataaacaggacatggaagtataatccccctacacaaaggtcaggaaataactgaggaacaatacgacaatctgccacatcaagtatctgaaatataccatatttttaatagtatatatagaatactgtatatctatgcagtatatatagaataccatatatccatgcagtatatatagaataatacaactggatctataatatgtgtatttatgtgtggagagatagatagatggaaacagatcgtgaagacagaaaaaaagatagatgatagacagacagatagatagacaaatagataaggcaatgtatatatggcttcattagcaaaggactttggtatgacaagaattgtagaaccatttggccagcccaaaaaagaaacagggatacttcttccaatccatcaggaagaaagttaaagaagccagatacagatacagttggttctaaaatgataacctataaacattttactacataattaagctaaacataaacacaaattcagaatactagcttagaatctaatattagtttccagatcattttcctacccctacctactcatccactcaacccatccaagtagcctgtgtgacagactctcattccatgagccatagatttttatctgctatctcattttctttctgttccatagctaagtacaaaccatataaatattggcttccaactttacttgttaagccagaaacagcttaacattctgtttttttttttttatttgttcatttgtttgtttgttttttggtttgccaccattcagctgtctctttaggaactggagtaccaattcctgcatctgtgttctctgttccaacctttctgtgcctatggtgagacaagacacaacttagagtcacgtcggtgtgaaaatcaacttcttgtttaaaatctaagttaaaatatatccccctcacattggataggaatatctaatctatatcattttctatgttacatttatataatgcctctatctcaactgtcctcttaactcatctcatgttatgtccttgttgaaccgtatcccatgcagtgtcctgaaggctgcatttgctcacgtgataataatagtccatgtttcaattttgagtattcctaggatgcaatatttacattcggtttccccaactccaatgcctccttagaagagatctacttctatttgagttcttttgcttgaagacaaaatacttcgttatctttgttcctatatcactgctaacaaagccaagctatcaaggagcctggctttctagtgctggaaaacttgatctgatctcttagatgaagatccaggaaaatatgatcttactcatcatttccattccatctggctaccattatttctcataatagtaaatgatattgaccaagatagtgttaatcaaaatcctacgcttttggaggtgatagatatgtttatggcattgattgtggtgatggtttcttgggtgtatacttatctccaaattcatcaagttgtattaaattatgtacatctttttgtaaacaaaatatcctaacagtctctaggtggttattactcagtgtgcctacacaaacatttcttttaacatcaattgaaagttacattgttgttttatcatatagcaatccaattccttggatatgcgaagagaatttctagtctagtctagtcaaaaaaaaattaatatcttgaaccttgagaatacttggtcctcccaaagattccaattaatatgttagatttgtgagagctcacctaatcctctttttcaaatattactacctacaaagtaatgtctcaattggaaaagctcctccttggcttatccttatctaagcactccagaaaggcagtttaagatcagagttgaagataagaatctccggcatcaagtgttatgtgatggttacgctgcacataatccctgtcctgtactagattctgagatagtttccagcatcgcgtctgatttttcattccttgtctggtcccttatttctggcttgaaccataaaccatgaatatgaagttgaattcttcatctatctgtgttctgctctgattagacattgagaaacactccagggtgtacaaactaattagagtatcactcttacatggcttggatatttttctcctgaccttgacctacaagtttacattcaaaaccctgctcttaccctacagtttggcatgaggtcttagatttttcgtgtcagcttcatgattagagcccccgtcctcctgagcagcttaagtccttttcctgggctctgtgatgtctcctgtcctatctgtcctagactcatccacactggtgggcattttgctctgagtgactcagaataaatggatgacatcatcagtgatcagcattgtcaaagcacgcttcagatgttcgctctaagtgtgtgatagacatgaaaattgatatatagagatagatataaaatatttacttgttaaataatttgtgagtttttaatcaggcttttttttaactgtattgcttagatttttttggtgattttgacccatgaaaataaactgatttctcctctacttttagatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagaggtaactacctgacaatgacaggaatggaaatcagttcatccctgcaagggcattaatatctgtcaagcatccataagtgccaggcactttacatccagtatctcctaaaatgctataaattcagtattgctaaccttattttacagataagaaacctgagactctgagaacttgtccagtgtcacacagccattaagtggtaaagttaagattcaaaattaaatctatctggctccaaagcttctccccattaaattatcttgatttctaggaaacttaaaaagaaaaaaaggagtctgtggcgaaagcattggccttcccagcaggaactataaatatcatgaagagacatttgagaatcctgtgttgttgggcaatgagaaataaaaagtctgttaagggaataaagacagaggacagtatatgagatttctatcgtacagggcaagcctacattgtggacatattctagaactcttgtctggaaaatacttggtttattgaaatagccacttctcccctctatttatccacttctcttcattttcttcccatttcagagcatattcagttaaatcaacatttgtgactattaagggagataaatttttaaaaagcaccaatttctcttttctttaaaaagacatttgtcttacaaacttcctgatttgtagactgctactaagaaaccactgcatcttcctgagtaagccatggttttggaaacttccctggccttgagcctcatatttttcttttttgttcctcttggatgtggagttggatatttacttttaaaagagcaaaatgtttattttttatatatcttcttagatgcctataaaactacaaagaaaattaccctattccactgaaaaggagagcagagaataaattaaacctttctactatatgtgcctttttttcaactatgctaacttaatgctgtacatgtaatttcacttttcagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaagacttacattatctttctcaaagacaaaataaatatattttccagtacaaatttcaaaagggccaaagttggtatacagtgagaatatataatatttttattttccatagttttcctggaaagtggagacaacttaacacattcattggatattaccttcctatcatttcaaaatattaaaagaatccagattcgacatccataatcagaagctcatcgtaacatttacaagtgtgaaagttgatctgttccattttgtaattaaaagggaacaaattagaaatttcaagtcttgtattcctgaaggaagaaaacattcaaaaatgatttttccctcttggaattattttaaaatatgcatattttctcttagttttgaaaagtggcttaaaatagacttattttacccttctgcagatgcaaagtttttctgtctttctagtgattcactaattggtttactactgaattatttattccatgagtcattacattttattgttaccaagaagtgtaaatttagttagagtcagatgcttctgtagttcatgaaatcacaggcgtttttccgtagcgctgtccacttttaaaagatgagcaatgtgagtaactacacagccaatcttagcacaggtgctaagaagggctaagtcactaaaccaccttgcctccagctctgaaaccaaaaaagcctagtaaaaaaataaaattttttttaaaaaagtgaataaacaaagaagcattgctgatacgatttaaatacacttcagttctgcacagtggaaacaatactgaattcattgttaagaaagttgggtttcagttctagatttcccaggttaactatataaatttctttaggtctaggtaaactatagaaaattatacaaattacttattgtccctgcttctcagttttctcaccttttaaatgaggtcattaaaatagataataccttagttcctttccagcttcaaaatcctgactaccgtcagtacttttttttcttcttcttcttttttttttttttttttgagacagactcttgctctgtcaccaaactggagtgcagtggcaagatcttggctcactgcaacctccacctcccaggttcaagcgattctcctgcctcagcctcccaagtacctgggactatgggtgcgtgccaccatgcccagctaattttcctatttttagtagagacagggtttcaccatgttggccaggatggtctcgatctcttgacctcatgatctgcccacctcagcctcccaaagtgctgggattacaggcgtgagccaccgcacccggccagaaagtacttttaaattactgagttcttcattatctgaagggttttgtgtgatattccattgcctttcctctgatttcataaatgtaatacaatgccacatattcaaaacagaattttgccacaaaaacactcttctaagatcatgtcttcagatgtttgtaaatcaggaactatctctggccttcccacttgctcccttaacttaggccttcccacaccattcactgctgaagctggtgttctagctccaagaaaagccctcagagattgtagaaaccagtatggaggttcctcaaaaaatcaaactaccatatgatccagtaatcccattttttcatatttattcaaaggaattgaaaacaagatctcaaaaagatatctatacccccatattcactgcagcattattcataacagccaagaactagacacaaactacatgtccttcagcaaatgagtggatgaagaaaaagttatacacacatactcaatggattattattcagccttaaaaagaaggaaattctgccatttgtgctactatggatggagctggaagacattttgctaagccaagtaagcaagacacaaaagacaccatgatctgggccaggcgtggtggctcacacctgtaatcccagcactttgggaggccaaggcgggcagatcacaaggtctggagtttgagaccagcgtggccaatatggtgaaaccccgtctctatcaaaaatacaaaaattagccaggcgtggtggtgggtgcctgtagtcccagctactcaggaggctggggcaggagaatcgcttgaacctgagaggtggaggttgcagcaagccaagatcacaccattgcactccagcctgggcgactgagcaagactccgtctcaaaaaaaaaaaaaaacaaaaaaaaaaaaacaaaaaaacaccatgatctaaattgtatgtgggatctaaggaggcaaactcatggaggcagagtaggatggcagttgccaagggctggagggagagggaaatgaagatatattggtcaaggggtacaaagttttagtaacgcacgatgaatgggttttggagatctaatgtacagcatggtgacaacagtcaacaatactgtattatatacttgaaatttgctaagagaagagattttaaatcttctcaacacacatatgcacacacacaaatggtaactatgtggagggatagatatgttaattaaattatgatggtcatttcactatatatacatatatcaaaacagcaacttgtacatcttaaatatacacgatttttatatatcaatatctcaaaagctgttgaaagaagccttcatagactatcctatcattataagatgtaaaagtttcatgagaataaaatattaatttttttattattatactttaagttctagggtacatgtgcacaatgtgcaggtttgttacataggtatatatgtgccatgttggtttgctgcacccatcaactcatcatttacattaggtatttctcctaatgctatccctcccccaggccccacccccaacaggccttggtgtgtgatattcccctccatgtgaccatgtgttctcattgatcaattcccacttatgagtgagaacatgcggtttttggttttctgtccttgtgatattttgctgagaatgatagtttccatcttcatccatgtccctgcaaaggacatgaactcatcctttttatggctgcatagtattccatggtatatatgtgccacattttctttatccagtctattattgatggacatttggcttggttccaagtctttgctattgtgaatagtgccacaataaatatatgtgtgcatgtgtctttatagcagcatgatttgtaatcctttgggtatatacccagtaatgggattgctgggtcaaatggtatttctagttctagatccttgaggaatcaccacactgtcttccacaatggttgaactaatttacactcccaccaacagtgtaaaagcattcctatttctacccatcctctccagcatctgttgtttcctgacgttcaatgatcacccttctaactggcgtgagatggtatctaattgtggttttgatttgcatttctctgatgaccagtgatgatgagcattttttaatatgtctgtcagctgcataaatgtcttcttttgagaagtgtctgttcatatcctttgcccacttttaggtggggttgtttgttttttcttgtaaatttgtttaagttcttcgtagattctggatattagcccctttgtcagatggatagattgcaaaaattttctcccattctgtaggttgactgttcactctgctgatagtttcttttgctgtgcagaagctctttagtttaattagatcccatttgtctattttgacttttgttgccgttgcttttggtgttttagtcatgaagtctttgcccatgactatgtcctgaagggtattgccagggttttcttctaaggtttttatggttttaggtcttacatttaagtctttaatccatcttgagttaatttttgtatatggtgtaaacaagggatccagtttcagctttctatgtatggctacccagttttcccagcaccatttattaaatagggaatccttcccccattgcttgtttttgtaaggtttgtcaaagctcagatggttatagatgtatggtgttatttatgaggcctctgttctcttccattgctctatatctctgttttggtaccagtactatgctgttttgattactgtggccttgtagtaaagtttgaagtcaggtagtgtgatgcctccagctttgttcttttggcttaggattgtcttggctatgtgggctcttttttggttccatatgaaatttaaaggagtttttttccaattctgtgaagaaagccagtggaagcttgatggggatagcactgaatctataaattaccttgggcagtatggccattttagtgatattgattcttcctacccatgagcatggaatgttcttccatttgtttgtgtcctgttttatttcgttgagcagtggtttgtagttctccttgaagaggtccttcacgtcccttgtaagttgaattcctaagtattttattctctttgaagcaattgtgaatgggagttcactcatgatttggctctctgtttgtctgttattggtgtataggaatgcttgtgattttggcacattgattttgtatcccgagactttgttgaagttacttatcagcttaaggagattttgggctgagacgattgggttttctaaatatacaatcatgtcatctgcaaacagagacaatttgacttcctcttttcctaattgaataccctttatttctttctcttgcctgattgccatggccagaacttccaacacttatgttaaataggagtggggagagaaggcatccttgtcttgtgctggttttcaaagggaatgcttccagttttttcccattcagtatgatattggctatgggtttgtcacaaatagctcttattattttgagatacgttccatcaatacctagttcattgagagtttttagcatgaaaggctgttgaattttgtcaaaggtctttactgcatctattgagataatcatgtggtttttgttgttcattctgtttatgtgatagattacatttattgatttgcatatgttgaaccagccttgcatcccagggatgaagccaacttgatcatgctggataagctttttgatgagctgctggattcggtttgccagtattttattggggatttttacatcaatgttcatcagggatattggcctaaaattcttttttgttgtgtctctgccaggctttggtatcaggatgatgctggcctcatataatgaattagggaggattacctctttttctattgattggaatagtttcagaaggaatggtaccagctcctccatgtacctctggtagaatttggctgtgaatccatctggtcatggacttattttggttggcaggctattaattattgcctcaatttcagaacctgttattggtctattcagagattcaacttcttcctggtttagtcttgggagggtgtatgtgtccaggaatttatccatttcttctagattttctagttcatttgcgtagaggtgtttatagtattctctgatggtagtatgtatttctatgggattgttggtgatatcccctttatcattttttattacatctatttgattcttctctcttttcttattagtcttgctagtggtctatttattttgtggatcttttcaaaaaaccagcttctggattcactgatgttttgaagggttttttatgtctctatctccttcagttctgctctgatcttggttatttcttgtcttctgctagcttttgaatttgtttgctcttgcttctctagttcttttaattgtgatgttaggatgtcgattttagatctttcctgctttctcttgtgggcatttagtgctacaaatttccctccacacactgttttaaatgtgtcccagagattctggtatgctgtgtctttgttctcatattgctttcaaagaacatatttatttctgccttcatttctttatttacccagtagtcattcaggagcaggttgctcagtttccatgtaggtggttggttttgagtgagttttttaatcctgagttctagtttgattgcactgtggtctgagagacagtttgctgtgatttctgttcttttatatttgctgaggagtgttttacttccaactatgtggtcaattttagaataagtgtgacgtggtgttgagaagaatgtatagtctgttgatttggggtggagagttctgtagatgactattaggtccacttggtgcagagctgagttcaagtcctggatatccttgttaattttctgtcttgttgatctaatattgacagtggggtgttaaagtctcccattattattgtgtgggagaataagtctctttgtaggtctctaagggcttgctttatgaatctgggtgctcctgtattgggtgcatatatatttaggacagttagctcttcttgaattgatccctttaccattatgtaatggccttctttgtctcttttgatctttgttggtttaaagtctgttttatcagagaccaggattgcaacccctgatttttttgctttccatttgcttgatagatcttcctccatccctttattttgagcctatgtcatctttgcatgtgagatgggtctcctgaatacagcacaccaatgggttctgactctttatccaatttgccagtctgtgtcttttaattggggcatttagcccatttacatttaaggttaatattgttatgtgtgaatttgatcctgtcattatgatcctagctggttattttgcctgttaattgatgcagtttcttcatagtgtcaatgatctttacaatttggcatatttttgcagtggctggtactggttgttcctttgcatgtttaatgcttccttcaggagttcttgtaaggccggcctggtggtgaaaaacactctcagcatttgcttgtctgtaaaggattttatttctccttcacttatgaagcttagtttggctggatataaaactctggttgaaaattattttctatgagaatgttgaatattggcccccactctcttctggcttgtaaagtttctgccaagagatccactgttagtctgatggacttccctttgtgagtaacccaacctttctctctggctgcctttaatattttttccttcatttcaaccttggtgaatctgacaattatgtgtcttggggttgctcttctggaggaatatctttgtggtgttctctgtatttcctgaatttgaatgttggcctgccttgctagattggggaggttctcctggattatatcctgaagagtgttatctaacttggttccattctccccatcactttcaggtccaccaatcaaatgtagatttggtcttttcacatagtccatatttcttgcacactttgtttcttttcactcttttttctctaatcttgtcttctcactttattaatttaatcttcaatcactgatatcctttcttccacttgactgaataagctattgaagcttatgtatgtttcatgaagttctcatactgtggttttcagctccatcaggtcatttaagctcttctctacactgtttattctagttagccattcatctaaccttttatcaaggtttttagcttccttgcgatgggttagaacatgcttctttagctcggtgaagtttgttattactaaccttctgaagcttagttttgtcaactcgtcaaactcattctccatccagttttgttccttgctgccgaggagttgggttcctttggaggagaagaggctttctggtttttggaactttcagcctttctgctctggtttctccccatctttgtggttttatctacttttggtctttgatattggtaacctatggatggttttggtgtggatgtcctttttgttgatgttgatgctattcttttctgttttttagttttccttctgacaggcccctcagctgcaggtctgctggagtttgctgcaggtccactgcagaccctgttagccttggcatcaccagcggaggctgcagaacagcaaatattgctgcctgatcctacctctggaagcttcgtcccaaaggggcacctgcctgtatgaggtgtctgtcagcacctactgggcggtgtctcccagtcaggctacacggagggcagggaccaacttgaggaggcagtctgtccattatcagagcttgaacgccatgctgggagagccacttctctcttcagagctgtcaggcaggatgtttaagtctgcagaagctgtctactgccttttgttcagctatgccctgcccccagaggtggaatctatagaggcagtaagccttgctgagctgcactgggatccacccagttcaagcttccctgctgctttgtttacactgtgagcatataactgtctactcaagcctcagcaatggtgaatgccccaccccttgccaagctccagagtcccaggttgatctcagaccgctgcactagcagcaagcaaggctccgtgagcatgggacctgccaagccaggcacgggagggtatctcctggtctgccagttgctaagaccgtgggaaaagcacagtatttgggaaggagtgtaccattcctccagtacagttactcacaacttcccctggctaggaaagggaaatcccccaaccccttgcacttcccaggtgaggtgacaacccaccctgcttcagctcaccctccatgggctgcacccactgtccagacagtcccaatgagatgaaccaggtacctcagttggaaatgcagaaatcacccatcttctgcgtcgatctcactgggagctgtagaccggagtggttctgatttggccgtcttggaagccggggcaatattaatactctttacagtatttaaacttcactgtatttaaactttgtatttgtatctttactgtatttaaactttagtgataatatgtataaagtgttagaacctgtatgatttataatggatgggagaaaatagggtatcattaagattcttggagcactgagtaatattgttcactgctgtggaggccagaaggtaacagaagaatataaatttcttaagactacagccatatcttattttgcatcatatcctcactgctaggtagaggacatcgaaagtatgacactcaaaaaaatagataaatgaatgagtgaatgagtaaataaatgaatcagtcaattcatcatcagtgagaaatgaataaatctggtgtcagatctcctttactctgtaactcagcactgccaacttttaaaaagcaattcctggattgctcaaaaaatgtaaaatttcaggataatacatgtataaaaatagagcattatgatctgaattttaacaactgagcaaatcttctatccaatgcatagaaagactggacaaacaaaagatcagttctactaaatattgttgatatcagaaagagtgtgacaatgcaagccaaatagggacaggaaaatatatacgttagtgagtatggttcgctagttgaagggagagcaggctttaaagcaatgctcggttatctcatcaataaagcagtgataactctggttgttttcattattaacaaatatattaaattttccttgattttttttaacaatttctaattccttttccaaccaaaaaagttcttggttttcttttcctaagtcaggaaggtgagttgaatgaatatgtgaataaatgtgcttatcaaattttctttcaaaataatttctaaaagctgaacttctaaattttaattgacttccatttaatatttctatcaattgcagaaagacagcttttcacatcattatcatagcagattcttagcacttgtcagaatattttagaggaaaaaactcacatccttttcattttctttattcagcacatagcacaggataaatgttctgtacaaatggataaatattctatacttttgatgaaaaataaaatacctaaaatatttaagattatttttccaaagaattaaatatagaaaatttttgttgaaggtatttagttctactatgaaaaatgtttcttggctctcaaattcaactgaaatgtcattactaatttgaaatggttacaaactacatgatatgaaaatgagtattaactagaattcctactaagaagcaaaaggattattataggcaaattgtccatattgaaagtaaactaccattattattgatctaaatatgagaaattttatttgtgatattccacacaataaatattgggggattcatttccaagatagagaatcagctgtaaaagagaatattttcattaaaaagtatatgattgattaaggtgaactgttgttagttgtggaaggtgttaccacagtagtccaattttatctaagccacttgattttatttattttctcttaaaaataccagtataaaaatacaggttgaagtcctagatatctaaacttgatgatttctagccactataggcagaaaaaaaagtatttccacatttcagattctcctcatctcactccatcagtgaatgagtatctatctatctatctatacacacacacacacacacacacacacacacacacacataaatatatgggcaagtaggaaatgttacacatatggtttggctctgtgtccccacccaaatctcatcttgaattgtactcccataattctcatatgttgtgggaggtacctggtgggagataagtgaatcatgggggcgggttcccccatactgttctcatggtagtgagtaagtctcatgagatctgatggtttgatacagggaaacctgttttgcttggctctcattctctctcttgctgccaccatgtgagacgtgcctttcaccttccaccatgattgtaaggcctccccagccacgtggaactgtaagtccaataaacctatttctcttgtaaattgcccagtctcagatatgtctttatcagcagcatgaaaactaactaatacaacatgcatggccacaatacacatgcttcaagcactttcagaacaccatgggtctttctcattcaaattatacaaaatcagcctaatacggacataactagtaaatgatatcagaataattagcattctttactacttatttttccccttgaatacatggatatttgtactccaaaacagagtaagtctagagttttcagttttgcttaatattctgattttacctcctaaatacaggctttctgtcctgctccctcagcacctccacatcatggtgaacaaagaagatgccatgtggtgtcatgaaacaaaaagctttggattgaggtacaaagcaattagattagcatctgttcattcacctgatgttcttgtacctttaggaccagtaggcttcagcttcctcatctataaaataaagtaggatgagatgattgagtaagccacgtgctatccctgttttgttacatcccattactaacgtgttcatcattttcttttctgtaacttggactcattttcaagagtaatttctccaaaaattgaagttttcatgaggagtttaataatgatctatttattatattttgcatttacccctaattataagagttcttctgaagtatttgacttagaaacagagaagttaaacttaaattgtatctgcacgtaagtgctgtctgtccaagaatactgtatggaagtatgtgtttcattttacaaatagttaaaatagtttcagattattttaacttaataatattctaaatattgctaattttccttgggattttttttaaattattaaatattttatttcattaaaacaattttaaatgattgttatcaaatggctacatgcctatattcatattaatgcattttgacatatttgttttatccttagtactttaatatttttgagttaaaatcatattctttgacttccaagatcagaacctgaatatatttatgattttaaaaaaattttttatatatacttccagactctggaaatgtgcaagataagcctccattgtccctgtgtagaaataaaatcttaccttctccaaaataagatagtgatagagatttgtacaattcagaattcaagcatcttgccagatatgaacacttccctatttataattcatcagtcacaccatgatttcatcaattgcaaagaactttttatgaattttagaagaatttactgtgaaaaagagatatataaagctttcttcaaagacatacaacattgcaatttgaagaaaattattattttcttcacctcactgcctaaaaatattttcaccacatgtagggctgcaactttcacctcttgtcataggtgaaaaattgcatcaaaatccgcatcatgagaagtgaaacactagtgttaacactttagccgttgcctagcagaaagcaaaacctggaaaaatagaatgcaggaatatagggagcacaggaaaatatgtaggctcagtgaacaaagatagtagggaaactagaggttatcaggtactgaacaggacttggggaacaaatggaaaggggttgcttataaaaatctccctaagatgcttatggaaaaccaaaacagggcttagtttaaacaatcaggtgttctaaattaataattatacattgtagtagaataaaataagatttctataaaaataaaagagcaagtattacattcctcattaagtagtatttatagaagcattccttataacaatctacccagctcctactgagtatagatattgtacacacaaacattaattaggtggtgtttctgttctcaagggcatgtaagctgataattaaaatacaaaacaatagtagtcaaggtagacctgtgtaaagactgctgtggaatctcagcagaagcatttacctctacccagtggaatttggaaagagaagaggttatgtttgagatgaatcttgaagaataattaagagatcactcagaggaaaggggaaagcagtgtgaattggaacaagagctggagaagggagaatcttgtaacaattcgaaatatttaaaagagggtagaggctttgaaatcagatagatctaagttcaaagcctggctttaacacttaacagctatgagaatttaagaaaactgcttaatctcactgaactttgttttttcttcatcagtaaaataatatataaaaatagcattaattgctcttacctcatgggcttctttatataaaaagtgcatataaagtcttgactctgtgttcaatataatttaactgtattatgagttatcacaaaagcccagatgagagacaatgatagtctgagctaggaaaatgaggaaaagagaaacaatttgaaagagaaattatgagctcagcaagaagggagagatcaaggttgttccaaagtttctagtttaagcagcagggtaagaactggtgccattaactgagcgaaggagatcagagggatgagcaggattcagagggcaagttgcatgtgaggtgccaccacgccataagtgggattccagagagaggtaaagaccagaaatgcagaactgggaactgttggcatgatcaaggcactggccagaggagatcttacaaggaaactgcagaacagaaagtggaaatccaaaggactcaatcaaagcttatgaaagaatataatagattaatgactcctcaattctcaccataaactcttcatgatatttatagttataaagatcatttatgacattttaccatgtaaaatgtattgagctaagtgttgatacagcattcattcattcaacaaatagttattgagcatctgctgtacaacaacatggttatcagagatgaggattcactaacaagccaagcaaaacacatgtttgccctcttggagcttaaattgcctttatgtaacaaaaagggtagtcaactaaagaaaatcacatcaattatgataagtgctgtaaagaatgaaaataaaataaaacagtagagagtggcaggtgtgagaactcaccagagaaagaagttagggggccctctctatgtagttcatatcctcctctcctcttgacagccctgatcaagaatgaggaatctgatgctttgagaagttaaataatgtgtgcgtgtgtgtgtgtgtgtgtgtgtgtgtatttaacatgagcactactctcttaacagattttttatgtgtacaatacagtattgttaactataggtacgatgttgtatggtagttctttagaaattattctttttgcataattgaaattttatacctattgattagctactccccatttccttctccccacagcctttggaagccactctgctattctttgcttctacaagtttgactattttagatacagcatataagtagaatcatgcagtatttcttcttcttctgtaactggtttatttcacttagcataatgtcctcaagattcatccttgttgtcaaatattataggacttattcttgtttttgagacagagactcactgtgtcacccaggctggagtgaagtggtgaagtctctgctcactgcagcctcaacctcactggctcaagcgatcctcccacccacatcagcctcccaggttgctgggactacaggcaggcaccaccgtgcccagctaatttttgtactctttgtagagatggggtttcaccattttgcccaggctggtctcaaatgcctgagctcaagtgaaccacccacctcggcctcccaaagtgctgggattacaggcatgagccaccatgcccagccactttcttttttattaaggatgaataatattccatggtatgtgtacaccacatttcctttatccatttatccacatagacatttaggttgtttccacatcttagctcttgtaaatagtgctgcaaaaatgtgggagtgctaatatctctttgagatcctgatttcaattcttttggataaatgtccagaagtaggattgctggatcatatgatagttctgtttttaatttttaaggaacttccatactcttttccatagcagtaggaccaacagtgtacacgtacaagcattcccaccaacagtatacatgtataagcattcccaccaacagtatacacacacaagggttccaatttattcacatccccaacaacacttgtcttgtttatgtatatattagccatcctaacatgtgtgaggtgattttattgcggctttgatttgtatttccttgatgattagtaacactgagcatctttccatatacgtgttgttcatttgcatgtcttcttcagagtatcatactggaataaagacagacatctagaacaatggaacagaatacagagcctagaaagaaatcaatgtatatatggtcaactgatctttgacaaaggtgtcaaggacacacaatggagaaagaatgatcccttcaacaaatggtgaatatccacatgcaaaataatgaaattggaccctaatattataccatacacaaaaatcaactcaaaatggattaaagacttaaacagaagacttaaaactataaaaccctaagaagaaaacataagggaaaagcttcttgacattggtcctgacaattattttatggatatgacaccaaaagcacaggcagcaaaagccaaaatagataagatcttatcaggaaactgtgcacaatagaaagtggaaactcaaaggatccagtcttaggagagaacataacatattaatgactcttaaattcccattgtaagctcctaataatatttataattcaactaaaaaaactacaaatctctgcgaagcaaagaaaataatcaacagagtgaaaagataacctagagaatgagagaaaatatttacaaaccatatatctcataagggattgaatatatatatatatatatcctacaactcaatatcatatatagatatatatagatatatatactaccactcaacagcaaaaaaatctaatagcctgatttggaaatgaactaaggacttgaataaatagcttctttaatgactctcagctagaactacagttttcataattccaatcccttatattaagtactgccttccacaaacacactaaatggaaaataaatgtataatgatctaatataaataactgtgttcaaatttaaagtgccattacctatacaaactaatttaatatggatgtttgttattacacctgtctctagttactgctgctaataaacttatacaaattagttcaaaccatcgttgatccttaggtctcagaagatttacctgggaactgatgtgatgatgcccaagttccagtactaaaatggaacactttctctttaattagcaaataggttgcttaagccaggaagtgaaaagcacatattgggtagtgagttatatatttcttaaagggagaagaggcaaagataaaggagccaaactaccccctttcaagaggttggaggccatggtccaaaccatgcagcatcccagcatgtcacttttgtcttggataataagtaagcagaggtgatccagggtcagggctgtgaacagtcagtaccaactggcttcttcaccttcagtttgaggacgaacggatgtgagcaaatagcaagaaataccattagaaacaccaaaagtgaaagaaaaaaaatactgaaaggatctgggatgtatagccaaagaatttagagaaaataaagtagaaaatcatgagctcattttatttaattttaacaagcagcatcttactcatctgatgtcatttttatctgccagccacagaggcagcagcatttgccaatttctgaagacactacccagtatctggcacctatcactgttgccttgtcctatgatcttgcttaaaatgaagaactagccactttggggttacataatttatctaagtataaacaaatatgtttataaaaaggactggcccagggtcattttcaaattttaacggtttaaggacaaagtgcctccccaaatcaatgaagtcttcatagttcatgaagaatattggtatacattatttaacttgagcctcaaaacagtcctagtaggaaggcatttttatccctgatgtatagaggaggagagtaatgaaacctaacgagtaggacctttgatttatatggaccagtggctgagtggcaagattcaagcacacaaacaaaaatccgacaacagggtgaaaacagaacctgccctgcaggagtgctgcctcaatccaggaagctgatggacgtgcatcccagaccacattacctggtagataattgtcatcctaaagagatggttattaaaaaagagcacattttagaaagtaatggcttgtaagaaccaaaatggatgaaaacaatcgttaggatacaagagacgtaatgaaatatgcagtaaagtaggcagaaaggagtatcagccttagatgtcaaacagtattcacagatccagtgtgtctcaatttattaagctcaaatttattcattgcttccttagcgtttcattaaatacttaataggtatgatgtattgggctagttgcaggcaatatgcagtaggcaaataaaatatggtccaaaccctcaatgtgcttagacattagaaaagagaggagataaatgaacaaataagcacaatgcagagtgttgtgatggtaaataagcaacgtttttaatcataaacatccttcattagagaactttcattcttaataaggaaaggaaacttttcaatacaagaaaggaatatgccagatctagaaacatacttagtttgaaatttatactttaaaaggaatcgtgtaaagaaagaggtgggaaaatctacttggcaatttgactgcttgacaggattacagctcatcttgctgcttctaattaataatgcattttgctatattattagacacttagatgtgtttccctggcagcacttgtaactgagttctcacaggcctcttatggtgagaaaagaataaaagatagctaaggtaaatatagtctgttttatgctgtaatgctgtctgatagcaccccagccccttggtgattcatatgcaagttacatcccaggcaattcaatctaaaattggagtgcatgtgctagcacagtttttatgtctcagtttggcagtttctatctagaggtgccacaaattaatgttattatcagcttaaaagtttggtgaaaagtgttatacattcttattctttgaaaggtgagagagagaaaataagattccgaggttttgtgtacaggaaaaaacttggaagctactaggtaccaggcacggtgaatagtcattttgcttttcttatctcatttaagtttcacaataaatatgtaaagaagttattattaagtatatttttttagtcttgaaaaaactggattcagagagattaaaaacttgtccaaactcaaagagctaagaaaccatgctgagactaaaactaaactttctgactccaaaagtcaccctttcccataaatcaaatgagagttttgctttaattgcacctgtttttttcaatcacatgcacagagggtagcctctgacattgaggggatacttgcatgactaatgctgattttcttgataaatctttaaatagctattttcaacattcaaatgatatcatgaagatggttgcggtcatcatcttaaggatatgcaagttagaaaattctttctatgcaatattcaagcagcattgatatgtacattccaagaaaaaaaatcataaaggcttaattttaaaagagattactgtcatcaccgaaaggcagagaaactgttcaggtaacactgaaatgaatcatcattcaaataacaagacgacattcagaaatcatcagagcatctcttgcttgctagcatctcttgcttgctagcatctcttgtccagagtagtctcttgcccactgaaacatcatcaatgatctatgtttccccggcctagagctcctacctgaactccagacctaaactgtgcaatactaccacatatcagaaccaccatttattgtacgctattttttttgccagttattgtgctgagatatgcaatatgttaccatcattcatcctcaataactctttagggtaggtaacctgaatctcatttttctgtaatgttttctttcctgaatgtaattgttacttccctgaagttacaaatctaaaaagtgatggagccagtcagcaattcaagcccaggtctttctgatcctaaggctaattcctgttcctccagtcatcaccgcctctcagtataagccctgattcccacttgcggtcctgatgttcctttaatgtttttcatgtctagagctgagtacatttttttccctcacttgacatctctgctttctttccatcctatattctttatcagaatgaatggcatcacttctcaactgtaatataattggatgctcacttgtccgtctcttacactaaactatcaattacctgtgtgtgcccagaacctatcacagagcctgaaaaatagtgtaaaactcacttaatgtataagtatttgctaaataaatgatgtcacccagttaccttagtcagaaccctagaagtcacctgagattccctcctgtccttcagcccccactaccagttggtaaccaagtccagtctgttctattctaaatgcctcatgaagctgtcctcattcttgcctggatttagttaccttctgcaagatggaaactccttgtctccaaggtaactcacgtccataacattgcttaccaaatatgattagagctaaaacctctttaggaactcctatgtctctagcatgatgaatatgtctctccaaatgtcttagttttgtttaccagtctaatctcattatttgttcactctctaatgttcctccctctctccatccctgtctctctcactcagacacatttacaaggcctttaaattcacatggcctctttccagtgtgcagtttacactgtcctttttcaatttattcacttcagaaattactaattacaagaccagtcaagagttaagcatttatcatccctttaaagtcacagtcttccagtatttgtacctccacagagaacttctaatcattaatatatgtgtaactaatttcatacattccaaatatggaaacttctggattggacaaattatcacctagtattttatctgtttttattttgtaattcagataatctgattcttataactaggaagcatttgtaggaaaaaagtgtatgtgatattaatcaagttttttttcttgcatttctattttgtctggagcaaacagtagctcaagtgagcacttaaaaatggcccagaaaacaaatgatcgaagtcttggcttttgagttccaaaataaagtcctaaaatttacagaactgataaaggtcttaaaagccttttatttgcaagtgaaaagttttctctactttaaaatggttgtcttaaaaaaaacgcataaaattgtcattaggaaaattaattttaaaaagatctcaaataataaggagatatattactacaaagtagtctttactaaatttttttaaacattttgtcttttgcaaagtaaattttaagtttttttcctctaggtcatagttattcatttatctttctagtttttctactttattttgccaatagaactttagaaaacaattcatcagaaaaatctactttgctttgatagagatcctagcactctttaaaaaactgcttctataaatacacctgcctcttccaattctgtactattccttgttagatttcccctaactgaaatttctcctcatccctctttgcttaaataaattctgttcctccccaaatatccatctcaaatcccatcatgttttcccaaagtcctccttgatcactctgagttaggaaactatctgtctttcatctctgaatgcatggagcaagcattatcaatgcagttcatgggccatgaatctcatattgttttgtcataattcttccttcgtgaactactttataatatttttattatcacattcttttcaagaatagtactcttaattctgcaaatagattctaaatttttggaaagaactgactgtgttatttatctttatattcaccagagaccacatcaatggtttgccaggagtaagtgctataagcacatttgatacagtattgtatcctttagtgatgacaacaatatggtaataattatatcacttattaagcatttactatataccaagcactgtgcaaatcacttcatgtggattatcacatttcattctcataacaaaccaataaattctgttctattactacctttaatgtatagctgataaaactaagactttagaggtgttaagtactttattccaggccacacagctacaagtggaaaacccagaacttagtttggtcctccatactaaatttttacttgtaggaatctagtacatcctcaggtagacaaattttattatctgtttcttgatgtcattgttttaggaaaagcattccttaccaataacaaatctacattcaagtaactatgtcacccaagagcaaagagaaggctttctgatgtaggtttcataaagtaaaaaaatggatgatgttgaagttggctcacggttttaatgaagtaatatacattttaagggaaaaactaaatcacactagaagaaaatataatgcatcagaactctacaacaaataatgatgatttcataaacactagacaaagatttctgcatatcagagctagcaatgatcctgagaaacaactaggcagttaaaaagtacaacatggtatgaaagaattattatcgagtaaatcactaagacagagtaagtgtttctgaaaaatcttccagtagaatctagaattggcaaaatcatctacacgtgaatcataaataatacaaggacaaagagattataaagtactttaagtacagtacctctgctcttgatttactgcttctgaaaaacaaagaacccttacaaacaaagggagtatggcatgtttgaggaattgtaaataggatgtctaataagtcattgctaacttaatgtgtacaaaaatgaatttttgatctttgccaaaacctatttctctacagtttttttcatctgaagaaacattatctaccagtgatttgggccatgaactttgatattttcctgaactctgctcttcctgtcttgccccatatgcaattaatcagtaaatcttgtcatctcttcctttgacatacatcctgaatcctatcacttttcacagcttgacccacccccgagccactgtcttactgtggctggaccactgcaataggctcctacctggccttccacctcctacttgccaatcttccccaacatcatgcatactcaggtacacacaattcagagtgttcatttgaaaatgtgttagattatattagccttcaaaattttccagtgatttctgtctcattcaaggaaaaaaatcaaaaatccttaccacagtcaactgggtctatcagcacctcacctccccttgcaaccgccacctaattagtcttatctcccaccactctctcctgctccaacactaccaaaaacaacccgtcccccttccctctattccgaacactggggcctcctttttcttccatgaactaatcattttcttttttttttttaattatactttaagttctagggtacatgtgcacaacctgtaggtttgttacatatgtatacatgtgccatgttggtgtgctacacccattaaattgtcgtttacattaggtatatctcctaatgctatccctcccctctcccccaaccccatgacaggtcctagtgtgtgatgttccccaccctgagtacatgtgttctcattgttcaattcccacctatgggtgacaacatgcggtgtttggttttctgtccttgcgatagtttgctcagaatgatggtttccagcttcatccgtgtcctacaaaggacatgacctcatccttttttatggctgcatagtattccatggtgtatatgtgccacattttcttactccagtctgtcattgatggacatttgggttggttccatctttgctattgtgaatagtgccgcaataaacatacatgtgcatgtgtctttatatgggcatgatttataatcctttgggtatataccaagtaatgggatggctgggtcaaatggtatttctagttctagatccttgaggaattgccacactgtcttccacaatggttgaactaggttacaggcccaccaacagggcaaaagtgttcctatttctccacatcctctccggtacctgttgtttcctgactttttaataatagccattctaactggtgtgagatggaatctcattgtggttttgatttgcatttctctgatgaccagtgatgatgaacattttctcatgtgtctattggctgcataaatgtcttgttctgagaagtgtctgttcatatcctttgcccactttttgatggggttgtttgattttttcttgtaaatttgtttaagttctttgtagattctggatagcagccctttgtcagatgggtagattgcaaaaattttctcccattctgtaggttgcctgttcactctgatggtagtttcttttgctctgcagaagctctttagtttaattagatcccatttgttaattttggcttttgttgcctttgcttttggtgttttagtcatgaagtccttgcccatgtctatgtcctgaatggtatttcctaggttttcttctagggtttttatggttttaggtctaacatttaagtctttaatccatcttgaattaatttttgtataaggtgtaaggaagggatccagtttcagctttctgcttatggctagcccgttttcccagcaccatttattaaatagggaatcctttctccatttcttggttttgtcaggtttgttaaagatcagttggttgtagatgtgtggtattatatctgagggctgtgttctgttccattggtctatgtatctgttttggtaccagtaccatgctgttttggttactatagccttgtagtatagtttgaactcaggtagcatgatgcctctagctttgttcttttggcttaggattttattggcactgtgggctcttttttggttccatatgaactttaaaggagttttttccaattatgtgaagaaagtgattgctagcttgatggcaatggcatggaatctataaattgccttgggcagtatggccattttcacgatattgattcttcatatccatgtacatggaatgttcttccatttgtttgtgtcctcttttatttcgttggcagtggtttgtagttctccttgaagaggtccttcatatcccttgtaagttggattcctaggtattttattctctttgaagcaattgtgaatgggagttcactcatgacttggctctctgtttgtctgttttgtgtataggaatgcttgtgattttggcacattgattttgtatcctgagactttgctgaagttgcttatcaacttaaggagatttggggctgagacaatggggttttataaatatacaatcatgtcatctgcaaacaggaacaatgtgacttcctcttttcctaattgaataccctttatttctttctcctgtctgattttaccctggccagaacttccaacactatgttgaataggagtggtgagagagggcatccctgtcttgtgccagttttcaaagggaatgcttccagtttttgcccattcagtattatattggctgtgggtttgtcataaatagctcttattattttgagatacgtcccatcaatacctagtttattgagagtttttagcatgaatggctgttgaattttgtcaaaggccttttctacatctattgagataatcatgtggtttttgtctttgcttctgtttatatgctggattaagtttattgatttgcatatgttgaaccagccttgcatcccaggagtgaagccaacttgatcatggtggataagctttttgatgtgctgctggattcagtttgccagtattttattgaggatttttgcatcgatgatcatcagggatattggtctaaaattctctttttttgttgtgtctctgccacgctttggtatcaggaggatgctggcctcataaaatgagttagggaggattccctctttttctattgattggaatagtttcagaaggaatggtaccacctcctctgtgggatcggtggtgatatccccttcatcattttttattgtgtctatttgattcttctctcttttcttctttattagtcttactagcagtctatcaattttgttgatcttttcaaaaaaccagttcctggattcactgattttttgaagggttttttgtgtctctatctctttcagttctgctctgatcttagttatttcttgccttctgctagcttttgaatgtgtttgctcttgtttctctagttcttttaattgtgatgttagggtatcaattttttatctttcctgctttctcttgcgggcatttagtgctataaatttccctctacacactgctttgaatgcgccccagagattctggtatgttgtgtctttgttctcgttggtttcaaagaacatctttatttctgccttcatttcattatgtacccagtagtcattcaggagcaggttgttcagtttccatgcagttgagtggttttgagtgagtttcttaatcctgagttctagtttgattgcactgtggtctgagagacagtttgttataatttctgctcttttgcatttgctgaggagagctttacttccaactaagtggtcaattttggaataagtgtgatgtggtgctgagaagaatgtatattctgttcatttggggtagcgagttctgtagatgtctattaggtccacttggtgcagagctgagttcaattcctggatatccttgttaacttggtcttgttgatctgtctaatgttgacagtggggtgttaaagtctcccattattattgtgtgggagtctaagtctctttgtaggtctctaagggcttgctttatgaatctgggtgctcctctattgggtgcatatatatttaggatagttagctcttcttcttgaattgatccctttaccattatgtaatggccttctttgtctcttctgatctttgttggtttaaaatctgttttatcagagactaggattacaacctctgctttttttgttttccatttgcttggtagatcttcttccatccctttattttgagcctatgtgtgtctctgcatgtgagatgggtttcctgaatacagcacactgatgggtcttgactctttatccaatttgccagtctgtgtctcttaattggagcatttagctgatttaaggttaacatttaaggttaatattgttatgtgtgactttgatcctgtcattatgatgttagctggttattttgctcattaggtgatgcactttctttctagcatcaatggtctttacaatttggcatgtttttgcagtggcttgtactggttgttcctttccatgtttagtgcttccttcaggagctcttgtaaggcaggcctggtggtgacaaaatctctcagcatttgcttgtctgtaaaggatttcatttctccttcacttatgaagcttagtttggctggatatgaaattctgagttgaaaatttttttctttaagaatgttgagtattggccctcactctcttctggcttgtagagtttctgctgagagatctgctgttagtctgatggcattctctttgtcgtaacccaatatttctctctggctgcccttaacattttttccttcatttcaactttggtgaatctgacaatgatgtgtcttgaagttgctcttctcgaggagtatctttgtgtcattatctgtatttcctgaatttgaatgttggcctgccttgctaggttcgggaagttctcctggataatatcctgaagaccattttccaacttagttccattctccccatcactttcaggtaccccaattagacgtagattttgtctgttcacattgtcccatatttcttggaggctttgtttgtttctttttactcttttttctctaaacttctcttctcacttcatttcattgatttgatcttcaatcactgataccctttcttccatgtgatcaaatcggctactgaagcttgtgcatgcatcacatagttcttgtgccgtggttttcagctccatcagatcatttaaggacttctctacactgtttattctagttagccattcgtctaatcttttttcaaggtttttagcttccttgtgatgggtttgaacatcctcctttagcttagagaagtttgttattaccgatcgtctgaagccttcttctctcaactcatcaaagtcattctccatccagctttgttctgttgctggtgaggagctgcattcctttggaggagaagaggcactctgatttttagaattttcagcttttctgctctggtttctccctatctttgtggttttatctacctttgatctttgatgatggtgacatacagatcgtgttttcatgtggatgtcctttctgtttgttagttttccttctaacagtcaggaccctcagctgcaggtctgttggagtttgctggaggtccactccagaccctgtttgcctgggtatcaccagcggaggctgcagaacagcaaatactgcagaatggcaaatgttgctgcctaatccttcctctggaagcttcatctcagaggggcacctggctgtatgaggtgtcagttggcccctactgggaggtgtctcccagttaggctactcgggggtcagggacccacttgaggaggcagtctgtccattctcagatctcaaactccatgctgggagatccactactctcatcaaagctgtcagacagggatgtttaagtctgcagaagtttctgctgcattttgttcagctatgccctgccccagaggtggtgtctacagaggcaggcaggcctccttgagctgtgttgggctccacccagttcgagcttcctggccgcttttttttttacctcctcaagcctcagcaatggcagacgcccctcccccagcctcgctgccaccttgcagttagatctcatactgctgtggtagcagtgagtgaggctccatgggcgtgggaccctccgagccaggcatgggatataatctcctggtgtgccatttgctaagaccgttggaaaagcacagtattagggtaggagtgtctcgattttccaggtaccatctgccatggcttcccttggctaggaaagggaattcctcgccccttgcacttctcaggtaaggcaatgcccctccctgctctgtgggctgcagccactgtccggcaagccccagtgagatgatcctggtacctcagctggaaatgcagaaatcacccatcttctgtgtcgctcaagctgggagctgtagactggagctgttcctatttggccatcttggaacttccccaaactcatcattttcttccctctctaccacaaggcatttgcacttgccaatccctgtgcctgcaatgctctcagttcagttctctgctcatatgccttagggagacattctctgatcaccctatataatatagcaacattgccactgccatctttttctatcttccatgccttattattcttcaaggcactcatcactcccaacacgttattttttattttctgtcaatctctattagatacaatctccccaagaacaagactttgttgagaagtatgcaaaatgaccagctaagtgtgtgtttaaaaaatagccttagctcccaaaatactaggaaaaccctgtaaaaagagcatagattttgtttatccagatttggatttttacttgtattctataacttttttccaggaaatcttactgtgtatatgtgagatttataatatagtataagatataagtagatcataaaagtcactacaatgaaactaattaatcatctcagatagttacatttttttgtgactagagcagctaaaaatctactgatttaacaaaagtctctattataattttattaactatagttctcacattgcactaatgatctccagacatgtccattctacatatctcctactttgtatcctttgaactatatcttcccatttcatctctgcctccccatgctcctgatagccactcttttattctatatctccatctatttgaacttaaaaaaaaaaattccacatatgctaagtgaaataagccaaacccagaaagaaaaatgttgcacaatctcatgtatatgtggaatgtaacacttttttacccttgccaaatttagggaaattaatgcctgtgagcctccattttcttatcactagaaaagaaaggaagtatgaaggatgtaatgaactgggactgatgaggacaaaggctagggattaaaagtaggaatcatggttaaaattaattcacagagttgtgttaaccaaaaataaaattctaaggcccccgcaactatctgaatggaccactcttggccaagggcattccaaagttaacctgaaaaaactagttcaagccacaacaggaactgggagctacacatgcctcattataccctcttcccttttggaattactgatagaacagactcttttagtctgataagaaatatttacagtctattctctatgaagcctgctacctagaggtttcatctgcttgataaaacattggtttccacaaccccttatcataacccagataatcctttctattgataataaatctttcaaccaattgccaataagaaaatttttaaatctacctatgacctataattcccccacttcaacctgccctgcctttctgaaccaaaccaatgtacatcttatgtgtatcaattgatgtctcaggtcccctaaaatgtacaaaaccaacctgtatcccgaccaccttgggcacatgtcatcaagacctcctgaggctgcatcacaggcatgtccttaactttggcaaaataaactttctaaattgattgagaacggtctcagatactcttgggttcacagttgctatagtaatattgttctcagtaacatatgtaaagtatctaacaaactaaccagcctattatggccttcaataaatgttcacaaaaacacatttttgtttctattgttcccattctattttctgtaaaaggaaaattgcagctgcctagagagtgtgatcactcaatactgtcatctgacaggtaccaaacacaatattgtttagtctgaaaagtgaaaaagaaacaaatacaggcctcttagtttacattttaaaaaataatcatgttagatgttcatctatacctggggttgtgtagaaaatataaaataacctcatacaaaccaagattagtatgggcttcattatgttctggactaaatcttcacacccatatcacacctagactatgttgaggtgtttcaaggaccaattttcaggataattttatttctgtaaatatgtttatgtggatagtatctactttagtacataatatttcctggaagctctgattatttagaaagaaatgagtagacactgggtcaataagcccaggttagtgtctttttacaactaatgttttaagtatctttgatcattttctgataacaattcaaattaaatgcaaacagtcatgtagcacacaacacccattatcaagtatttctgccagctgagaggataaataatgtaatgagacacattaattatttgctttctaccagctctaattgattaattttgactggtacatcttgctaatgtaatggagtacagtaaatattagggcttgttatttgttccagggctaggaaatcacggtctccaatgacttgccccatttgtagctttatctgcaatctgccaaagtgtattgatagagccaagttaatctctttaccaagtgaatttccatgtaaatatcacactaggagacccattatcaagtcaggtgagttcactgagttttctgtctcagaaaacttgacacacacaaccccccaacccccagttttatatacagccaaacccatgaaggtaaaaataaatcctagctacatatgtacatagttatcttcctacttaagaatatatcattaaaccatggttgttgttctaagtaaccaaatacctttatgtaagcccatgagtggttgtaccagaaatactgaaaatacttccagtattagatttgaaagccttgaacaaaatgtgaagagttttaaatcacagccatttacaggaaattaccaccagagcagtgtttctccaactttttattgtccccctaaggagttttttaagtgttttttccctaattgccatttccccttgaaattttaatatcatggatatactgtatgtctggttatgttctatggccctttgaagggccacaaaccattgtaacatctaaggatttgttttgttttgttttgttttgtttacttttccaagaaccagtttttacttcctgggggcagtatcactccctttgagaatgcatttactagagccttcattctactgactcttcatcattgtctaagttacatattctcattcagatacatcaacctctctatatctcatatttctcatatgagctggtgaaataggcacacacaaacccccatgtctaagtccaccccacaacaacacatctagtacaaatgcactttatcccttttcttcaccccgccagcccccaccaattaatgcatgctgaatcaggctcaagcaacattaaggcaatcttgaaaaaagaaagaaatctcaaaagaaccatacaaattgttctttgcagaaagactgaatgaatttcaacctgcaatctacatactttagtgaagtactttacttttctgagctttagtgtccatatttattaaagggaaatatcaatagttatctcttacctattcaaccaacaaatatgtgctagctcagtttgaaagtcctcatggagacaactagaagcacttactgatcaagaaaaggtgaggttcttaaagttactgcaatgcagcaagcaaaaatattatctttacaaagtcttagaatatccaaagaaagaaaatttaaaaagggtatatagggtcatagaacctattctgaatgattttgaggttgtattagttcattttaatgttgctgataaagacatacctgagactgggcaatttacaaaagaaagaggtttaatcggacttacaattccacatagctggggaggcctcataatcatggcagaaggcaaggagaagcaagtcacattttacatggatggcagcaggcaaagagagagaacttgtgcaggggaactcctctttttaaaaccatcagatctcgagagacttattcaccatcacgagaacagcacagaaaagactcgccccatgattcaattacctcccaccaggtccctcccacaacatgtgggaactcaagatgagatttgggtggggacacagccaaaacatatctttccacccctggcccctcccaaatttcacgtcctcaaatttcaaaaccaatcatgtcttcccaccagttcctcaaaatcttaattcatttcagcattaactcataaggccacagtccaaagtctcatccaagacaagtaccttccacttatgagcctgtaaaatcaaaagcagattaattacttcctagatacaatgggcgtagtacaggcattgagtaaatacagccattccaaatgggagaaaccagccaaaacaaaggggctacaggccccgtgcaagtctgaaatccagcaggacagtcaagccttaaagttctaaaatgatctccttcgactccatgtctcacatctaggtcacattgatgcaagaggtgggttcccatggtcttgggcagctccacccctgtggctttgtaggttacagcctccctccctgctgctttcacaaactggcgttgagggtctgcagcttttccaggcacatagtgcaagctgtcagtggatctaccattctggggtctggaagacagtggccctcttctcgcagctacgctaggcagtgtcccagtaaggactctgtgtggggttctgaccccacattacccttctgcactgccctagcagaggttctccatgagggcccacccctgcggcaaacttttgcctgggcatacaggcatttccatatatcttctgaaatctaggcaaagatggccaaacctcagttattgacttctatgcagggaactacaggctcaacaccacatggaagctgccaagccttggggctttcaccctctgaagcaacagctagggctgtaccttggccactttagtcacagctggagtggctgggatgcagggcatcaagtgcctatactgcacacagcatggggacctgaggcctggcccacgaaaccattttctcctagacttctgggtctgtgatgggaggggctgccatgaagacctctgacatgtcctagagacattttccccactgtcttggggattaacatttggctcctcgtaacttatgcaaacttctgcagctgacttaaatttctcctcagaaagtgggattttcttttgtatcatattgtcaggttgcaaattttcctaacttttatgctctgctccacttataaaacagagtgcccttaacagcacccaagtcatctcttgaatgctttgcttcttagaaacttaatccaccagataccctaaatcaactctctcaagttcaaagttccacaaatctctagggcaggagcaaaatgccaccagtctctttgctaaaagataacaagagtcacatttgctccagttcccaacaagttcctcatctccatctgagaccacctcagcctggatcttattgttccacagtttcaggtatcttttcagcagctccccattcctagtaccaatttactgtattagtccattttcacactgctgataatgactacctgagactgggcaatttacaaaagaaagtggtttaattggacttacagttccacatggctggagaggactcacaatcatggcagaaggcaaggaggagcacgtcacaaattgcatggatggtggcaggcaaagagagagaacttgtgcaggggagctcctcattttaaaaccatcagaaaggatccctgagaatattcactagtttccaatgttagggcttgaaggtaaaagtagggttgaggtagtttagcccattttcattgactttggagggatttgtagattgtgtctcagataatgttaagacccagtgaggtactgcagcagtctttcaaaaaattttcaggaagaccctgtctcacccttgagtttgtgagggcaaatgtgagatcaaggagtaaaagctatcaaggttataatctaaaaatgattaatctacttaaaccaaattgtctaggattataatcagcagaaatctatgccctggtttttgtaaatgttgcatcttagtaggtttgaatatcagagattcatgttaagaattatgcctggctgggtgcagtggctcacacctgtaatcccaacactttgggaggctgaggcgggtggatcacctgaggtcgggagttcaagaccagcctgaccaacatggagaaaccccatctccacctaaaatacaaaattagccaggcgttgtggcacatgcctgtaatcctagctacttgcgaggctgaggcaggagaattgcttgaacctgggaggtggagattgtggtgagccgagattgcttcattgcactccagcctgggcaacaagagcaaaactccatctatttaaaaaaaaaaaaaatcatgcctgtgtgatttccttgatacaagcctttggataccaaagggcctgactcctacactgcccctgcaggcaagccacatcatcaggagttgcaacctagaatttttgaagtagtaaaaattaaattattgaagaattattatggtagcaaaagttaaataaatctgctcagaaaactcaaacaggtccaggaaaataaggcagtttaactgatggaattatggttttggctctatgtggctcagctttgacagatcctcagcacagatcctccatgagccaacaactcctactaaattcttccctctcctatctcaaatcaggcaggtccacatgcatacttctcccttcctgatgaaaactggcttcgtctccagcatacccattttagaaatcgccatcacacaaggctcaccaggtaaacctgcactaatctgtcttgaaagcttaggcccatcacttactaatgttatgaccctaagtcagccctttacatttttggtgcttgatttttctcacctatgaaatagaggtaacaatagtatctaacttgtacaattgttctgagatttaagtgagaaaatgcatgaaatgagtgtagcatagtaacgaaaaaatagagaactataaattttagctatattgttattaccattccttcaacacatctctccaatttgtctctcctcaattgctcctgactccaacagaatcgtgacttttgtcacctcacaccttttattttaacagttttctcactgcttttcttaccccttcgttttccctcttcttaatcttaaacataagtaataaagtattccctgctccaaattcccatcatatcaacttcctggcttatacacattcttctacccctctttcgaggttttttgtagactgaatgcactaaactaaactaagaacattgttaattcacaagtattggattcattttggtagctttcagctgtaaccaatggttagaagaagatgtatcctgtgggtcttctctcccacagcctggccactcagaatacaccaatgtgaaagcaagactcagagctgactctgctacttatgcaaatagtcactttacccctaaattgccataccaccagttctttaagctccatgaaggctcatctctcttagcttttcaggtgtcccaacagtggttgctctggtttgaatgtttgcgccccacaaaattcatatgttgaaatcctaacccctaaggtgatggcattaggaagtggggccttttgggagtcagtaaggccttaggcaaagccctcataggtgagattggtgcttatataaaagagaccccagaaagcttccttgctcctcccaccacgtgaggacacaggatgaaggcaccatccgtgagaaacggggccctcaccagatgccaaatctgtcagcaccttgatcttgtaccactcagactccagaactgtgagaaataagttctgttctttataagctacccaatttacagtattttcgtctaatatactttaattgaatggactaagatagtggcctgtgtggaaaattcacctgaagcagattctaatagaggaatttaactatccttctgttcagggtttcacaacaatatcctctgataaacaacagaacacaggaaagattcagaattctaacctatgatgcctttccaaaggatgtaatttcttgggcttactagattgctctgtcttgtttaagcaccagttcccaagcccatacaaatttctagcctgatcagccctcatttcacagattaaaagtaatatctaacacccattatactaattaataaggcaactgatattaattaaaataaagacattgaaaccttctgaatgcccaggcctctggtctttgggcctctacttagaaattttcatgtactaactaatcatccctggagtgcatattcctgattaaggtacctaacatgttaactaacggactttaaagtatagattaagttgactaccaccttctatgctgggtgttttaatagtaaactgcaggccaggcacggtggctcacacctgtaatgccggcactctgggaaactgaggcgggtagttttcttgaacttaagagttcaagaccagcctgggcaacatagcaaaaaccctgtctctacaaaaaatccaaaaattacccaggcacagtggctcacgcctgtagtcccagcattttgggaggctgaggcaggtggatcacttgaggtcaggagttcaagaccagcctggccaacatggtgaaactacgtctctactaaaaatacaaaaaaaaaaaaaaaattggccaagtgtggtggcacgtgcctgtaatcccagctgcttgggaggctgaggcaggagagtcacttgaacccaggaggcggaggttgcagtgtgctgagatcgagccaaggcactccagcatgggcgacagagcaagacttcatctcaaaaaaaaaaaaaaaaatagctgggcatggtggcatgagcctgtattcccagctacttgggctgaagaggggagaatcacttgagccagggaagttaattaaggttgtggttagccaagatcgtaccactgtactccagcctgggcaaaagagtgagatctgtctcaaaaaactccaaaaactgcagaatataatatctaactttacctccccctatttcccaacacacacattcatctagagcagagtttctcaatctgggcactactgatcttttggactggataatcctctgttgtgaagggatgacctgtgcattataaggtgttagcacactgctggtgtctatccatgagatgccagtagcatccctccccagttgtgataagcaaaacgtctacagacattgacaagtatcacatgctcttaaaatcaccccttgttgaacattattgccctacagtgtggctgaccccctaaagccaaccccacttaccaggatatttttctttcttaattttacttatagtggtccccagtcttagaagataccttctccactgcgctactcaaatgtgacccatgctttaagacaagacagcaccaagaatttcaaaaagcaaatgaagctctcagaagtgatttatttggaccacgtaaatgtgggctacagatttctgtagacctcacagctctagggtattacactttctcattcttcctacttatctcatttatgttatctgcctggccctatgagaatttacattaatacttaataataagttttaattcataataagcctaataagcttcataataagcctaataagcttcataataagcctaaatcatccttccaagaaattgtccactgtgatgtccatattgacctcttccttttcaggagaagttttatgctatgaagaaaactaaaaaaattcaacacaactcgagtactaaaatttctcacaacttaatggctcctgttaagagaagcaaagtattaaaacagtgtactaaagtcagctgttctttaaaatagtcacagaaattatgttatcagactggcaaaaaaaaaaaaaaaaaaaatgctcacctgggtcaatatgagccatcctgcaatttttgaaagaccaaagaccacataaaacagagctttttttttttttgctgtgtcacccaggctgcagtgcagtgatgcaatctgggctgcaacttcgcctcctgggctcaagcagtcctcccacctcagcctcctgagtagctgcgaccacaggcgcatgccaccacgttcagctaatttttatatttttagtagagacggagtttcgccatgtcgcccgggctggtctcgaactcttgggctcaagcgatccacctgcctcagcctcccatagtgctgggattacaggcatcagccaccgcatccagccaaagacaaggttcttaacaagtattgtgtgagtgttcttttacaaagcagatataaacctgtgtgtaataggcaaagggtatataaaggtgatgatttttctgtgaactactaactctttttttttctaactctctttagtccctaaaaataaaccctatcatattaaatcaagaacatcataagtaaatgttggcaaaatacagttaggtgaacagtggctgttctcaaaaaggctcaataaacatagtagaagttataacaaattaatgataaataaagcacagtgaaaatgtagtgatatatctgtgcatatttataaatgtgtgttaaattatttaaaagagattctacctgagtctagtttataacatgtaagattttagttttctctaaaatacaattgagataaaaatttagcaatactttattaagatatgaccttcatatttattttatctcaaaagttttttaacaggacaaaaagcactttccaaactgaattatatatattaggaaagtccatatatgtgtgaagatctttattaactatcaggatttttgtaaatataaattatgtccattgattatctcactcctttagttttccaactgaaatagttctacttctccttttttctatgattatatcaaacactttacagtgcttcagcaaagctatacaccccctgccccaaaaggagaaaatttccttttagataatatggcatttttcaaaagaaaagggaaggacaaaagaacttaatacttatcatgtgcctactgtgttcagttctatgtaagacaccttcaaaaatttttataaccttacaataatcatcagagagaggcagtattacattcagtttatagatagaaaaatgacgtctcagagaatttaagaatattgtctaatctcttaaatggaaaatgtggaattcaactgaagcatatctgactccagtctttggtttttgaactattcataccggtcatcagttttctccttctttgcaaaagaatcttgcctatagtggtcagtcgggtccacttagttcagttatctgtatattaaataataccccaaatattcccttttccagcattttatgagatacccaaaactttaattgataatgaaaataataaataatcctaagtattaataagttacatattgatatgtttagaaatatttctatatatatgaatgcattaaacaaataggtcatatgcatagcattcatgataagtatttggtagataaaaatgaggatctgaataaacttccatgtccttctcacagtggaactggtaaaacactttagctggtaaaacagtaactggtaaaacacttagccatactaatggctaataaaatagtctgttctggtgtgaatttctcttttatttagcatcttgtttttctttagtgggtaattcactggttttgtgcaatcctaatctactatgaacattgatttcttgagtatccagatattattttcagaatctagtttttcacatgctgaaagttcaagtttgagatccatcactacatggcaataatatttactcatgatgaaaatatttgccagtcactatgttaaatatcttgcatttactgtcttatatcctatttacaaaaccttgcaaggtagatatttttacttccttttgtagttgaaaaaactcaagcttatggggattttgtaaattctaaactcacacagttgggaaatggtgaactgtaattcagatgcagactgtctaattctaagctgcatactcacccaccttacagctgaggagggaatgttgttctaataacaagccttgcaaaatgtcagctgcatgctttacatgctaaccaagattacattcttcctctgtttatgtggttttctgagctctgggtaaggcaactattctctgtgccacaaaaaaagtgttttattcagttttttctggaggaaataaggctaatgctgttttctatggagaaaagcataatttccaaattaatgattaacttgaaaatggatgattcattgggcaagcatttcctataccacagcattacatgttttccaattatagtgctcaggggaggttcttagttaattcttagttctatctaaatagaagttatatttttattaatttatcagttttatcaatgtatatattttatacaatttatatatttaattaagtactacaacttacatagctaacatcaccttaagagcataatataaaataattttagctgtataaaataaattaactgagttacatagaacttaatttcaccttaagtccaacttgtcctaaattgaaggatattaaagagccctaaaaatgctttaagtggtgatttgaacttctaatggaaaatgttataatttgcatactgaaaaatatctcattgtacaaggatagtttctgtgacctcttttcaatatgctatattgagtttctcaagaaaaagggggaagaaggattttgctaatctgtctctatatctcacctggttcctgctgaaagcaatgacaggcacttgtaaaaatataatcctaaaatattatgaagctagctggcctacctgagctccaattcacaaactcaattttctcaacaccttctaaaaccaactatactagctaattttcaaagcaaggaaaatttagtctgacagtctatatgcctagaggaatcatcatgcaataattattgggtttgtagtacaaatttacccagtggatattgggtcaatttttcttttctaaatatttataaaggagtatgttagaagtcacatataagggatttatcataatacaacatttaatagacatgtgggcatgctttagccaaaatgaacatacttggctagggatgaatacatctactatttacagttaaatatttcctctacctggagagattcctgtgctggaaggcattttagaacatacagtattaatattatttctaaaaatagggtgagtagagtgacaatcttctaaaatccctgccaggaagaagagaaatgctaaatatagattgaggaatcccatcttatttgggagattaaatcatatctgtataaattattggaggcctagcaactttccaacacaagctagttaattgttacattttcaaattctatacttcctgtgtgttactttgtaatgcacttttgtaatcacggtatctttcacaaccttttccaagttccaaaccacttctatttacataacttgataaagatcagtaaaactgactcactagctaaaagagataatcatagggtaataggcaaaacaagataaaaagcagaaattcagtgtattctaataaaaaagaaagaatgctcgtctttggtttcaaagcactaaattcaagtgtcatatagcataaatttaatacttaatgttctcctataactttacattgtctttctcatgcatgaatatatgtcatctttatagccttccttgaggagagtattattgttatatctattttataaaggagtaaacaataattaaaagaattgaagtggttcaggcatggtagtttattgctgtaattcgagcactttgggaggctgaggcaggcggatcacttgaggtcaagagttcaagaccagcccagccaacatggtcacttgaggtcaagagttcaagacaagcccagccaacatggtgaaacctagtctctactaaaaaatacaaaaattagctgggtaaggtggcaggcacctgtaatcccagctatttgggaggctgaggcaggagaatcgcttgaacccgggtggcagaggttgcagtgagccaagatcataccaccacactccagcctgggcaacagagtgagaccctgtcttaaaaaaagaattgaagtgtttcacaggaattaaactcaggtcccagactagatcctttgcactttctaaggcaagccccatcaaaaagccccatcaaaaaggagcataaagcattgcttaagaatggagataaatcaataaagacacaaatcaaattgcactttagggaacacagctgttgtattttatgattattttgtggttctataagacaagattatccccatatttcttcatatgccagtctaatagtaataagttttgcctgtttgattataattaattctattaaataatagatttcattccactctttatagatttctgtctcaatgataaacatgttaccctcatatttgaaagtttacaattgctgagtaatacagtaagtgatacattccaagacccccagtagatgtctgaaaacatagtaccaaatccaattgctgtcaatcaatcaaaacacatttctgttcatattttctacccacaaatttactgcctgttccatcttaactaagcacttatcatgcactatggctgcatgcactgcaaacttttgtagttttaggtgcgatagcacaactagcatgaatttctttcactttcgtcactatttcgcagatggaagatttgttcttagtaatcttagaaacctcagtatattattttgttttctttgcttattgagaacttttaccttttatcttaaaggaagcattttgcagcttatctttggcatatttgaattgtcagcatcactactcttgtgctttgggaccattatgaaataaaataaggctacttgaacacaagcactgggataccacgacagtcaatctgatagaccaaatggctaccaagtgactctctggtggttagcatatatggcatagatacactggacaaagggatgatttacaccctaaggagaacagagcagaatgacacaaaatttccaaatgccacttaagggcatacaatttgaaacttgaaagttatttctggaatctttccatttaatatttttggaccacagtcgaccacaggtaagtgaaatcatgaaaagcaaaaccacaggtgaaagagtgctactgtagtcattgaccatagaagaagcagaaaaacaaggcctgtcttaagatttttagcaaaaatctttttttatatatgcaatttttttgtatatgcaatgttttcgcaatttcaatatatgtaattctactctcccccatctctaggtgtattttagcaatagctatatcacaaggtctaaataaagtctaaatccatcaacaaaattaacacagtcatctatctgcctttttatttttataaaactgacatgatggaatttaggccttacacagagatttctggaatgccatgaacctaaacaatttgatctttaattgatactaacaggatgatgttgcagtaaaatgcagcatggattgactacttgttatttggttgttgttatgtcttttattgacataatggtacatatttggggagtatatgtgacatttttatacatgtacacaatacttaatgatcaaatcagggcaattgagatatccattgcctcaaatatttatcttttctttgtgtcgagaacattctgatttttctcttctagctatttagaaacatatgacaaattatagttaactataacctccctactatactatcaaatactagaacttattctttctatctaactcataaaaatgatattttgtacccattaaccaacttctcttcatcctcctacccctatcatttctagcctctggtaccactaatctacttcttaactttatgagatccactttttaaactcccacatataagtgaaaacctgtaacatttgtctttctgtgcccagcttatttctcttaacataatgacctcttgttacatccatgttgctgcaaatggcaagatttcactcctttttatatagctgaataatattccacttgcatatgtaccatgctttctgtattcattcatctgttgatgaacacttggatagattttatatcttggctcatgtgaatattgctgcaataaacatatacttaatttatttttgaaaatagatcagatggatctattctctttcacacctgaaacagtttgagtaagccacaaattagtactttgaaattacagtttgctcctttttaacctcttctgtattaacaacctcatctatattcctacaaactcatgtgtatgtatacacacacggaatctgattaattgtctaacaattttatctgaacctcagtacttttctttcttctttttgaacaatttcatctccaattgttaaatcttcaccatctacttttaaatctacatctcttgccttgtgtgatgattaactttctgtcaacttgaccgagccacaggatgcccagatatctggttaaatattatttctcagtgagtctgtgagagtgttttccataagagattcacatttgaattggtaaactgagtaaagcagatggccctcctcaaagtgggtgggcatcatccaacccatccagagcccaaatagaacaaaaagatagaggaaagttaaattcattctctctcattctctctctctctctctttgcctgactgcttgagctgagacatttgtctttgcctgcccttggactgggacttacaccatgagtgctcccagttctcaggcctttagactcagactggaatttacattcttggctttcctgagtctccagtttgcagatggcagatcatgggacctctcggactccataatcacatgagcgaattctttacaataaatctcattcaacacacacacatatgtgtatgtacatatatatacatatatatgtgtgtgtatatatatatacagagagagatcataggtaggtaggtaggtagatagagagatagatagaaagtagagagagagagagagagacagagataatagataggtaggtaggtagatagatagagagatagatagatagaaattagatgtatggatacagggaatgaatgtaatgccttgcaagatgaaggaaggaatctgagacaggtggtaaaacatatgtaataggaataataattagttcacagtagagaacaagggaaaatcaggagactattagataaagctgagaagttgttttgagtctatagggaaagctcttgaataccaaaataagatagttgaatattcaaacaagatatttgtatcttaccctttggatgttgggaccattgcaagttttggaaaaagtgaagtagccaaattttaatttatagaatgtaaccatgacatcatgaaggataaaggaatggggaagaggcctgcgctcaaggtggatgaatagtaggaaactcagtgaagtgagacgggaaatggtgagggctgaattagggaagtgacagtggaaatggtgagaaaatgaaggcaagcaaccctgtggaagtagaagtaatgagactggaaactgattagatgaggagagtgaaagaagggagagcagagaatttgaaattctgagatttcagacatgtgcagttgagactatgatagtgccataaaatgaaatgtgaaacacaggaggaagagtggatttggggaggagaggaggactttgattctggatatgagacatttgatctgcttctgggaatattcatgttatggaggtccagctgaaaactagacacatagatctggggttaaggagaatacataaagagtgtatgtgtgtgtgtgtgtgtgtgtgtgtgtgtgtgtgtgtgtgtgtgtgtgtgtgtgtttatatatatattcattttctcctaccctcacattttgaaaccctagctaactagaatgtcatctaagaaactctcctcaatttcttgagtcagaatgattgtctttttcctcttttcttcattactcttcatttacatctctgccatggtacctatttacatacaattttaaatgatatgaggtacagttcaattcacagacattcattgatgtcttcctctgtaccaggccagtactaggaggaaaaaaatgagtcagacaatgtctcgcctcaaaaatttacaaacgaaacactgaactatggcaggcagatttggcaccataaaaaagatacaaacaaggtgctgtgaaggcttaaatgaagtaaatctttattatgtctatcttttccacaaaaggtcaaaaaacatttctcattttctgtctctctctctcacacacaccccccccacaaccattgtgtatgtcacggtaaatattttttgatgctaattctttaactcagtaagtcaatcaaaatagatttactgcatgttatagactgaattatactcctgcaaatttcatatgttgaaatcctaaaaaaaaaaacacccaatccctagtacctcagagtataactatatttggagatataactatatttggagatagctacactctgagttactagggattgggtgggttttttagtatttcacatttgaattggtagactgagtgaagcagatgccctccttcaatgtgggtgggcatcatccaacacatcaagagcccaaatagaacaaaaaggcagaagaaagttaaattcttctctctctttctctctatctctatctctgcctggctgcttgaactgagacagtcattaaagaggtgattaagttaaattaggtggggtcttaatccagtttgactggtgactttataagaagtggaaatttggacacacacacagacaccagggatgtggcatgcagaggaagactagatgaggactcagcaagaaggcagctatcttcaagccaaggagagaggactcagaagaaaagaaacctgccaacaccttgatcttggacttctgggctcaagaactagaagaaaataaatgtctgttgtgaaactaacacacagacaactatctagaaaataagaacataatttaaaaataggctatttaatttatataggtttatacattgtaaaagcaaatataaccctctgactgggtgaggtttacatagccacaaaggagagttatgacattgtgtatgttgaaacacgggctgtatcaggaaagcactatcattttgccacaatgtacttccttgttatttatcccctacattgggccctaagtatttaagttgctaattgtgtttgtttgtttgcttaatctgacaaacacaataaaaacattttcccatatactgtagaaaatgtgtgtgtgtgtgcgcgtgcatgtgtatacttgactgtacattccatcaaggtgagattagcttgacatttcatttaatctatgccatcataatgaagataaatgcatcattctagtaggcattttaaaacactggaagtagcttgaataacatccccttttgtaactttcttggttattaatagttttatgctttgtttccagtttgagctcttcagaccactaaaatttatactttacatagatctgaatttgaactttctttgagagtacattcccatgaaatcttcctaaattgatgatacataattattagattttttttattgctatgaccttttcttttttagacaggtctcactctgttgcccaggctggcgtgcagcagcacaatctcagctcactgcaacctcggcctcccaggtttgagtgattctcatgcctcagcctcccaaatagctgtgattacaggcatacaccaccacacccagctaatttttgtatttttagtagagatgagtttttaccatgttggccaggctggtctcgaactcctgacctcaagtgatcctcccacctcagcctcccaaactactgggattacaggcgtgaaccaccgcacctgacctgctatgtccctttaaaatatatatgcataactttcaggtttcttgttcaattaaataaataagtacaaacctactgcttcattgcaaaacctatgttatagtctatgccatagaaagaatgttaaacaatgttacttatggtgaacaaaatataaaatacaacaaattagttgtaaataaaattaaacataaattatcaaatgaatgatgttaaattaccattaggatttgacaaactactagacttagacactgtctatgatcactgaaaataatgaggcatactcactcatgaggttcaaatcagaggccaaaacttcattagcaccatgtcctggctacgcaggacagatgtttatgagcagcaaataccattgtcaaaattctcaattgactttgcaaaattcattagttgatataaattattaaagaaaacacaaaacaaacctagcaccactgaattgactgttaattccctttcttaattataatagttgtgcataaagcaacagatttaattgccacaccattaatttatctcagtcattaaagcagtataaataaaaccaggttagcagttaaagcagtttgttcaaatgatgatgatccttccaattaagctgtcaactaatagtaagaacattcatgggacgcacatttctccatttctaaatgaagctggtcagggccattccaaagggttctacgggtttttctctgcacataggcacaaagtcaagctggtgagtgggggctgaaagccagccttagcctactccctaagccatgcatctattggcctttgggagcccagaggaggtgcttttgagtaacacacaaaggagcccttgtgccctctcagccttgaggctgactctattttctttgattgaataatgctacaaattccacctattcttagaatccagtgtaacaaatatctaaatagaatgtgactcatgaataatttaaccataggattcttttgaacatgatttaaacattaacaatttaaagtaattttaaaaattgtatgactaactttttaaaaagataaattttaccttctaaatattttccaaaccttaaactgtcaaactttgatttcacaaattagtagaatagaaaggcaatttgtggactaaaaagatattatctcaatgacaaactaatcatctgaagattgctcaaaattaaagatcaagaagtaatctctgccctacattttctaacattttgcaacaaactaagcttctcaacatttgaaacaaataaagcaacagagtatcagattatgactgctactttccttctatcaatgccctttatgatgagagcttaaccatgagaaaaattcagaatcacgagaataaactatgtgccaattaaatattaagatagttttaaaatgatagttcattaaagaagcaaatggcaatatttctttttttccttcaacttttaagttcaggggtacatgtgcaggatgtgtaggtttgttatataggtaaatctgtgctgtgggcaaatagagatacttcttttcagtcattccttattttgaaattcttttttaaaactgttaatcaggttaataatctaaagaaaaagtttccaaccctttcctggatagtctgcatttatccaaagggtacatatcattttagcattcgctatataacttggaacaagtaaggaaaaagattaactacttgtgaccatagccctttagaagcgtttttgattccctcggaaactcaaattcttgtgatatatcagaattgttataagagtaacagaataacattttgtttcttttactcctcagccctactgaattttgctaacaagttggaactttgagttattttggctcagagagcattttttaggatggaggtacattgcttattatccttttattcttcaattctctcttgggcttcctaatcacaaaacattcattaaactaccattctctttatcattaacagatcaggtaactttaaatatttctgtattcttaagcaaagggaaagtggtcattgtgggcacctgtataaatgttagtttttaaagcttcatcagatagaaccaaaaataaactacagagtgtggaccacatctcagaggtttaattaaaactcaatcaatcacgttatatgcattgagtgaaataaatgatctgtgataaaaatatgtgttcatatgttttagccaaaaaaataaaattcttgcttaattaaagcaaaaattctaatgaattcaagtgtatatttatatgatgctattttaaaaatagtaatgatgcagctattatttgtgtgagtttttatatcaagaatactataaatatattctggtacacatgtccctttggttttatttttattttcttagctaaggataataacattattacccctacaaaaattgtatatgctcattataagtaaccaaaaataaaacaatgtagtacaaaagaaaatattcttaaatcccttaaaatcttaacatttagaaattattttctgaaagtttattgattaacactctggacatttttcctatgtacagagagagaagaaaaggtagaaatatatatagataattgattgttccacttgttaaaaagataagtcagtcaagttgctaagtaaatttatattaaacttacagcctggaaaattgtcttgaaagataaatattttagtttcaagagcaaggcacttaagagacacaagagttttttcattttccaatgatctggacttcgagaggcaaagccatgaagaaacaaggcataaagtttgtaccataaacaggaagttcaattacttttgagaaactgaatcctgccaagcatcatgtgactgagcttggaagcagatccttccccactggagccttgagatgactgcagcccccaactaacaccttgattgtggctttctgagaggccctgagccaaaggacttaacaaaactacacctgaattcctaatccacagacgctgctagacggtaaatgttatttaagccattaaagtttggggtaatttggtacacagcagcagataactaatctatcatctagtacatcaaaacctaaaatgagaaactggaattaaataattaatattgaattaaaattctatctcttatagaaatgtatgcatggattggactccctataatcatctttatatccttattttttccatttcattttagatcatttcattaaatctacttaccattttactgattctgttttcaactgtgtatatgttcttttcattgcttctaatatgtttttcatctccattatgttttcttttttattccattttgtttataagttcttccagcttacttccacctcattctgttttctttatgatattattttggagatattgtattctctgctttgtttaaaatacaggaaaattctttatcttaacatcattcaaaaattattttttctgttattctgggtaattcccctcacaatatatgttcttcatctagttttaattatattcatttcctccttttgcatttgtatgcataggtactgtcctagtcatttctaattattacttttttaataaatggatctgctaattgttctaaaactatatgaaagaggggttagaataggtaacaggcaatgagtattctgggacattatatagcctctatttaagactgaaagtatgtgtgctcccagaatgcatacactgaaatcctaacccccagtgataatattagtgggtgaggtctttgggaggtgattaggtcatgaggatgaagtcttcatgaatgggttgacagctcttatacaaagaactacaaagagttctcttttccatccaccacgtttccatccacagacagaagacaaatatttatgaaccaagaagcagaccctcatcacatatggaatttgttggcaccttgatataggattctccatcctctagaactgtgaataatacatttctgttgtttagaagccacccagtctatggtattctgttatagcggcctaaatgtatcaaaagacagcctccattattatacattgtccccaacaatacttaccatctcactaaaactgctattttctctgcaatgggggcacatctttcctcaatttttagcactcaagtaaatagtgtggcttagtgtaataaagaccctctttagcacccccttcatccattttacttccaacaagaagcctagttcccaggtaataaaacgtcatttgtcctgggatctgcctcacttggtattccttggtgtcaaattgtgtcactctaggaacaattctagttttccttacataaaaattactgaatgctcttttcagaattgtaactatttttttaggacaaatatgtaacttcctcaaggtccaagcaagtatatgatggcttacaacataatcttcacaatatatgaccaataaacagagttcacagtttctaatttggaattgtggccatttctcaggtcatttttttctctagttataattctttttattgacttagtt
